United States Patent 11,549,145 (METHODS AND COMPOSITIONS FOR INHIBITING AND TREATING NEUROLOGICAL CONDITIONS) - sequence listing, part 67

SEQ ID NO: 1475 - DNA, 160106 bp, Homo sapiens
ttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttgaaaaacatttttggattgtttcattctttgcttgtcatttatctgttgattagaccactaaagtgaaggattcaagctaaatacatcaacctttctatttaggctttatcagctatatgtaaattcaattctatcaaaattttctgagtgcctcctcagtgtgtctctctgatggttcctgcccggtatggctggcatgaagaagatcctgtaaaaaagagaattcatttatttattcacttagtttgttcatgcatttgtttaataaatattgagatgtaccatgtgcctggcattgtggtaggtattgggaacacaggagtgagcaaaacaaaagtcttgctctactgcagttaagggccagggagaggcagaaaaagtaaataagtaaaatctatagtgaatttggtggtatgtacaagcggaggggaaggggttacggttttagatggactggctctttcagaagctgacacttgtacagacctgaaagatgtgaggaagtgagctatgcatctgtcgggaaaccattctgaaggatacagcaggtgcagactccagtgggatggttggtgtattctgggagcagccagacggcccatgtggctggagaagggtgagtgtgaggagtctaacaggagaggcagagaggaattggggtagcaccggaggctgcctcttaggccacagtaaggacttcacttttgactctgggagccagtgtaggagttttgagcagtggtctgatttaagctttaacgaatcacccaggcagtgggaatcaactgaaaggggaaccagtgagaagcttttgtaatcatccggacaaaatgaaggtgggccagactagggtggcagcagcagagcttgtgacaagttggattctggacatattttgaagataagagttaataggatttgctgatggattggataaaggttgtgagagagacaagaaaagaatgatgcaaggttttagcctgagcaactggaagaagagagttgccgtcagctgagatgaagacaatgaaagcagctttgcggacgcggtaagtttgagatgcccgttaacgagacatccaggtggggatgctgagtaggcgggatgcaaggctctggagttcatgggaaagctccaccaggaggtagaaatctgagagtcatcagtgaattgatggtatttaaaatcagaggagtagatgaaatcagcagtgaagtgggtgtagatagaaaagacagggggccccaagactgagtccagggcagtctggagatcagtgggatgagggataagcccaggagactaaaaaggaccagcagagactaagagttgcaaattagtgtggtaagtacagtgaatgcagcaggcatgggccccttaacgtcttcttgtctgtagtccttgatcagtctgctcattcacccacctatctatcctgtactccttgagcatctgcatgccaagcactgttttaagcagcagaggaagcaataagtaaatacatttgagttgttgagagatcatggggacaacagatgataagaaaacaggacagtatcagcagttgtcttatctgaaaaatgaggatccgttcctccctccagattgttgtaggatttaatgagataaagctcctgaagcacttatctcattgcctgcactaagagaccgctcaggggacattctgcaatgccatttgagctccctcctctttgcctggcaacagccccagctgccatctctgcctccagttgtgcccttctgcatgatctttccagagcactcatctgaatcacattaaacttctctgtttaaactttgtgtttacacttctgtttaaaccctggacctgctccaagttctcttctgtagctttgtgtacactgttttctctatgctgtcctctcaccgattttcttttccccgctaactccctatgtttcacaaattctttaagatgaccctcaagagctgaagggctgccctgccctctcctagcattctcttttctctgtcatggcttttgttgttttggaattgcttgcttattgaggtccccagtaaatcgtaagctccttgaaagccaggactgtatagagtctaacatgagcctagcattgcaatgagggcctcagtaaacacttgttggatgactggaattcatctcctgagttccatgggatgaatttgcccacgtgttcataacacagtctatgttcttcctttccataaggatatcatgaggctgtcaaatgaagatgtagcatatcaccagcattttatcttgccgttttagtttggcctttttctgtgaaacatcattaggggaaagtaaaactttacttggacaaaagaggtttgctaccaaattatataaaatgaataaacatatccctggagtgtttaagtcagcaagtatggccatctattattccacagacattttatattataatttactcactgaactttaacgaaggagaaaatgattttctaataattcttagtctttgaagattgtcactggaatacattccttgctcataaccactccccttgggaccgtggatatactatacagttattaaaatgcctgaattagaaaatctgctgctcttgggctatgagtttaactatagaagaattactgtatatgctcacacgagaggggcagaagaagggggtcacatttgagacgtagcagagaccaggcctttgaagtcctctggcatcaacaatgacttgctcctgagtcaaatgatgtgagaaaaccagaatttgggaaattttcatttcaattaagattcaggaaaatgagtcactggtgttctttgtaaattcatttatgaggtcaggcccccagaactgggaatgctccttatcacatagaaatgaatagaaaaatctgcctctgtaatttccatcacccagggctagaatatgtaactagagagggtggtcgaggcctgagtttgggtctgggggttcagagcaaccgatcaaactggaaaactgagcaggtgagtggagactcctgctgttctgaggagcacacgttcgcattcattcaaatgtttatcgccgctccactcgaggcactgcccaactctcatttatcttcacagaagttgagtggatctgcagactgcagcttcagtttttagatagaggaagaactaaaccccagcagctaatcggtgacaaagccagggctagaatccaaatctgctattctttatagatagaaaggccaagactcttaggcttgtaagtcacctgtcagtcacaactggaagtagaatactcctgggttcagtggcagatgacatcagcctaggggtcataaggcttggtttcactagctggggaaagtcatccaatagcttacgtgatggttttggagatgttcttatattcaccttcaattagcagtgagcccttcactaagcccttcatcttgggcttattgccctacttgctgtcaattaacctctggagacacaccaagtcttttagaaggaaggaagggagctactattttttgagggccttttatgtgccaagcccacaggctgggcattttccatacgttatttaactgaatcataacagtgctgcaaggtgttatctctttcataggtgtgcaaacagatgcagagaggttaggtttccagggccccacagccaagtggtggagctgggtttctggtccacggccttctgtctccactgggtgacactccctgtaccttctcattgaagcccctgggctagagggtccaagagcatcacttcagttctgcatttcattcgttactcacttgcatcaggacagatgcatcactactaagctctcggagaaggcatcagatgctgtctgctcccaaggagcttctacttttggtagtctgcttaacttgtatctgtgcctgtagagattgctctttgaaaaaagcagcaggaacattctgatagaagccaatggatgggacaggtggggggaatgcgttggatttgccagcacctggccactgcccaacctgctctcaattctcagatgattcaggtattgagcaaggaaggtagcagagctactgttgccttccctttggggaagcctgtttctactttgaaactcttaagggattcatttcaaattagtggcaggccttggttagtggatctgtgtgctgtcttctgccatcttgattgcatctccccccttctccttttcctttcatttgaaaaaagatgcagcccctcagagcctcactttcctgatttgtcaaatagggaacctaatgtacaaggcttttgtggggcttagaaaaaacatgtcaagaatctgatatagatctcaataaacagcataatacttatctttcgtcccagttacaaacccccattcctgtactgcccaaatctccatgattcacaaattgcgaccctgctgcttctgctccatggcagacacctagctccaggcaccctcctctaccacctccttctccttatggccattggcttttaggagacagacattgcttacttagcaggaaagctgtcacctgctttcttttgaactatcccgaacttgattctctttgggcgacgcatacacccatcaagtggtaaagaagactgggaatgaggggagaaaagaccctgggcttgttgctggggccagtagcttgggagtgtggtggtatgtgtgtggctttggctgtcaagtggatctaagttcaaccctggctacactgactttccagctgtgtgacttcagcaaatgggttaatctcctcaaggattcacttcctagggaggctttaaatgtccccgggtgattccagtgtgcagtggaggttgagagccagcgccctctactctcacccttgatgcccaaccaactcattgccagtctcctcctttagcacagcccatgatgctgcgatgtctgccaatgcagcatgcccctttgtgcctgctctgcccataacattctcaggagcttgctggacagcacagatgtttggtgtgcatattaacccagctgtggggatctttcctgctcaggtttggtggctaatttatagagcagctctgtcaggatgatcaccaatccctcttacaggcactgctttctctgttcaagtgtctcacatgtgtgtgcttgtgtttgccttttagctattactgtgatgattcccaatgtagtagacactgccagtgaccaccgcaatatccaatctcccccttttcctcactaacaacccctgcattgttgggggctgcagtgtgctcagctaaaactaacaattgcagccacattttccatcctcctacataggggtggccaataagctgtatgcagaagttgtggggtggagcttccaggaaagctcttaaaagtctgccttattcagctggacaatgcttccatcctatggtccttaccatcttttctaatgcctggaatatgtgtgtgctggaggatgctccagcagccattttgtgacaatgaggcaatcttgaggctaaaagccacttccaaaggatggcagagtagaaatatagaaggatcttgagatttcaatgatatcataaagctacaattccagctctgtactgcctatctctgaagttcatgttacatgagggaaaattcaacccctgcctcgtttaagacattgttattgctggtctttgctactagttctttagttcaattcctaactgatacttcccaaaacaaacctggtgaataacagcaattcaacaaatgtcaccgacccctgaatctctgcctcctccacccactcaccccagctacaaacactctttctttctcctgatgagtaaccgggcatctagctgtaaggttgctgaagctttgtggaatctcagaaagtcataaagctactgaacaagttcacaaacaagtgatgcatagaccacacccagcccacagatgagttctgtgtggctcacacttattttttaaaactgggtttgctgccaacacttcaaaacccaacgattttgcgtgaaaatccagatttcttagaaaatctgtggacccagggtcttcctttctgcctggcaacaatcagctggaactcagcagtggttgcccctgagatgaggcacagccccatccccctcactcatgtcacctgtatggcttggaaggcatgtgagtttgcaacctgctcaaacccacaccccagaaacggcccgctaaaatgggatttcagaatccacttgtacctttcttctttctcagtctcccctgactcaacacagcacactggcattgtttttttcctctcagacaactcagcatgcacttttgagaatcagagagaaatccgcctctcaaatgtcagaaaacagctgatgctgcctcttacttgggggccttttgacttcccacgtgtcttactgccacttgagagggagggctgcaggcaggcaggctccctggggagcagctgttgggatgcttgattgaggccctgagacagccagaggacaattaaattgggtattgaatatgaattgctttgaatggtttttattaccacattgtgagctgactttggttgtaaaatctgactccatctcttgctcttactgtggtgatgagacagaacttcaagatgtcttaaatagcagggcttggaacatgcatattagctcatctgtactcgtgaagtctgtcatctgatacccgcgctcctccactgtctgaaccaagttaggagccctgattaaacctccgcggctgcagtcgccaccttccgccggggtgaccccattggagatgacaaatgaaggatgtcttatttcagcctgatgtgtaagtcttcacagcactggtcgttaactactcttggaaagttaaatgcccatgcagctttttttttttttttccccaaacaaacataggtctctgaggttttggagagaaaaacaaaaactgttttaataataatttgtagctatgctttttgatgagttgcacactgagtgcaatatgttggctgcagaatgaccatctttgcagaagcaactctaaggaaagtgatgccacgctaagcacagagtgagttctcaataagtagaccgacttgagcggaagacagaaacagttaagtggagttggcatttccctggttggcaccaaggtctcagggttatttcgaccacaaaattaagttccagctcctagctactaacagagtcacaatatgcagcatggtgatggtcaaaaggcctgagcaagttcaaagcgccgtctctgccggctttggaaccggtttctgtgggaagcaggactctgttgctggggcaggcagatgcttgtgtccatttgcctagaggcagtaaatgtggggctggctggctggctgttggggagctaggactggaatatggggtgggccagtgggccttgctgcatgtagactctgtgctggctgtgttggctagttagttacccaactttatttcaaaaaatgtgtttcgaaccttcagatcgactagcctatctaaaaagagaacttagaaagttattttttttaaaaaaagtcttcttcctacggatttcctgaacatggccattatattctaattctcttgaggctagatcacttatcaaattttcatttcttttcagaagtaattaggagtgatgctaccttgaatccaggtgtgaatttttattgatttttgaggatttggccacgtgttcctttatccaagcctgtcttctgctccatcttatccaaacaaacattgaaccagcaatattcccaagtattccaacttgagaaaaatcttgtgtgtcttgagaaaaatcatttccatgacttattaatgaactaactagggataattttcatagggttcgttaactcagatttatcatagaatacaatttaataagaaacaattaaatggagtaattgaattcaagtccttttttgagtaatgatgttagcattcaatgaccccccctgcccatggttattgaagttatcaatgtatcaattttccccttgaagaaaatcagctgcaaatctcttcgtcaatgcatgggccgcctctcatctgccccctgcaggcctagcccttccttttcccgtccctgctctggtctatggggctgctgtgtgtatagaaaaaaatgaaaggactgatgaccatgtagataatgtttttccaaacataccatcgaggctgtgctacaaaagtgatccagtttggtggtcctttctcttttagagatgcctgttttgacaattcctccttacagtctgctttaatatttaaaagaaggcagtgggggctttaggttaaaattaaagtttcagaggcctgtgtatctttctcagactggttgaacttggaactgtgcaacttttctcaacaattttgccaattaaaaaagtccctttagctgtagatgctgagaaggctgggcctttggttctgctcctaaatgggagtggggaaggtgctcacagaacgatgccaagcaccactgctgtacaacttctgttttatttttgtgtgctttttttataggatataaataatgacaaaaattacaaaatttataactggaagcccaagcttatttacacatatgcttctgtttcagcaaagctcctattaactttgctcctatacaattgcctcctggtaccatattttagtgttatttaactctcattttgctacatacatatcaacagtgaataggcaaaatatatacaaggaactgttcagttcaagtaatttaatattgtattaaaattcttcaacactgaactaaaaccgtatacatttgttagtttgaaataaaatgtagttattcttcaaaactcaccaactgatgaatgtaactgatcatctcagttaggtttaaaataatgtcagttaataaaaaaacattaagacaattccacaatttatcaatatcgctataatgaacttcaaaatgattcacaatatgattgttagaacaatatacattaaaatgttatttttttctataatgatattggtactgtttatataatttgattctacataaatatacattatggtatcatacaaatactccacagagacattaaaaaattaaaataccttaaagaaatgtaagtaaattttatttaatcaaatagtaagcaaactttttttttgtttgtctcaagaaaagttttattactttggaatttcttcttttttttttttgtatttattttttctagaaaaagaaatttttgcaatagaattttattaacacctttctcaaacaaggtttccatgacagaaatcttgacagcaggagcactagatttttttttttttaacatgttctttaaaacactgtgaagattaaaaaacaatcttggcaggctgatggctgcgtcagcacttccgggcctcctgctctagggagcatcaccagtattttgccaccactgagccagtcctcttggtagtagcagtagaaatttaattatttgaaatgaaaccagaaacatccctcgcaactaacctagttttcttatcaatgcattaatgaaacattcttttaataaaaatatttaatacaagacacattttgctgtgcataataaattcctctgctttgaatcattctttccttttgaaccaatcatttggttgaaaggttttctttctctgacataggtgattacatataaaatccacaaatatagaaatggggaaacagaatctcctggcaatcatatcacgggagttgtttttgtccttttgcattaaacgatactcaatgatagaatgattttacagatgctttggaggtgggaggggtagtgctgctctgatttcacctttaaaactgctgacagtgaaagcatacttttaggcagtattagagatcccctttacttttttttttttttttttttttttaaagaaaaggtattattttccccaaatgaagcaaagcaagtactggggcggagtcatcagaaataccttgggaggtggtggggaggggagtcgggagcatcagggaaaacccatctcaactcacgcctctcaggggttgcgactggaaagtcttgcgttttccatcactggtgcagaaagaacttccccaggaatggccagtggcctttcgcccgtaacaaggccgcacgctcagagcagtcttcctcctgggctgggtggacgcggaggcgcgaaggaaagcctgctccgggaccgcttggcgagcaaggcaccgcgaggacaggaggacggcgagtatcagaaaatcgtggtttcatacttggtattaatgcccctcttggcttcttggcccggctccacaatccacggtagattggccagagtcttttgctcagatgggtcgatctgctttaaaacagaaaggctgatgcctgttatacggtcgccgcgcgggtgcgcgcatgcacgcggacgccgctggcgaacccacgcgaggcccctcgccccaggcgcggggcggcgatgctggtctaggcggctcgcgggctcgctctttggacacacatttaccgcataccgactctctgcagggcaccctgagggtgacggtgaataaggcacagcccttgcccttgtgagcacacagacggggagcagacagaggcggatttcagtgctgagaggtgagatacgaggggaagagagggcaccatgtgggcacacacaccttgggagccaggggggcttcctggaggaggtgaatcaggcatgccactccccggctctcactctccagtggtttccatcacagtcagtcagaacaaaacccgaactcctcaccgtgacctccagtacccctgcccacctgatttttctgctgcagccacacagcttccttgctcttcctgcccgccaagcccacgcccagggcctctgcgctcatcatctgctctgcccgagttcccttctccagacacctgcatgcctcatgctctaatgccattcaggtctctgctcaaatgccacttccactggcacctgtattcctagaagcctttcctgtttactcctacaaaaagcaccccaacttttctgctctcctcttctgccttattcctgacaatacttattgccgctatgcgtcatcacatatttatttgttcatcctccactgccacgtatgctcatggaggcaggattttgtctgttttcatcactgccattttctccaaaacgcagaaaagctcctggcaaccccgtaaataataggcacacaataaatacttgttgaataaatggtatcaaaagaatgaggtaatatttaaatggacagccgaaggaccagcaagtatttgcctgaagacaggaggagggggcatttgaagtagatgaaacagcacatgcagcagtcccagaataatctatacaacagaatgaaacacagcctcatcttccactatatacagaaatcaactcaaaatggattaaagacttagagggaagacctgagacgatgaaagaactggaagaaaacattggggaaacactacaggacattggtctggataaagattttttgggtaaaatctcaaaagcacaggcaacgaaagcagaaagagacaaatggaattacatcaagtgaaaaagcttctgcacagcgaaggaaacaatcaacaaagcgaaaagacaacctacagaatgggagaaaatatttgcaaagtatccatctgacaagggattaacaaccagaataaataagggactcaaataactcaatagcaaaaaacaaaaataaaaaacaaaaacaaaaacaaaaccaactcaatctgattaagtaacaggcaatagaactgaacaggcatttctaaaaagacgacatacaaacggccaacaggtataggtaaaaatgctcaacatcactaatcatcagggacatgcaaatgacaatcacaatgtgatacgatctcacccccgctactattgaatggctagtatcaaaaagacaaaaactaatggatgctgatgaggctacagagaaagggaaacacttctacactgttggtaggaatctaaattaggaaaggcactatggagaatagcatggagggtcctcaaaaaactaaaaattgagctaccatatgttccagcaaccccactactgcgtatatatacaaaagaaaagaaatcagtatatcaaagagatatctgcactcccatgtttattgcagaattattcacagcagccaagacatggaatcaaactaagtgtccatcaatggacgaatgggtaaagaaaatgtggtatatatacacaacggaatactattcagccataaaaagaatgagatcctgtcatttgcagcaacatgaatgaactgaaggtcattatgttgagtgaaataagccagacacagaaagacaaatattgtatgttctcatatgtggaggctataaaaagtggatctcatggagattgagtagaatggtggttaccagaggctggaaagtgaagaagggagagtagggatgaagagagattggttaataggtacaaaaatatggttaaatagaaggagtaagttctagtatttgatagcacagtagggtgactgtagttaacaacaatttattgtatatttcaaaataactagaagaattgtaatttctcaatacaaaagaaaaatatttgaggagatggatatctcaattactgatatgatcattacatattgtatacatgtgtcaaaatatcacatagcaataaaaaacagtcccagaggtaagggaaaatggtcgttgaggggttggggtcagtttgcagggtggggagcgggaaggcagacagctaagggtgaggaggtgagcagggacccagtcaggctaagccttgagacaaatcctaaaatggtttcgtccctgtgcgtacaaatacaacgggacactcctggggcggggccgggctgtccgctctcaggaacggccctcaggtggatctacaccatggctgcctcttcctttggtgtttccaggtctgcctgccctgtcctagctgcctgctcttctcagagcctgaggttgtgggaaggcctctcccatttctctggcaccatgagctttgcagctgccttctaccgtgccttgactgtatctccataaagctgtggggaggacctcacgtgttcttagggatcactgaatatttcttaccaagaaatgcctggggctgaaggaactagaatactaatgcctgtcgagggggactgatcttgaagcacataaataacatcagtattattcactgtatattttcctatttcccttgaaggcatctggatgaatattctatgagctcttatgccacccaaccctttgtgctcttctggaagaagcctgtggggaccagggtaaggtcagatagaggcacctgctgtgaacagatttattcagcccacatgagaatgaatacaatagtctaagagataatctctaaaacattctgcaaattcctggacacttagcagcctaatcaatctcaaagatatgcttgtgaaatccatccacaggccctcattttgtcatccacagatattcactgaacacctgctatgggcctggttccggtggtgacaacacaggtggggtccctgtgtgcatgaaacttacatttttttttttgagacggagtcctgctctgtcgcccaggctggagtgcagtggctcaatctctgctcgctgcaagctccgcctcccgggtgcaagccattctcctgcctcagcctccctagtagctgggactacaggcacccaccaccacgcccagctaacttttttttttttttgtatttttagtagagacggggtttcaccgtgttagccaggagaatctcgatctcctgacctcgtgatctgcccgcttcggactcccaaagtgctgggattacaggcgtgagccaccgtgcccggcccaaaacttagatttttgtggaggaagatagacaataagccatcagtaaaaaaccctcaattaataaatgctacacagaattaaaagcagatgacatgcttgaaggtgactgggtatctatgtcagattgggtggttaggacatccgcctcttcaagtagccgagacctgaatgacaagatgaagtcagccatgcagaaaccgggggaggatattccaggtgtggggagcaggtggcataaaggcctcaggtaggagtgagcattacatagtcaaggaatgggaagagctgagcatcacagaggactgtggtgggaaactgcattctgggtacttggggcagagggtgccatgactgatctctgctgtgtggggaggggagtctcaaggagctatactgcataggcctggggcgaggtggcagtggccccgactggaagagagatggaggaagtggggaagagtggacaggattgagatatattttaggggtagggtggatgggatttgctcatgggctggatacagaggtaaggggaagacagggatccaggctgacttgtagactttgggcttgagttgcatggtgagtggctgtggggtggggaagttggtgagagaagagctttgaggggaaaatcaggaattgtgtcctggacatgctaagtttcagatgtctgtgaagcatcaaggtggaaatgtgaaagaagctggccacgtgagtctggaattggggggtgcccagggctggagatacagaactgggagccagtgtgttgggttgggtcagtgctgaatgggaggaccaggggctcagagcgtggcatcggaagaaagacttcagaggagatacagctcctggggatggctggtaatgagtgatggacacaggagcgaatggccggggctggagggaaagatcccgaaagtaaactgtcagggaactgtgagaccagatgctggaggggtcaatcctgtggatgttgatggtgccaagaagggtgacaggggtaggcccccaaaagaagactgaaaacaagaactgcatgttcacaaagggaggtgcctccctgcaaatgttaaaaatgcctgctgctgttccccatgacagtggaggtgggggctggtgagaaggaggagagacagttccagatggaaggattcgggggcgtgagagcaatgcattctgggggagtcccagggtttctaggatgcaatacggcagccggggcagaaaccagatgggaggctggttgggaatcttccagcttttgaatattgctactaccagaggaggccgctttgaagtcatgcaagcctgttgggacaggatgtctgcagagcctgtgggagggaaggggaagaaattcctggaggaaggcagatgctgagaaggaggggctgcaccttctgaacaggcaccatgccgcaggaagcctcagctgcgggagacaaagcacgcaggccatggcgcaggccttgcatatagcagggcagcctgtgcatccagcttcctctagctggggaccgaggacatcatcactgtgtacctctgcaaacctctctggaggccaggggcttgtaggaggctttgccctctgatgggatggcagctgaagccccagggaacactgctcccaagctttcctgaatctttaggtaagattcaccaagaacagcagtacctgctgctgagacccttcatagggttgctgcaggtgactgagaaagtggatttctctggaggctccaggttgagggagatggtgcccaagacttggtgggaaccaggcagaggtgatgatggacacatgccaggaggaggccaagggaaaggatgaagaagaggccctgggttctaatggcacccacaccacacaagggcctggttagcagccccttttcctcctgttcaaggttttttagaacatctgtatcgtttctacttaccacggacttgcgaatgctaacgcggggcttggggatgggtttggagggtttgttttcaaagctttctggaagtgtggaggagtgtcccccttttcttgcttgtagtgctagctggtaagcgacttcgaatgcctgtcccagggttaggatgatttcataggctaaattctgcaagaaaaatgagaaagcatttgctactggcacactgcaaattagaatgggtcgaatggctgaggaacactgagggaggtgaactagggaggaacttgaactacttcaccagaggcagcagcgattcggtggaaatctacaaagaacaggacactccgggtccaacttagggtttacaccaggctttagtcatttgtgaaaagaaaaatcttgggacctcaaatcactaagacaaacgaaaaagtcagctgggaactgtgttgggcaaacctgccttgcattctattcctaaataagatagctacaaagataaaaaagctacatacctccctcacaatttgcccaaaaggaaatttcctgtggacaaaagacagagctcaaagtcatgcctctgctcatgtgagataaatgcatatcagattgcttcccctgtcctgttgtttccctaagccagactaaggcataagtgactattcctgtaaattgtgtattcagtgaaaggctgatcttcagaaactcaaaataattcaactgtttgtctcttatctacctatggcctggaagcccccttcccatttctagttgtcctgcctttccagaccaaaccaacgtacttcttacacatactgattgatgtctcatgcctccctaaaatgtataaagccaagctgtgccctgaccaccttgggcacatggtctcaggacctcccaaggctgtgtcacgggtgcattttttttcttttttttttttagatggagtctcactcttgtcacccaggctggagtgcagtggcacaatcttggctcactgcaacctccacctcccgggttcaagcgattctcttgcctcagcctcccgagtagctgggactacaggcacgtgccaccacgcccagctgatttttgtatttttagtagagacggggtttcactatgttggccaggctggtctcatattcctgacctcatgatccacccgcctcagcctcccaaagtgctgggattgcaggagtgagccaccacgcctggtccacgggtgcatctttaagcttggcaaaataaattgactgagacttgtctcagatatttttggtttacacactgatagggcactcttgcttacagatccccagttagccccaggaggagcaggccccacagcccagtggccccaggagcccacaccattcaaagctctccctgtgggcagttggtttgtccccaaggccttggaaggtaaggggttactactggtatttctgctgagtcctgggagcacttcaaccttgcctgtgaggatgatcccacacactccacaggaggtgttcctgagaagtttgggtctttttacctcaaacatctgtgattcagtgaacatctacgaaacacaatcaaaatctaatttaggcctagaggagaggcattagtcatgctggtgtggcggctcacagtcgcagcagtgagcacgcaaacagtgctccaacagagccaattccccagctatttcttgaggcttttgctctccctgtgggtccactctatattttatcatgaaatcagcaagagacaggtgattctgtcaggctagatgccacgccaagcagcgcctgggagaaaagttcttttcttccgaccttcaatcagtccttttctcaagatgatttctagctttcttctcttctccaaatgtgtatctttgatttctgccttttcttccaagcacagcttccccttgtcttctctcactgagaaaccatcacattgtctgacccaaaagaggcagggtggccaccacaccctgaggtcacagagcatcagagaagcagatgcatactggtcacagagagtgttctgaaggtcactgtagcagctgagagcaggcatggtctgccccaagctttcttttttcttttttttttgagacagagttttgctctttttgcccaggctggagtgcaatggcacaatctcggctcactgccacctccacctcttgggttcaagtaattctcctgcctcagcctcccaagtagctgagattacaggcatgcaccaccatgcccagctaattttgtatttttagtagagatggggtttctccatgttggtcaggctgagcttgaactccccacatcaggggatccacccacctcggcctccaaagtgctgggattataggtgtaagccaccgtgcctgaccatccaagttttcattctgatgaatgtccctagaatgtccactcacggtttctcaaaaatcacagaaatgtcattctgctgatgctgatattgcaactaagctggccctctctgttcctgcccatctccaccctcatcaagcgctctgggagcccgattcccacactgctgctggggagatgtgtttgcgattgttcgcatttgaagatgatggagaggaagatgcaggatggtgccttctgaggccatgggaaagaggcccaagggttctagaccaaccagattccagatccatgccagatcaattgtgatggtctcagaaccaagtggggaaaatgcctctgagcttgagagtcggtttgagagaggatgtgtctgtctcctttaagtgagttgctaggaaatactgaccctacaagacagacatctgcctgctggagatactgcaccttgcacagcaagctgagcacttccttgcaacgaacactgagcccatgtttgcctccagagatgagtcagcctagtaaattagtaacgcaccagcaaatgatagtggaggaggtctgggagacagctctgaccatcactgcacaaagagggctgagctctttccactgcctacacttggcactcacgtcactgtcagctttgcctcttagtgtttgcgtgggtcccctctgaaaggcaggcagggcttccgacttctgtagtctcacaatgaagacacaggctcttggtcttgttcatgctactgtggaagatggctgattcccatctgttggggacatgtaccagatattcctgttctgggtgggaaactagactaagatgaaggtgtgagattcagtgattctgtaacatgtggtctttatctgctgtaacagtggaacttaatgagtgtgaattcctttaccattaacctaaaaacaagttactgaaagcgagatctacttaaagctccaggatcttcaaaggaaagtaaaaagaccttcatttgagcaagtgaggtttttcacatgattatgggaagcctaaaggttttgggagagaatgtgttagaagtcctgccctttcatttttaattagttcctggtattaggaaactgctcaaataagacacacagaccagactgttggattaagttttcctgcctaatggcttcttctggttccgcttacattttccttgacttcttgctttggttttattttagaatgctttgtcaagtttcttttgtgattatgtatagtacaggattggacactgttacctttcctctcttgtctgcagccctcctgtttgtggtactgatgctggatgccaggagggcccatgggcaccgagacacaccttccaagtgctgtgttgcccatcccgacacaccagggccctttcggggaaacagatgctcatcccatgggacctcaggacacatgtgtgaatggggaaagaacccccatttttttgtaggttcaattctcctgcctctcctattaacatccctaccatctgaaacgggaggagagttgctatcatgtacgaggagactctaccgggatgaggttgaaaattatattgtaacatcagaaggcttaggtgagaagcccatcttgcaaacctcaatgatgctggctggctctgaagagcccatggtgacacccagaaaatctgaaagcccaactgtctctgccttcaacatattatccctgcaactgtggggaggccaacgcctggtactgggtctggcacattccaggtgcagaagaaatgcttgcttgcttgctgaatgaatgaatgaatatccacaggactaactggagtaatcgtaacatttctagttaatactcagtctagctaccattaagggagaacttaataggtgtgagagatgtgccaagcattatctttgtttcatttaagtcttaccaaatcacatgcagtagcatattatcctcattttatagatgaggcagtggaggctcagaggggtgaaataactttccagacatcacagagacagaaagttacagaacttgacatgacccaatatctgtgctcaaaatcccccactcttggcccaacccatgtgtctacccagcttgtctctaagatgactgccatcaactctcccctcccgtgcacaccatggtgttcccctgttgagaagtcgaatctgctctttgaatctggactggttttactgacttgcttgacccataggatatagcagaagcaacatgctgaatttgtgaggttgaatcatgaggagtcttgcagtttcctcctgggcctctaggaacattactctgggggaattagtcatgtaaaaagtctcaccatcctggctggatgcggtgactcacgcctgtaattccagcactttgggaggctgatattgtttagctgtgtccccacccaaatctcatcttgaattctagctcccataattcccacgtgttgtgagagggacctggtgggaggtaattgaatcatgggggtgggtctttcccatgctgttcttgtgatagtgaataagtctcacaagatctgatagttttataaatgggagttcccctgtacatgctctcttgcctactgccacataagatgtgcctttgcttcttctttgtcttctgccataggcctccccagccatgtggaactgtgagtccattaaacctctttcctttataaattacccagtctcgggtatgtctttattagcagtattagaacagactaatatagaggctgaggtgggtggatcacttgaggtcaggagttcaagaccagtctggccattagtgaaaccccatccctactaaaaatacaaaaaaaaaaaaaaaaaaaattagccaggctttgtggcaggcacctgtaatcccagctacttgggaggctgaggcaggagaattgcttgaacctgggaggcagaggttgcagtgaaccgaggttgtgtgactgcactccagcctgggtgacagagcgagactccatctatctttttttttttttttttgagatggagtcttgcccttgttgcccaggctggagtacaatggcgcgatcttggctcactgcaacctgtgcctcctggcttcaagggattctcctgcctcagcctcccgagtggctgggattacaggcgcccaccaccacgcctggctacttttttgtatttttagtaaagacaagatttcaccatgttggccaggctggtcttgaactcctgtcctcaggtgatccatccgcctcggcctcccaaagtgctgggattacaggcatgagccaccgcacccagctgagactcaatcttaaaaaaaaaaggaaaaaaaaaaaagttcttgctatcctgagatcatcatgctatgagaatgcctgagctagccacaaggagaggctgcctggacaggaacaacggtttcagccaggccagcccaggctcaagatttgggagtgaaggggtctcaaagacattggagctccagcagacatcgcttggagaagactcaagacccagacagatggctccagtcgggctgccccagcatctccagccattgcaggcactctggctgaggccccagatgttgttgagcaggactgccacgcccagcccagatccctgacttacagaattgtgaacataataaatggatgttgttttatattttggggtggtttattacgcagcaagagataactggaacaccatgcgatgctgcagaaggctggttggaccctcattcagacaacaggaagatgacccatgagcccaggagctgtgatgaatgctgcttagccaggaggccaatcctggagccacccggtcccctggctgccctggctgtggggaagctcactgatcacagtgagcactaaggtgtcccatcccatctgctggctcaaaccactgtgctgcagtgaagtcagcaaaatcatgctctcatctccagttactacctcccttgggcataaattcaaactcatttagttttacttttattacctcacgtctctcgaatgctgtaacctggcctgtctccgaccttggctcttcctgtctcatataagctcattggaagatacttgctttggtctttctagcataagtcttttgagacacatttattacggcgattggtctggagtattgtctaccttacagagaccaccagtgaaagagagctgcatgtgtgtgcatgtgtgcacgtgtgtgtgtgtgtgtgtgtgcacacggggtgcaggtgtgagggttgattactgaaaacagcatactctgagccttggttttctcatcttaaaatggggataataccatacgcagtaccccctaactggattgttctgataatggctaataatattatttaaccaaatggcaataccggctagcatttattatttactatgtggccatgcaccatgctaagtgcttcaacatgggctctttaattcaatcctaaccgtatctgtatgccgtaggtctattacttccattttgcacatgagataattacgctcagaaaggttaaataacttgctcatgaagtcagcacccagacaaactgggatttgaatccagttgttctttctgagaggctatactcttcttgaccattacaccttaaaactatacataagataaaataaaaaaaattctgtaatctgttttaaaaagtttaaaaaacatgtgagccaattgagcttccaagtgactgacccatcttggctgtggtgaggtcacctactggcccattgcctgggtctcatgcccagtctggctgagaggcagcctccaggccgggggtgtacttcgtgactccacagagaccatcaacacaggaattcttcatctttggcttccccaagggtgaggtaaaagatacgaggcaactcccatcctcagtagtggctatttaggaagaagggtagggagtcccagtccaatggggaaaaacctcctggaaagcacaggaattcccctcttcccttcccttctcttctcttcttccccagggatttttcttttttcttttcttttcttttccttccttttttttttttttttttgagatagggtctcactctcttacctaggctggagtgcagtggtgtgatctcagcttactgccatctccacctcccgggttcaagtgattctcctgcctcagcctcctgagtggctgggattataggcgtgcacgcctggctaatttttttttttttttttatggcagagatggggtttcactgtgttggccaggctggtctcgagctcctggcctcaagtgatcctcctgcctgggcctcccaaagtgctagaattataggcatgaaccactgtgcccggcctgggattttgatctgcgaattaagaactgctacattagaggagcttaaggaaccactgtatcataaagataaatcctaaggcaatcaagggatgcaaactcacttttcttgtgcaagctgaagatatgcaggtcagcttatatttactgtggtttcttcaaggcaatcatggatattgaacatcaccacagatatttaccaagctccttccaagtgttaagggctgtgtccctggtgccagtcccatgcctagcctatagacaatgtccaggaagtgatcactgaatgacatgggggagtaaaagtgtccatcaagactctcattacatccagaggaggctcatggagagacaaagagatcttcctcgctgtcctcccgcatccttgtccccgaggctatacgcagcatattcatcggtctagtatgagaaaaattgcatcatagatggtgggcaatctgtcccctagaaaaagctctagccaccaaggtaattaatttattttaactggtacatcactaagatttttgtttcttagtttgaaaatctcttaggcacaagggttcactgatacatgtgcaaaaatattcattaaagtgtttaaatttttcattattagaggactgattaagtagaatactaggtagccatttaacatgaaaactggaggcgggtggattgcctgagctcaggagttcaagaccaccccgggcaacatggtgaaacgctgtctctactaaaatacaaaaaattagctgggcgtggtggtgcacatctgtaatcccagctactcggggggctgaggcaggagactcgcttgagcccaggaggtgaagattgcaatgagccgaggtcgcaccactgcattccagcctgggtgacagagtgagactccgtctaaaaataaataaataaaataaataaatcaataatgggttaaaagactacgtaaaaatatatgtatacatatacacatagataggatctgtatatatgcatagaaaatagcaatatggatcaaatgtgaatagtagttatcactgcgtattgagactggatgatttctatttttgtattttggaactttatttaaatgaggattaatgatgtttacagtcataaaataatctttccattttgataattaaaaacaagagaaagtcttttgcgtttaaaatagtcttattcttgctttttttttttgagacagggtcttgctctgttgtccaggctggagtgcagtggcacagtcatggctcacagaaagcttgacctcccaggctcacatgatcctctcacctcagcctctggagtagctgggaccacaggtaatgtgtcatcacacctggctgatttttgtatgttttttagagacagggtttcaacatgttgcccaggatggatcttattctttctgcatcaccttggggttctgagggtctcttcattctctggctgagagggctgggaactactttccagcaaaatctggaacctctctgcaggtgctgtcatggctcacctctatgtgccaggaagctgcccattcatttggcaaagaatcttgtttaggctcttcagttttcatactggatgccaattctaacatcttctcagtgagactttgaagtatcaagctcttcctttaagctgcaaccctaatacttctactccaagtgcggaattgaccctttaatggtccaacttctgccaagcccaagtgaaaaatgttgttacgtggatattaacttatagacatgcagtcaatccgctcttgtagctgtgcaaagtttgatctctgcacgaagtcaaactgcctatgaacttgaactgtattttatttcctttcataatgatgataaagcagtggcagcagcaactacacatgatattgcctactacatcctagggacgaggctaagtgccttctgtggattgtctaccccttacaacaccttacagaggaggaatgaccatcctcattttacgtgtgagaaactaaggatcagcgaaattgacaacttggccaagttcatacagcagagccaggattcaagtgcagatctgacttcagattagccagtgtttcatgccactgggctatcctaccttcattgctctcatgaatgtgctggtcttctgtgcctatttcattgaggcaccctctagaacaccatcttgtgttttggagattcactgtacaaatgttggtgaagacattattacacagtatcccctcatgggggcctaggacagaaagttccttcatacttaagtcttattaaaatactattttcggaagggaaggggtatacttttctttcaaagaaatatgcagcataaaattactgcatttccctttttgccttgacctccaggaagctcagagctaaaagctcagagctagagagagcccagctcccatacctttccacaactccatggtctgtatattgatgctacaacttttcccttgatatggagcttccttttagcctatattttccctaattcagatttgtgtgtatgtatatatatattttcagactactatacctattcatgtaggctgtcttcaatccgttatggaatgaggcatggtagaaacactgtccatttgttcacttagatatttattccaggacttactttgttgaatgcattgctgcccaaatggctgacaaggtatgtcaggcataaagcttcatctcatctggcgaatatgacgaaggagtaaggaatctgaggaggaggccatccagggaggaaaggccctcctgacccaggctgggaggctgctctttctgagtggaccattttgacctgccttgcagtgctttgcattaccattagaaacacaatggccacattttcatgactggaatggaatgaacaaatgtattcattccatagcatcagagagctgcaggcccagacaggggtcagcagaagctcacccacaccatgaagagggcacagatgcagacacgttcaagggaagggctgtgtctgtatgtgggagtccagggcagaaaagcttgggtgtcataaagtaccttgagatgtctgattgaaaagtgtctatcagtgaatagaggccataaacagagtccctggatcacctgcataggccagctccaccatgggctacctacctacagcacctattgccactgagaagtgggtgtggtccaggtgacctattggtccctttccaccctgggagtttcaggattctctgattagaaggggctatcttttacccagtcaactacagattcagtttagagatgcacgcacagttgatgctgtgctaaacagtggcatgttacccagaggccagactgcagggctccataacccaccagctagagctcagagaggcagtcaccaccaacgggctgcccttcatctcagaaaacaccttcattccagcaatcacccctaaatgctattccaaatggccaagcatttcatctattacaaaatggatttgttcttggcaatacatgcgtttgccatctcccacctttgcctggtgagttactgcttatccttgaagactcacctcgggcatcatatctccagaagccttctttgaatctcctttcctgtcctcccaaccctggctaagttaggtgcccctcctctgcggtgccacaataccttgggcacagccctacttaccacgtggtatttattatgattttctccttatagggctgattcccccagttgactgagctccttgagggctctggtctcactgggctttgcatctctagggcttagaataggtcaggtgctcaagaaatgtttgttggctaaacacaaaaaggaagttgcctggtaggtccctaagataagggaacttgcaccttaaggttaagaaaagggggaatatggatggccagagccaattccttccttctgtcttctctcccacaggcagacctgaagaacaaaagctagacaagtgcagataatgccacagggggcctgaagacacaagaaggtttttttcaatctgggttctcagtggggtctccagaaagaagcgacatttctttttaggctatattttgcttgtacttgtttttttaagacctggggtaagcctggtctacaacttgcttcacccacgtccggaggcaaaaataacttcgagaatattctgggcatattcacagacttcattgacatctctttagctctacctatagttagttctctcaagtaccagccagaaattagtcttcatagattgtacagaaataaatagtgcccaatcatagccttcagcatttagaaacaaatattagcaattctgctaagatgtctatctggggcaagatgacaaatcaactggccaaaatgcaggtagcttctttagggctaattttggctaactaaaagagccacgagattcctttatctccctaattataacaggggcagatgtagaaaattttgaaaatactaagaataaaggaaaaaataaaattcagctgtgaaattccactgttgggatatggctactgctaacatcttggtgcattttctttttatatttgtatatacacccaaatactttcatttcctatatgaatatttaaatatgaatttaaaaactagaatactttatgagtctaaaatcataacatattttatgtgcagtctcataagttccttttttgcgcaacattatctcatagttggtcttcgcatgccattacacgttcttcaaaaaccagatttttaaagggggtgagcgttccactgtatctgctgaggtttaactttatgcctcaccccaagtataggaggttgggccttactttgttaaaccacaacttgctttcttatattaatagcattccaggttccctgtggatgtcatgcactgcagcccaacacactggtcacctgtcttcatggaaccacagcctaaggtggctggccagcagccctgtcacacccatccagagggactggcctgcctgggaggaagaaacatgcaatctttatcctgtaacttggccagggtttgtgcaaaggtggtacaggaggaagaaatgccagatttcaacctctcccctgctcctcaaaagaaaaagctccagtggaagctgtagggaactcttcactaactttttgtttttttcaagacagggtctcactgtgttacccaggctggagtgcagtggcacgatctcagctcactgcaaccttcgcctcctgggttcaagcaattctccagcctcagtctcctgagtagctgggattacaggtgcctgccaccgtgcctggctaattttttgcatttttagtagagatagggtttcaccatgttggccaggctggtcacaaactcccaacctcaagtgatccgcccgcctcagcctcctaaagtgctgggattacaggcgtgagccaccgcgcctggcttcttcactaacttgtgaggcattggacatgggtcactcaccagattcaaaccttttaaatttgaacccttgttgtttaaatctttctcaaatggatatgcctgtttccttggtttagtcagcacagcaaatataaatggcttttcctttacttattgcagatgcctacctgataccctgagttcactattctaaattgaattaatgagttgccgtgcctccaaaccgaccacgtgttcactcacacagactaagtgttcagcttccaacctgcgcgtccctcctcttggagagcccaccctgctggctgctggtgcagtgcccgggtggcatggatctgattctgttgtaactatttgcttgtgtcccttcatctcctgctggaccatgagctcctggagagcagggatgtgtgtctaatgcatggcaggcactctatcaatacaggaatgcattttatgtggaatctgacttttttcctcagatgtggaagcacgcagcaacaaacatatgtcgtgaatcaaaaaccgggacataaagcctcacacagggtctgacaagaatataagcatcactattaactgcttctgctattctctgtgtcctcggcagctaagagttattgaataccatgtgctggaaatgcgtatgtgtcaccttgtttaatccttgcaatcaccataggaggtgtcctattataatctctattttacagattaggaaactgaagactagaggcattcttttttattttttgagtcagagtcttgctcagtcacccaggctggagtgcagtggcaccatcttggctcactgcaacctctgcctcctggttcaagtgattctcatgcctcagcctcccaagtagctgggattacaggtgtgtaccaccacgcctggctaatttttgtatttttagtagagatggggtttcaccatgctggtctggccagtcttgaactcctgagctcaggagatccacctgcctcagcatcccaaagtgctgagattacaggtgtaagccactgcacctggcctttatttttctgagacagagtctcatcctgtcacccaggctagagtgcagtggtgcgatctctgctcactgtactcactgtaacctccgcctcccaggttcgagtgattctcctgtctcagccttaggttcaagcagttctcctgcctcagcctcccaagtagctgggattacaggtgtgcaccaccatgccaggctaatttttgtatctttagtagagacagggttttaccatgttggccaggctagtctgggactcttgaccttaggtgatccgcctgccttggtttcccaaatgctgggattacaggcatgagccatcgtgcctggcccatggcattctcgcccaaactatgaagctaagagtgcagatctgggattcaaaaccagactgattctaaaggccaccccctgatcatgacacttgactgccagttatttagaagtggggggtgcaacaaatacatgcataaatgctgcaaagcaatctgtgaaaacaatttcagaatgtctggtttctaacttcacaaaaaatgggattaatttaaggcactgaaaactttgtctccccacccccaaaatagggatgagaagatctctgaatatccaaccacctttgtctttgtggcctggttagttctcagtgatttatgccaatggagaggagatctggataaatgaaacccagcactgttaatttatctattcttttttgggaggtggtggtgttagtgtagaaggaccattggaatgcgatgctgtcttttttattccatcagggccatttgctcctcttaggagctgcgtccttcctgcagctgacttgctggtgagtttcagctggctggacagggccagggaacggcttctcttttacctgtaggttgccactttgtatgcagaagagtaaccagggaaagtgttcgagttcaatttttaagggctctatgcattgtgacattttcttatattgccatttcttttcacagtatcacagtcaaataggttgaagtctattttcaggtggagaaaatgagaaacagaatgagagagatcacccgcctccatgatattaattcaattgtcagaggtgaactaacatcaataatagcaagagttcttttgcatctttaagttctcactttgtgggacaatctctgcaacataagccataaatatttttcttcagggacctcaaactactccatggaagtaatctcggcatttaaaaaagcactcaagaatttaaatttttctttcctttttttttgagacagagtcttgttctgttgcctaggctggagtgcagtggtgcaatcacagctcagtgtctcctaggcccaagagatcctcccacctcagcctcccgagtagctggcactacatgtgtgtgccaccatgcctggctattatttattaatttttttttttttttttgcagacatggggttgccctatgttgcccaggctggtcttgaactcctggagtcaagtgatcctcctgcctcagcctcccaaagtgctggggattacaggcatgagctactgtgcccagccaggaatttaaattttattaaactgatgagaaaaccaacaagcaaactcatagcagagccaaagttggaagtggtgtaggtatcactgatcacgaccacgtggttgatgctagtgtttttcttgccccacactttggctggctttgtgcatatggatgggagagtactacagaaggtgatcacacagtcggatgaccatgttttcctgcgttttgtcacttctgtttctccagcttagatcctcacatggcccacattcagccaagaaagcacagggaagagggagctccgtctcccacacgtcccacccaccctgcaccacgtcttcaacattctctacgcactcctgagaccgtctcagcctcgccatgtgctgcacaccgaggagcacaggatttgggagttgcaagtgaaaaatgagcatggttaaaaatatcaaagactgcaaacatattcttttcagaggagtgagaattagcaagggtctggcagcaaagccatggcttttaatgctattaaaaaggaagaacaccttttaacatttaaaactattgaatgaggctcttctcagatatttgatacaaatctgatactcccatggagaatgcatcaaaatctttctatgttgacttacatcaactctctattactgagaaatctagagtaactaagcaaataaaatacagaagacaacagttttgaaattaccttggttgtctctctctctcacctatagtggccttttgaggacgatcacttcagcctcgggatctggtggccactgaaatacccattccctctctggcagtcccatttgtgtagaattctctccactcatttaagagcagaggagagaaaagctgagtccatttttaactctcacaactcctagtctcataacacatccttcttttctgctcaccctacagttccctcttccccaagttctcactgcccagaaggtggagtttggggaagcttttgttctacagtgggtgagatgtgtttcaggcctagcaagttagggatatgattagaaatcagctatgacaacaacgagagcatagactccagaatacagagcaggcttggtgcttgcttgtgtgtatatattggcttttttcttgacaaccctaattctgttttgctctagtctttttattttcatctccccatcatttaaaactgaaaatatcacaagctgaatttatggtagattccaagcaacaaaagcaggcttagagatcatcaaatgtaacattttccaaaatgtgttctgcagaaggccacccctgtggggtgctctctaaaaaaaaaaaaaaaaaaaaaaaaaaggccgggcacggtggctcatgcctgtaatcccagcactttgggaggccgaggcgggcggatcacaaggtcgggagatcgggaccatcttggctaacatggtgaaacccggtctctactaaaaatacaaaaaattagccgggcgtgctggcgggtgcctgtagtcccagctgctcaggaggctgaggcaggagaatggcgtgaacccgggaggcggagcttgcagtgagcagagatcgtgccactgcactccagcttgggcgacagagcgagactccatctcaaaaaaaaaaaaaaaaaaatggctaccatggccaaataagcttaagaagccccgcacactccacccccgcctcacatctgagcacattcagggccctgcagagtcccatagtacgtaaactatgttaagctcacatcctagcttctgtagggggggctccaggcctcctttctcggactacaatttctatgagaaaatgctctgaacttcaaatctaactgtccataaactggaaacttcctagacatcactgaattttcttgatgatatcagataaaaacatgggatatgtgataacagtacataaaaacatgtgacccataaaaggtctttaaggtccaaaaagcagtaacttcacaattaaaaatgtatacatacttatttagctaaaaggttaaatgtgtatttgaggtattatagggtcttctttactttttttttttttttttttttttttttttgccatttggggcagcccaggggactgattcatatcaaaagaattttaagccttcaagactggactggtattgaactgccctacataaggatacaaaatccatgctcaaagaagctttttttagtgcaagtgaagcttgttgcatctcagaattgctcaaagtcccaggtcaagggtggtggcctttgttactaattttgaggtttgacaaactgttcacctggagaagattaaaatggaggatctgtgtaagatgaaagtcctttggagctggtatgagaatcctaagctagtaatgtttacattaaatcaaacatctggatgaaaagataaatgttaaggcaattctctacatgtttttctaagtgtatcagggatataacgttcatcataaaactaaacagttgactatttcttcccccaacatttcacctcagtattctggtgatatatatatatcacacacacgtatagctaataaactcaagggggcagatagtccacagaaaccagttttagtttcatgtggaaaaatactttagatactctgatgaaggcaaattatatattaccttaaaaaccaattttattgaaagaaatgctgcaatacttaggaaaaaggtggcgttcatcctgaaaagtatcagaatattcatgttgatgttcaatgcaaacacggtctagaggcagcaagctctgtggagtcaatgttttctttctgctatttctattttaatgtttatttattgctttcactttttcaatcctttcgtaatggcagtaggaaaactttggaagataaatacacatctgacaaacctatcttatgtcttttagcagaaaaagggtcaggctgttaactgacgtcagcaggcagggagagggaggaggtgaaggaacaaatgctgaacacctgttatttatgaagcactctacatatgttctttcatttcactcctggtgaaaacctgcaaggtagaaactcttgtctctgttctctagctatgaaaattaggactgggaaaagtccagcaacttctctaagaccagagagtagagagatagctgatttgggatgtgaactttggtattccgttctttctatgacatcaatccaacccctatagagaaaggtatttcacataaaccaaaatagatgtgaacaggatgaaatttgactgtataaagaaacaatcaaattttacaagaattgcaagttatgtttaaggcaccagaaacctaacactgcacatccttgtaaaccctgaatgaaatggctttaatcaacactttaatcccgtgcaaacaaacgcttcctgagatatttagagcagtctcgcagggctttgctttgcagtctttactgttaccacagactacttttatatcactctcctcaagcctccccaaatggaagggtttgtttttttttttaaaggcccatgatcattctttcccattttcaatctttctttaaaaaccaaaaggggtgaggaacatgtagcatgatacaaatgctctgagcatgaactgcctgactcacggaccttaagctggtatagattttggattacagttggccttggcctataggtgttcatcagaactggaaaacattgcttcaggcagtcttctacccatgacattgaactgggggctggcctctcacgaatatatgaatacgtgattcctgattctttaaatatgtatatttcaaacccagtgagcagagcagaatcatcaaacttaagtggcattttcaaattcttctgattataaattattaatatactatatcagagatatcctcaagcaatttgtaccaccttgagggcatatcaatcttaaagaaacatttgttatttcctttaattgtttccattttccaagtttgtaatatatgagctagtcttttaggtttaatgacaagtatggctataaatggaagtggtgtaatcccataaggatgtcattacaagaccaactttttttttgagtgacggtttcactctgtagtccaggctggaatgcagtggcacgatcatagctcagtgaagcctcagtgtcctgggctcaagggattctctcatcagcctcctgagcaactgggactacaggtgtacaccaccatgtctggctaatttttttttttttttttaatagggacaaagtctcactatgttgcacaggctggtcttgaactcctgaactcaagtggtcctctcaacttggcatcccaaagtactgggattataggtatgagctgtgcctggccaagagtaactttttttaaaaattgagacagggtctcactctgtcacctgggctagatggcagtggtgtgatcacagcttactgcagcctcgacctcccaggctcaggtaatcctcccacctcaccctctcaggtagctgggactacaggcatgtgctatcacacccagctaatttttgtttgtttgtttttgtagagatggggtttcatcatgtttctcaggctcatcttcaactcctgagctcaagtgatctgcccacctcggcctccaaaagtgctgggatttcaggtgtgagccactgagcccagccaagactaatttctgaatgagcatatgggccaaatcttggagttcccaattaccacctgtaggtatctgatctgactcctattcaatatagaagactgcagatttgtatgaggcaaacacacctattatgccctagtacttagaaatggctactagagaaactgacagacatagtgagggacaaggaggctgtaagacctttactatgttttggtgccagagaaacaaagggatttctcaagtctgaaagtgaaattagtaaatgagtaatggcagttgagatactaggtagggctggcattctaagttgaatggaagaatgaaaatatcgaaaaatctccaaacagcctagtctgccaaaatgtacttggtgttatgagtggaactgtgacccacccaaaattcatatgttgaaggcttaacatgcagtaccttaaaatgtggctgtatttgaagatagtgccctgaaagtggtgattcagttaaaatgaggtcattggggtgggccctgatgcaatctgactggtgtccttacaagaagaggaaatttggacccagacatctaagcacagaggaaaggcgatgtgaggacacagcaagtacgcagctgtattagtcagttctcacgctgctaataaagacgtacccaagactaggtaatttataaaggaaaggggtttaattggctcacagttccacatggctggggaggcctcacaatcatagcaaaaggtgaatgaagagcaaagccatgtcttacatggcggcaggcaagagagagcttgtgcaggggaactcccatttataaaaccatcagatcttgcgacacttactcactatcatgagaatagcacaggaaagacccacccccacgattcaattacctcccactgggttcctcccatgacacatgggaattatgggagctacaattcaaggtgagatttgggtagggacacagccaaaccatatcagccgccatctacaaggcagggagagaggcctcagaagaaaccaaacctgccgacacattggtcttacacttctggcccccagaagctgtgagaaaatgaatttctgccatttaagcctctcggtctgtggtactttgttatggcagccctagcaaacaaatacacttggtatgtatcttaataccgggtaaacaagccaagctagtgtgttaattataagttgggctttcaatacagtccaggcccattctgcaaagtctttaatctgttgaaagggggtgggtactcaccacatcaaaggcagtaaacacatgacagtagtggtgattagacttcaaatcttttgtgatataggcaaatgttgagaggtcttctgggtcctgggcagcacaggagatattacgaatttcatgctcagcaattatgttctggaagaaatgacataaatgatcattgttttcctctgcgaaccagcatatatgacaaccaagacaagtaacccaggaagcagttgctttccttctttctggagtgttctagactagcaacactcaaagtggtccactatattatttgtgggtaaatgaataccagatatggaagaaatattttcatttaattaaaaacaacctaacacagtcatatcctggagctgcagttctcaccagttgctgtgcatagaagcagtctgggtggcggccactttttttttgtttgtttgagacaagagtctcactctgttgctcaggctgaagtgcagtggtgcaatctcggctcactgcagcctcccgctcccaggttcaagcaattctcctgcctcagcctcccgaatagctgggactacaggtgcatgccaccaggcctggctaatttttgtatttttagtagagacggggtttacaccatgttggccaggctggtcttgaactcctgacctcaggtgatctgcccacctcggcctcccaaagtgctgggattacaggcgtgagtcaccgcgtccggcctccactttaaaaaataatagtaattactaagcatttgactgtttccattccccatgtccacctgtagctgtgcagcactgctttctgctaattctgtatggaggggagcatctgtcgctttctctgtatgagaagagatctgacccaatgaggctcttcaaatccctcgccatcatgcttgcacgttgttcttgtgtcctgctcctcctccctcagagcaagggcaggtactgaaggaagcaggcaggtggaagcctcaaggtgctttctccgtggaaactaaggtgcaggggcctgataagagaaacaccatactgcaagattcaggccttggatgccttgcttgatctgggccctgtggctatattaacaacactttcctaactacatccactgtgtataattaggaggtggtgctgttgctaccattatttacaggtgaagcaactggtactcaaagaatttaagtgccttatgcagagcaggtgctggggtggaactgaaatttggggttgtctgactgtggagctcaggctctttgaaatgcattgcaatgcccttcaacgtctccacctccctcttactggcttaacaagaattgagttatttcttctctagcatctctttgtgccttcttccctggtgggagaaaggtttaagtaccattgtcctgaagcacaaaataaccacgaagcagcttggctgcaaaccctgctagaaacttcttttgatacatagatgtgtttaaaaagaaaaaaagaaaaaaattcacataatcttgcaatcattttcttatcttataatatcccatttatgtttttttgcagttgtcacagatctaaaaccctcgatgctttagttactctaattactttttaattgcgctgtcttaaataacctgttggcaatacagtgttccgtgtacagccatcaatgcctaaaaatgcttacaaaatgtccttccctgccagcacccccagcaagtacttcatgtccctcactttaccaagctgagtggttcggaggcaattacagaattaactcacaaaagaaaattaaattaagacatttttcaccgtggccttttgtgttgacattaatgcagtgctctgtcaaaaaataactcaaattgcaattggaatcccataaacaagtaacattctattgcaagataagtttcagactagaaggtgatgatcctcttctggcatccagatagcattccttcaagtagaaaaccaaattagggatgggtgagtcttaaaataatgttaaaatgagaaaaaggtgcaatgtgagatggtgtgggaacctctgccattatcttgattgggggcagccaatgccctgggaagcctgggtggatttggtctcacttgtccaggaggcactgtcacaggaaataggtgcttcaacttttactaagttggcattttgtgttcttgagatcttttgcaagatctcaaggtagatgcacttcttgggaaatgaaaagtgctctgtgatttttattgcactgaactctctgaatcttgccaactcatgggatgccactcttgacaatttccaatggtgcacggcagcactgtggcctgggggaaagttgcaaaggaggaaaagtatatctttggtactctctcctcctgtgtctttgctgacccctgaattttctggagccctcttcttctctttctctctctctctcttttttttgagatagggtcttgctctgttgcccaggctggagtgcagtggcaccatctcagctcactgcaacttctcaggctcaagcaatcctcccacctcagcctcctgagtagctgggactacaggcatgcaccaccagcctggcttattttctgtattttttttttttggtagagaaggggctttgccatgtttcccaggttggtctccaactcttgggctcaagcaatccacttgcttcagcctcccagagtgctgggattacaggtgtgagccactgtgcctggcccagccctcctgttctctattccccaggagcccaggactgtcttttagctgcccagggaggcctgacctctgtgatactccatgttccaaaatcagccttctccccgactgtggaaacttctactactctgttcccattgtctaagctataaggaaagctcatgctagttaaaatattctatattcaggtaggaataactcatcattgtggtcatcctaactggcgcttaaaagatgctcttgaatttgtattgatagcctgcggaggcaggtatttttgaacagacctttgtgatatattgccaatgctagaatggggtaaggtcctgggatgtcactactgaaatactgccatcactctgcattgtctacctgtgcagaatggtgaagccagttctctatgtgcaggacgaatcaaaggtcaaggatactacagttgtagactgtatggagactagatggtagacttcctccttggagaagaagccaaagaggaacacattctttccaccttgtgtcatgcatttatgagtggcttttccacaaattaaaaagtgatgtcatgaagaggtacaggtgatgcacctcagttgaaaactggactcctcacatgttgatcagtctccatttctaagcacattttaagaaggccagagctttaaaaggctcaagagaagaactggggaggggctcctcctgcctcttcttggggatagaaattctggcagcatagcacccttcaatagggagagatggttttgcctgtctgttgtttgccatcatggtgagaaacagctgaagaggtgtcttgctggtaggggtaggacaggattctcgggtccagctaactcatatggtggttctgagaagggcgcgtggtgatgaagtgatgcagcttagaaatctgcctctcgccactgcattcaatctgagccccgacaggtgggacctttctcttgcatctcctcatcagccgggcttttcctgagtgaggagactgcagtgttccctccagggcggggccaacagtatagacctagagctaactggtgatgccctgtggggcacgtgatgctgagaacagcacatgtgcttaacatggccttaatttgtctccaagcttcttaggagtatttgctataaaaaaaaacaatgggaggcccactgcagtgactcatgtctgtaattccagtgctttgggaagctgaggcagaaatattgcttgaagcaaggagtttaagaccagcctaggcaatatagcgagatcccatcactccaaaaaaacttaaataattagccaggcttggtggtgcatacctgtagtctcagctgctctggaggctgaggttgggggatcacttgagcccaggagtttgaggttacagtgagccgtggtggcgccactacactccagcctgggcaacagagtgagaccctgtctcttaaaaacaaaacaaaacaaaaaaacccccaaacaacaggcacttgtttaggcaaatgttccaaagtattttgtgcccctaaaatagcataggccttgtttaaaattggcattccaaaaaaatttttaaaaactcaaaaaacaaaacaacaatgaaagcaaaaaacaaaccctggcactgcatcatttttaatttagccagatgggaaggctgaggagggagtcagcacaggaaggcaaaatgcaacctgctcctcagctgagcactgaatgtagaaaccgtgtctcctctcggaagacctccctccccgactcccccaacctgaagaagggtccgttactaaacagttgcagtcccccaggccgaattccctgctagagcaacctttgggctattgatcaacagaaggctgaggtgatttatctaaaacactttagtgctaaatctattgcaagttccacttttaattcaagatcgctttctgcttcctccttcttaaatcaggattagtgattcaattcatttcctaagttgctaggcaatacatttatgagtttataactaggcctctaaccctttcccatgaattcagccaaacccatttatttattataatcaaaggaaagaaatgcttcacggagggttaatctttcacaaagtctaatgggggctaataggaagggaagagtaattaacacacaatgaattatcacacaatgaattagtttgcacttcaaactaatttgtggaaggtagctgtggagtaacagaaaaagcattaggttagggaggttgaaaatcaagttttagtcgttcttcacgaccaacaggctgtgtgactgcagggcagcactgagccaagggactgaggccttcaggtctccagctgcccagggcagattaaacaatcacctctctgaccaaggcaggggtacgagatgcaaggttaggagagtactgttgaagaataaagtacgatgaaaacataaaatatgaacagtaggctgggcgtggtggctcatgcctgtaatcccagcactttgggaggctgaggcggatgattacctgaggtcaggagttcgagaccagcctggccaacatggcgaaatcccatctctactaaaaatacaaaaattagccgggcatggtggcacacacctgtaatcccagctactcgggaggctgaggcatgagaatcgcttgaattccaggcctagtggcctctagtacctgaaatggtgagatctttaaatatgcttgcatattaaaagttctttgcttcaaatcaaagtggcccactgacacagcactgcccagtgggggaaatccctggtgaaaacagaaagcaggactctggagtttatcaatctgctccttttctgctgtgctctttgctctagaacaaagtagcatacacaggtgtcctcgcacacactgctagaatctaggtatctgggcatggttcctttcacaccacaacttgaggatgatccttcaactgtggatcctccgtcccttctgaagccagtcctcccaccctggctgatggtagtatttctcagtcttacccagtcaaactccaccaatacggccttccactattttctttcttctaacctgctaaacacaatctctctacttgggctccctacacagcaactactagactattgccctgagtcacccacactctccctacccactgtcatactgggggagatcagctaccttgcaggtcactgggatgtggaccctgtatagccagttgaaattaacatccttcagttccttaaaaagccaggcacatgttgtcatacattcacagactggctccacttgccaccaacataggcactttgcctttgctctagattctgaaaatatgttgaggaccacactgcaaagacttgaaaaaatatgctgaccttctttatttagcatctttatttacatagaattatcttttgcatatctttctgtgcttttgcttccaagagtagtcatcagtgagcagaggtttatggttaactcatctaattattggcaattgaagtagaagtatctccttgaggcacaggagcatcaacttctgtgtctcttgccgtgtcagtaagcaacatacaatggaaccggcagagctctctttcattcctctgattgtggagagtgggttagagaaaatgctattaatacagctgcatccagccatacccccaaaatcatgaaatgattgccttaggactgtaggaacttctcagggcaaataccacttgtttagaaattgtcagaatccaagtctgctaaagttgttcatctaagagagtgtcaaattcatccactgaaaatatactgctattcaagctttccaagcataaatgggatagagggagttgtttcaatttagggaaaaaaaaatccaggtgccaaagtctttcttaagatttagatacagcaatagcaatggtatctttgccattctataatgtgttccataaagtgttagaacttttaaaaccaactgactataatttaaggataaagtaattttatataccaggaactaaagatgcttccaagaaataaaaaagcaaatcaatcagcattgttcttatttgagtctccacaattattatctgtcaacaaccatcaacaatattttgcacagttggaatcaccattatgctgatattattggtcagcatgatgctgggttatatgctttttgcctgggtttcagaactttttctataaccgggaggttgttttcccaagcagatttggggaacttgggtttacctaactactgaaacaacaatctctttcgtcacagaaaaccaattggaaaaacttccgattcagatgctggggtttaatagagacaccaaagagtcactgcccgtgagacttttccctggaacctaaatccagttgccttggccctaagttgctgtttcttaagttcacctgtttcatgacttctgttccctttctccaaaacggagggggtccaggtgggaggtctgggtgagaggtccagagaaagaccagcattcaccaatggtgatcacctcttttaccctccttctgtacttgattagttgaaaggatgcaggaataaaacacatgaacgtttggggttttgtgaggaggagtcagtcagctttgagtttatggagagggacaatggtcacacccaagctttctacttcagcaccacgatgctgttgtctttgtcaagaaaggaatgctttttcagtaaaatgcaaccccactgaccacgcttgacatcacagcccacaaactattcccactgtgaggaagaagtcacagcggagccacagcatggcctgggctcttttctgattgtgtctcttaagaaaacagtacagctgaaactctctcccatctcagaggctgggaattaaatgtagttataaaattaaaaagtcagaaaattatcaacagaaaagacacatatatatctctagataaacagaaagacaaatgttctagccctttatctagtaacatctcctctgatggaggagtgatgacattgttgacttttcaatctacaagtgatttttgttttctgtttcaatgttctccagatccaaagggacatgctggataataagtggccacagtctattagagaaagcatcatgacaaagtgaaagcacaatatttatagaaaccccagatcaagcccttcccccaaatggttcctttctgtatgtatgaaggtgtgtatgtgtgtgtgtacatgagcgtgtatctataggtatatgtaggaagcatgaaggttgggggaaagggatgattacagtggggagtgctgggtattataggaagcaaaggattttagatcatacactcaggactgcatctggtgtctaaaccagagagaggagtggtacttaccttatttgttgcatcaataaatttgactcctttatatgagacagaaagaataatagtagggaccttcttcatttgctctgtagacttctgaaattaaaattagaaagctgttagagcagtttgtgttgcgtggcaactgaagcacacaatttttcctcctgaaagataaagatgagctcaaattaaaaacaacaacaacacacacacacacacacacacacacacatcagatacacaccacgcacactctaattttaatgtctgcctctcctctcttgggcttagctatacttcgggcttataaagttatccgtcttgcccttgaggatctaaaaagagtttgttccgctactttgtgtggatgaaggagtacttcttttccctgacactaaagggtgaatgaagaggtctgtctcctactgcaatttcaagtgactgttcctttcacaagagttaaaccacatcggacttaactccaagggtgcatttgacattaacaaaatatatgcacccccccttttcctagttaccttcattcttccaggcacagataatgcttggatgtatacttaaaatagggatgtaaaagatatcactatgtattgttcttgaactggaccaaatccataaatgctgatattatatttacagcagaatcacttgtgaccacaagggatgtaatgatgctctagaacaatgaagccctccaggagcagtctgggttttgagccacagcaaaatgctggacagcccaggtaacctactttatcatttagagctgctacattcccttaggccaagttcttgtgatagatgttcacactggctgaatgtgcttagagtttgcagcttgtacagttttatgcatctgcaaaaagtttctctataatttagtatgtgcctttcctgtttagctttatcattcatcaccagtcaccagcagtcagtttacttcattgccctctatatatactagtaataatcacactaaacatcaagaagaacctacctgacagttagcctggtggattttccagttaagacagatgggaacataataggagagaaaacatataaaaggtgagagagaggaaaccatttcaataattcaccaacagtgtaaattcattaaaaaacaaaagatgccacaaaagaacaggcttcagagtcatcaaagatgcagtgccactgttattttagaaatgctgcaggctttcaccggcccctttctttctctgtttctcatcattctgtttactgcaccgcacagtcttaggactgacacacaagaaccttccactttgagctttcaacaactagttgtcttatgtctattaagggaatcaggaaaaaatagaaactttcttgatttattcatttatatttcccaattttctagttttaaattctggaatgcagccagaattcaggaaggcttttaattggatagtgtgagtgaaactcattgaactcaatgatgagacttcaattgcatcttttagttgagctgtgaaaaggggtgtttcacattttcctgattgttttggcacaacatctttttgagagttactacgcctgtttcaaaaacaatggcttactaaaagtattgttatttaatatctgttgttgtatacaggatgtgaaaaagcagctctcttgctttttaaccagttttgaaattccctggatgcatcagtgttcctttgtgattgccaaaaagagagattatgaaaataaaatataaggttagaaactcgttttaatgcttcttccaaccacttcttaaaaatgtgcaagacacatcaaaggcaggctagaagaaatcatgtgcaatgtgttgattttaaggcaacgcggtggctgaactctgtaaagagggagggctggggcagcccaggcgatagttggaataactgaatgcatatgtgaaaaattttctgcaaagcgtcacagtggatttcggtaaatcacctcacttatcttttgccatgaatccattctcctggacagatctatctgtaatgcaaagcaatatacagctaatattcagatgaaaatctattcgttatttgttcagcaatcgagttgttactttaggcaacccactgtgcttgtcactggaaaagctcgagtctagttcagggatggcagacagacctcaaactgtgtgcaaacaccagtctgctgaaagcactgtgttgagaaagattctgagctgtgtctgagctcagtagaaaagagggctggaaatgatgtctgccatgggagaagaagaggacgaggcggcccaggggctacacatgaacatgcctgctaggtctgataggaagaacagctacaattacaatgttgacaaatgtgacaggagcaatatgaacaacatgcctccaggatagtgaataaaaacagccttattttgcttgacagagtggggccagtcttcattcattcattcaaaagacaatgacggcctattaggggtgattgagctgactcttgatgaataagcattttccaagtagcaaagaggccaaaagaggctgttttagcaacagaactaatacatgcacagaggcctagaaatgagaatgtggtgggtttgggtaactggtggagatgagagtggtagagtaggtttggaaggttgtgacttactctgccaagttagggtccgttggaagcttttcactagagagtgacacaatcagacctgtgttgcagaaagattcttctggtggttgtttatgaaggagggactggaagagctagaggctggatgcagggagtcaggaagttattgtgcaaatccaaaggagagagagaccctaagcacctgagttgaagtagaggcattggagaacaggaggaggcaccacaatgtcgatgaggaagaactgagaggttctgttgattgatctgctatggaagatgaatgggtgggaggattccacagatgaagaagccactgagataaggaatactggaggggaaagtgtttttgcgtaagcataatggaaatgcttttgcacatgctcagtttgataagcaggtggagatatccagtaggaaatgagaatcagatctggaaatccacctacatacatggatggccaaggaggtgggagtggacaaggtggtttaaggagtgaacaagaaaagagggaaggacacacttcaggggaagatgaaatcccaaggggtggggcagaaacaagagctaatgaaggaactggaattgaagttggaagatgcctacaacacagtatcacagaagccaaagaggagagggcttagaaggtaggagcaatgccccatgccatgaggactaacaaggcctaaaatggtgtgcctaccacagtggctggctcacacaggagctgctactttcattgggcttactgggtggaattcctggcttttgcaacaagaaaaaattgttgctgatttcattaagagtagcttcaagaaaatggtggcagcagctggagaggagaacacagtgagctgtgcaatggatgccagttaaaggaagcagaaagctggaacaacaggcaggtcaggacacagctcttgagctgacatgaaggcatcagcggtggttcctgtgatggtacaaagatcccacatcagatgctcggccaagttgaacaaaaaaaagaaaagatgaaggatagtcatttctttttcttccatgggtcccaggaatctctgctctcctaactggaggcagcactatggtgtcagtgatgcaggctgtgcacaggcctctatgaatggcagtgttgggggtggccatgctttccaatctggagcccaaactgtactgctctctccactgagtcatttgacaagaagctgatggatcctgaccagccagagagttcaaagggagggtgggaaatcttctgggtagagcccctccttgaaggcatttatacaccctacaaaagataaggatccatcgtcttttaaaggggttttctgatggtgtactttgacaagagtttccaaagaggtcttttcatacataatcttagcaaaagatgaaaatgcatagaaagaaggcaaagaggctaggcatggtggctcatgcctgtattcccagcactttgggaggctgaggtgagcagatcaccagaggtcaggagtttgagacaagcctggccaacatggcaaaaccccgtctctactaaaaataaataaattaaccaggcatggtggtgggtggctgtaatcccagctattcaggaggccgaggcagtagaatcacttgaacccaggaggcagagattctagtgagccaagatcgcgccactgcactccagcctgggcaacagagtgagactccgtctcaaaaaaaagaaaaagaaaaaggaaaaaaaaggcaaagatcaaagttattgagtcttcagggagtctaatctgggaggcaagaaatctagtaagtgcccacttcatttcatgaaggctttacaggcatcaaaatgtgagcacggggcttcagtccaatcacaggcagtcaaagtccctccttccccattttctcttcggtgttatgatcatcattcttttctccttcccagggacgaaggcgcctactctgaacatcaagttactgagcacgtgctctcaggcaacactggtttctatgacctatctatctgcatgctctgctgggtgtctgtataattaatactcccatatgtttctgttaaaaattcaagctttattgatttgtataaacagaactctgtacttcaggcccatttccccagtgaaagatgctcaaggcgaaccttctgttatcgttttctttcgtttctagttgcttttccctatgccatgctctttgtggcatttttcaggtttcccaatgttctcaaatttaccccccttcagagccagctttacagaagagactaatttgtaatggagacctctgagtacataagcagataaatactcctgggtaaggctccaaattattttaatttttacagcatcttggtcacctgcaaaaagcattatagtgatattcaaatgtattttgttcacaatttcccaaattaagaggatcatacttttatttttccaagagaaatgatatttagttatatagagatgttacgtttctgaaatctaaaatacaatgcaacatttgaatcctaaattcaaaggcagtcttctctttaagcacttgagtttatattgtctataaccattaaacagaaacaggaatcagaatttcatatctggaggtggccacctgaaatattgttcttagtaagtcactgaatgcttttagagcatttttaaaaagaagagattttgaaatcaccaagagaaagaaataaccatctttcttcttctcctttttaattttaaattatgaacggcttggtatcaggtcagaaattatcattggtgcttttattactgccttaaagcatgttctgaaaataagtaggttttctattttgaatgcagaatcagtagtatggagataccctttccagagtgcacgaactctaatctcagagcaagacttttccgagcacgaatgaaagcagaggggtttatgatggggagcacttcagttgtgagctgtaatgctctttgagtctggagtggtgttaatgttccgagtaagaatcattagtgccccatcatcagcacagacagggaaaacagtgaggctaatgtggggaggacgccaccaacccttcattcttacaatgccccgattgctcccagtgtatctgaagcacaggctggggaagggatttccggttggtctgttgccatccaacttacagtatatttttaacctacacatggctatcctgagaatgctttctagttagatattcagtcctgagtcgtaactattaattttggcatataatatcttccttagttagattcaaagcttaattattatattccatttcagcaagtaaattaaaataggatcaagcaattatgtttggtagccctaagtgactttcaaatgattaaaaaacatacacaaaataagcattattgtggtgattttgtaggcagtgaaactagctaggttgtgggattacaagagataaaaagcagaacaccaatcagcaatttgaaatgaactctcaccatttgaaactgagcttaaaggccactttctggggaaaggcttccgcggtctcccaggctgacaggatggcttttctcttgttcccctctctgccacttttcccgtgcactgccctgggtctcagcgtggtctgcttgcttccctatagggagctccttgaggactgcccacacctttcttgatttgtcttcactgtaatgactagcacatggtcttacattgagccctatgaagtagccatttttcaagtcaagaatggctaagtaccagcagtttcataggattcgatctaatggttgctgaactccatgactgttaaaggaacaggccagtgaattaatgtatcgtaacaagcacgtagccagcgttataaggaaccacaggctgggcgtggtggttctcgcctgtaatcccagcacgtagggaggctgaggtgggcggattgcctgagctcaggagttcgagaccagcctgggcaacacagtgaaaccccatctatactaaaatacaaataattagccgggcatggtggtgggaacctgtagtcccagctactcaggaggctgaggcaggagaattgcttgaacccaggaggtagaggttgcagtgagctgagtcggcaccactacactccagcctgggtgacagagcgagactctgggtgacggagcaagactccatctccaaaaaaaaaaaaaaggaagcacagtgccagcctctcaacacgctgagagctcagcaaactttcagagagctctggtacccagagccagcaaagaggccttgcaaagcttgcaggaggaccacaaatgtgattagagggttaccaagacattcctatggggtggagaaaacttcaaagattttggctgggtgtggtggctcacgcctgtaatcccagcactttggaaggccgaggtgggtggatcacctgaggtcaggagttcaagaccagccggaccaacatggtgaaaccccccatctctagaaaagagaagaaaacagacaaaaaaaaaaaaaaagatcatgagagttttcagtctcaaggaggcaaggcttaggtcttcgtttctgcaaagcaaactggctcaaattgcaagcattaagaagaaaagccttcttgacagggtagaaggattcctaagggcagctgggaagtttccccctctagacatctttaaaaatagtttgggttctcatctgtcattaatgaggctaaatgaccttgcaaggacttttctggtcataggaggtctggcacaaaggctgagggaatacagaacctaagaccaggtgacaagaacagacagtgggcaagcagccattgaaaccacacctcctgcatatgacatggccattgtactgcctgtgtaactcacatgctctggagcacaagtctggcacagcacaaagcggtgccctccgtttctatatgctgctgatgctgcacgtctgagaccatactttgagaactactgctctaaaaatgcggtcgatcagtttgattgaaagttactgtcagaactgttctctgctgctgtgcatgtaaactcgctgtactgcatcctacattaattcagaaagaatctagtttatcaaaacacactgttctccacttgacaagtgatttccaaaaatccttagttagcatttagctacagctcttggtcttgagagcaattaacaagaattatttaattcttcatggtttctcagggactgtgaatggataaaacattcttcacataaaacaaagagttcagttcataatgacagattcaagagttgtacccagaatagatgttggccgggtgtagtggctcatgcctataatctcagcactctgagaggccgagacgggcagatcactgaagatcaggagttcaagattagcctggccaacatggtgaaaccccgtctctactaaaaatttaaaaattagctggacgtggtgacgggcgcctgtaatcccagctactcgggaggctgaggcaggagaattgcttgaacctggaaggcagtgattgtagtgagccaagattgcaccaccacactccagcctgggcgacagagagactcaaaacaaaaacaaaaacaaaaaacctgaaaaaacaacgatagagttaataagatcaggggtcttgctgaagatgaagatgtatagtttttttttttttattaaagttcccctattctccctcaaattaagcacatgctcttgagagatgtgacaggcaaacatgaacatgggcttgtgtactgcccctgggagtgtaatctggaagaagttttctagaaggcaatttgggaatagttatccaaagtttcacagtgtgtataccctttgatccagccattctatatctagtggctcattctaaggaaataatcaaaccaactgcaaaagatttaggtaaagggtgttacccatagtactggctatcatttgaaaagaattggaaatgacagaatgaccaacaaggagaactggttaaataaatttggttcaactatggattggaatattgtaaccaaccaccacaaatgatattggggatgaatatgtataggaataaaaatatttcaaaatatattattgtgtttaaaatacacggtaaaacagtggatatgcaatatttccacttcttactagaaaaatagtacctacaaatgcataaataattggtctggaggattacacaagcataagatgttaacagggaggaatttaccacttctaggtggtaaaatcacagttgtttttatttctccttcctgtttttctattttagaagtgaacagtaatgaacgtgtattgcttttgtaataaaattttaaaaatgtatgattttaattaaaaatgccaattgcaaatgtgtgaaaaaacacactgtttgaatctatcacttataagtgcaacttctgtgttttttgggggtgtgtgtagccatcttgagcttatgaagggacccactgaggagctccttcctctgagaagaaaggggtagttgtcagcaaatgagagtacagggtatgtttggattcctggcttagttccattccttccttgcggcgtggttaggtactcaacctccctgtgtcttagttacttcatctgtaaacgggtatgttaatatagcatctacattttagagttgtgaggattgtacaggataattcagtgcctagcatgtagtgaacatcaacagattttagctattactgcttaaaaacagtattttttttggtagagatgggggtcttattgtgttgaacaagctggtctcaaactcctggccccaagagatcctcttgcctcagtctcctaaagtgctgggattacaggtgtgagccaccttgctcggccagctgttattgttattctgaggatagatgctttcacttagaaagtccctctccaaagcaaagcactggcaaaagagagcagaaacaaaattgaaatctgtgtgcataactgaacactctccaggctacttgctatgatggcagggaaatggtggttgcaacaatgaactttcagtggatcaatatacctgggccaatgagaagagactcaatcaatcaacatgtttagaaagagcttgagacaagtgggaattaaagacagaagcagcccaggaaatctttcagtgatgtgaagtagtaagggtgttatatgggagaaaagctagcaacaagggctataaaaaataacaaagagaactggggtttgaagacaatatggaataagatggttggtgctctttagccttctagagtaggcccgtaagaaaacattcacaatgagaggctgggcgtggtggctcacgcctgtaatcccagcactttgggaggccgaggtgggcagatcacaaggtcaggagttcgagaccagcctggtcaatatggtgaaaccctgtctctactaaaaatacaaaaattagccggacgtggtggcggatgcctgtagtcccagctactcaggaggctgaggcaggagaattgcttgaacccaggaggcagaggttgcagtgagccaagattgggccactgcactccagcctgggagacagtcaaaaaaaaaaaaaaagaaaacattcacaatgggaaaggcacatgtgagcaaggatcagcaataaggagttacctatgtggctgtttctttgtgggcattgcgattcaatagacacacaacacacatttatgggcttagaagctgtattcactatgactcacgcagtatttgggagagagtgaaagaaaataattgatgcttccatgaaattgggcaacagagaatttttttttaaagatgggatctggctatgttgccccggctagaatgcagtggctgttcacaggtgtgatcacagtacactacagtctcaaattcctgggttgaagtgatcctcctgactcagcttcccaagtagctgggagtacaagtgcatgttactgtgcccagctcaacagagacttttaaaaaaatagttgtttaaaagttttttttcccagtctgattcctaagaagtaattcttgaagttatatctgaaaatgacaacttgtcacagaaggaatttgtatgaggacagaggaacaaaacatgattttagtttgagtctcttctaagaggaaagaggcttttacatttagtatttccatctaattttaagatctaactttttcaaagttttccaacccattccctctattgtttcctaaaacacataaaaaagagaaaagtcttaatacttcaactagggcatggattattatttggaaatttgtatatttgaaaattcacgctttagaagtgcttctggattgaaagtttaaaaatcatacaaattaagaggaacagattcaatgagaactatggggaaactatccaaatcctttgggaaataaaagttccaagacctaaatacactagatttgcttatttctgacttaaaaataatcttaaaatatttcctttcttatatcaggaaggcagatttctacctcatcttagttgaaaacagatatttcttttttggggaggattattttttaaaaatatcaattgacacataataactgtacatattcatggggcacaatgtgatgtttcaatatatgtatacattgtgtaatgacaaataggggtaattatcatacctggaaccttaaacagttatgatttctttgttttcagaaattcaaaatcctcttctagctattttcaagtatacagtacagcattgttagctacagtcaccctactgtgcaattgggcaccagaacttatttttcctacctaattgtaagtttgttaccattgagcaacgtctccctattcccctcctcctcatctaccctttcctggctttgataaccactgttctattctctacttgtatgagatcaactttttagattccatgtatgagtgaaatcatgtggtatttgtctttctgtgtctggcctatttcacttaacataatgtcttccaggctcatctatgttgtcacaaataacagaatttcattctttttctttccctgaatagtattttattgtgtacatataccacattttctttacgcattcatctgttgatggacacaattttaaataaacacttagcttggatccacatcttggccattgtgaatagtgctagagtaaacatggaggtgcagatatcaacatactgatttcatttcctttggatatatacccaatagtgggattgctggataatatagtaattctctttctaattttttgagaagccgccatactgtttccatcattgctctactaatttatattcccaccaacaatgtacaagggttctcttttctccacattctcaccaacatttgttatcttttgtctttttgataatagccattctaaatggagtaagatgtggtttttgctttgcatttccctagtgattcactttgggtttgctttgcatttccctactgattaatgatattgagcattttttcatatactttttggccatttgtaagtcttcttttgataaatgtctattctggtcatttgcccattttaaagttgattatttgtcaactcaaaatggattaaagacttaaatataagacctgaaaccactagaagaaaacgctggagaaacacgtcatgacattggactgggaaagaattttttggatatgactccaaaagcacaggcaacaaaagcaaaaatagacacatgggattacatcaaactaaaagccttctgcacagcaaaggaaacaacagcaaaggagacatcttagagaatgggagaaaatatttgcaagctatacatctgacaaggattaatatccagaatttataagggacccaaacattgcaatagcaaaacaacaaataatcctatttttattactttttaagagaaatttccttgagaacaaacacctgtgaatgatactaaccatcaactatgggattagagaacgtaagactgcagagagtattaaattgaatataatggcttacctcttacagtaacagatgcttcctaattgtatatttaattagggaagtgatgcattactgtatattagtgaaaattaagccccagggcaaaattcagggttcgggatggggtatgggtaagcctagggaggcaaaattgaagagcagaacctcatctggccagagcaaatccttcacttcaccaaaaactgtatgtcttggaatctttgaagtgggagttattcataccaacataacaacaacaacaaacccactgaaaagtcaaagcaatatacttatggctttgtaaaatccagtcctgtggacacattatttaaaagtggtaattcttggccaggcgcggtggctcacgcctgtaatcccagcactttgggaggccaaggcgggtggattacttgaggccaggagttcgagaccagcctggccaacatggtgaaaccccgtctctactaaaaatacaaaagttagccaggcatggtggcaggcgcctgtaaccccagctactggggaggctgaggcaggagaatcacttgaacccaggaggtggaggttgcagtgagccaagattgcaccattgcactccagcctgggtgacaagagcgaaactctgtctcaaaaaaaaaaaaaaaaaaaaaaaaaaaaaaagacttcctctcaagcttggcaagcttggcgtttggtcgatggggacccatgggggttcaacatgtgtatcaagaagtgttatttctgtctggggcccatccaccctggccatggcaagatgttcatccgcaatgattgcaaggtgttcagattttgtaaatctaaatgtcattaaaaactttaaaaagaagtgcgatcctcacaaagttaggtggaccaaagcattctggaaagcagctggtaaagagcttacagtggataattcatttgaatttgaaaaccgtagaaatgaacctatcaaataccagtgagagctatggaataaaactactgatgcaatgaagagaattgaagagatcaaacagaaacacgaagcttaatgaacagattgaagaaaaataaagagctacagaaagttcaggatatcaaagaagtcaagcaaaacatccatcttatccgagcccctcttgcaggcaaagggaagcagttggaagagaaaatggcacagcagctacaagaggatgtggacatggaagatgcttcttaaaaatctctgtaaccatttcttttatgaacatttgaaaatgccctttggagacttgaaactgctaaattattagcttattttttacataaggccacttaaatgaaaaatgattaaaatatatttttcctaccttgccatctaatggcactaggcagcatttgtataataactaatggcaaaaattcatggctagtgatgtataaaataaaatattctttgcagtaaaatattccctttattaatgttatagaagggaggatacaacaaggaactaacaatttgtatgacagtgtcaaatattatttagattttagaatttcctgttttgcttcatttgcatcttagaagagcataatgacattgtttgatgaagcctaattatgctggactgttttgagctggtttaacccttctgataggtagttgtggatgtcgaggatgagaactgaataatctttgcctgaaatcacactacactctagaatttccactctggagaatactcagttctaacttgtgattcctggtagaacaaactttatttttctagcctagcaatgatctagaagcagaggaatcccagtgccttttaaaagttattatgtggttttcttttaaaaagctcctgtttttggaaagtagaatttctgggtacaacatctgtttattatttgcacataaaataagccatttaaaaagtgaaaaaaacaaaacaaaacaaaacaaaaaacaaaacccagggcaatgaatgttcctggcacattggagaggcagtccagtctctggattcacagtgtgggtagtggagtggactgcctggtttcaaatcctggctctgccacctgctgtctgtgtgaccttgggcaagtgacttaacttctcttggactttgttttcccatatgtaaagtgggagcaatggcaatacctactgtgtggactgagtgaactaatgcacataattcagttgtgcagggcagggtgtacagctctcaactgctacctgttattagccctaataaactgattttaggagggcatgagtatatgtcatttttaagatcgtctattatgatcccttaggctgatggcaacttgaaagtgcctctatggtaatacttctaccactttggggtaattaaatgttcacatgttggtttcctccactggattgtgaactcggtggattttagtcatctttgttaacaaagtacatttaaggaaacattgatcagaattgggaaccacagtgatttacttattactgggagagacattttcattttggctaaaatgcatactttgaacagaaaacatctttttttcaattaaaagaataaacaggtaactcttaatctacaatactttggcctaataatattaccatgaatcaactttttagaccgtctgtgtcctaaagtatttttcatggggagttttgattgaactgggacttttggctgaaatgccaccatgctgagaacagagaaaacagcaacttggggttcaaactgaaaattagctgcaagttgagatctacatcatttatagttggtgaaagttctaattcacaatagaatagttccagatagcagatcaaccctatgcttctggttttgaaagactctggtgaaatgtagtgaatgcaaccttagctactttatcaagaactgagacttacttaatcaagattggaaataagggtttatgatagtccgagaagtaatgaagtttctattttcatgtaaactacataagcaccaagagcagcaaaccagaaaaatgccccccaaaacagaagaatggcttctaaatatatgtttttttctaagtttcattttaagcaacagacaaggatttaactaaattattctctacttaggctactaaaatggcttttctattgctatcaggatgtaatttcagatccactcaatttcatgaaattgactgagattcaaatcatacatctggtatattttaaatgatgctgcatgcactaggcaatactgatgctgattatcacaccggagtagctggtctcaggtaatttagttaagagtattaaatcagagatgcccaattaatttattagacatgttcatgaatatttctaaaattattatgaggcttgatgaatgaaaactttccctttttcttattgttcattggtgacacaaattaggccagataaatatttagaatacaagatttccagaattataaaaccagggagaactctaaagtgtatctagtctaatgttctcattttatatgtaagaaaacagaggatcggggaaacaggagaatgtagtggttaaaagcctgggctctggagtcagacagacccgaattccagtctcagattggcaagttattccctgtgtgaccttgagcaagttattcaacctctgtaagcctccatttcttcgtctgtaaaatggggacaataattgtactaggggacactgtaaagactcagtaaatgttagcagctatcatattatttttatgaataacaggtgactcctaaggcaaataaccagccacggaactaaaacttagagtttctgatatatacagaagcttgtttttttatctaaactcagtacctaagttaaatattcactggtactgacaatttaagtactgtctaactctgcattaaatagaaggataactatttcagtcttttttgctgttgaattgatcaaaatattagtgattacatattgaagtctcaatttcatgaagattcacacatatttagctttccataaacaatggatatttcatgtttaccttcatagctgtttcagtgtaattatatgctcttaaattattttccaccaaaagctgctcatataaaataaacaacaaggtatattggccataaataaaagttaggattgcacttactaatgaccttaaatttgactttagttagatgctatattgaacaagtctgatattctcaatttgtgcagttactcagataccagcatagcctctatacacctgttatggaggaagcaagaacaagggacacgtacaaaaggaaaaggtgggtctgcaatacgagttagagttgctttggctaaaatagactcctaggaatcaagcagccactaatcacagatatttggaattgccattttttttttttttttgagacagagttccacttgtgtcacccaggctggagtacaatggtgagatctcagctcactgcaagctctgccttcaggttcaagcgattctcctgcctcagcctcccaagtagctgggattacaggtgcatgccaccatgcctggctaatttttgtatttttagtaagaggggttttgccatgttggccaggctggtcttgaactccttgacctcaggtgatccacccaccttgacctcccaaagtgctgggattacagacgtgagccactgtgcccggcctggaattgccatttttagttaacatttgcccttaaatagttcattccactcaaagttgaatttaaaaaaataaaaaaaaaaaactgagtaagaaattgcataaagaatattagctttatataatatgctcttaatacttctgcttttgataattttagtcaattggtgatgttttcagtaaatattctcagactattcagtgcgtgcttaaaaccttttgttgtaataaagatcatttttctaatctcgaaaatgatacaattaattttaaatctttaaaaataattaagaacaaatatagtacaaatatagcaaatagacattaactcaaactatagtgagataagttcaagcataaacatgcagaaagcaagagcacctttttatgtaataccaatgtgattcagcagaccaacagatggagaaaatagtaatttgaaaggtggcaatttgtatccatacccagtatttagtatttcagctactagaaataaagtagtttggcagacttacccgcatttttgcacaagcatcttgggttgattctgtccccctaagctcttttatcagcatagaacctaaatactaaaatacaaaaaaaattcaatgatttatgaaatggaatatacatatgagtaatgttttaaaaacaaattgtggaagtattactggctaggtttcctggctgtaagttgttgcataactttaaaaaactgacagtaactaatcctaacaaataaatgcattcatagagaaaatgcagcagaattaaccataagttctgggggctgtaattgctctttataatgaaactgcaacatcttctaaagatgccatctttcaaatcatatttaactgcaaaatgggggcatctaaaaatgttttccccttttttgaggcagcaatgtctgcaaaaataaatcacactactatctctgtaattacagggttgcatgagacagctgagaagctaagcaacatgtcccccatttaggcttattctgctgcataggtaattaatgttaggcttttaggcagagatgcagttttggacctttttcattcacagctgtgtgccctatggttgatccacctgagaacgggatgggagggtggggggagggagagaggcattctcagttgtttcccaggggaagagagctgggttcctggtgcgaagtgccacctggagggctgaatggagctagaaggatgacagtctcccaagaattgccaactactttgttgttagaagaccagaccccatactgtatcatcctggtacaaaatgcccctcgtgctccagcttctggctggggccaaatggttttaaacaaaatgtctgatttgcctttctatcaattgactccccttcaaccttttgaagctttagtagggtttttgccttttgtcattcccctgccccttgccctccccccaccagcccccaaagagctctatatatgttttttaaaaaagtgaattacaataattattttagaagatatctgatggacacttcctgacaagactggagacttgtactctgcagagacggggatgggaaccactcttgtggactagggaagtgcctgacttgaagaagacgtgagagggcacaacagcagaaggcgtggtcagggccttggagaaaggcatgttcagaaaggcttggggacttggggtttggagggaggagccatttcaatcctatggttttgggcagtaccactgaaataaatccaaagctgcaatataagtaagctttagtaaaagaggggcagaaagcagaaaatgaaaaaaaaaaaaaaaaaaagctcaactggtatgagataaccacaatgtccatctaaatcaaatgaaggtgaaatttattatcttttggtaaaatccttatcttttaagttatcagggaagtttgcctgattgaaatgtttctttttaagagaggcagtttcaatgcactgctgaaggttcagccactttttctgctgtcgtcaagacaaccaccacctgacccaaaacctacagtatcttttgaacatttaccagttcctattacatttctcagctaattataattaattcccctcttctaaaaaactaaacaactaacctaaactaaaccaaactaaactaaacaactaaaacagaaaaatagtataatcctattgatgacagtgaaaagaatctggtatttacataaagtggcagacccagtgttttgagacccagtgtttggtgagtgagcagagatatatatatatatatgccatatttacactcatttccattttaagattgtacgttataacatttatttaaaaatatacaactatataagaggtcacaacagaccttaaacttacaagattaaaacggttttaaagctctagttatttggactttctctttggatagaaggctactttaagaaaaagtgaagagaaaaacattttaaaaatttcagtgatggatatggatattttggtatattttcaatgtaaatgcaaacaagctgaaaacataccccctatctccacttaggcccaaatactgaattgagggtaacttacaaaagctttgtaatcacacgactggaagataagcttttctgggtgatgctgccagtactgtaccggggtagaggctgtggcttcattcggaggtcgcaaggtaatggaaggttctccccagtctcctgtctgaaaatgacatttattctagaggcaatatgagcagtcagcaaagttcattccctgtagctaccctgagctcaccttacacacaggtgctgtgaatgtaccaaaatgcatttgggtgtcttatgtgaatataaatacttggttattacatttttatatgtattagcatatctctcaaggctgagttaatttttgaggtgtggagttgaattattctatttttagaatgacatcctaagctaagtcactttaaaataaaacatgaagatattcataaatgatttactaatcacaattttccatcacaacagcaaaggacacacaatctttaaaagaattttgtttttaaacttgactgaaatttttagtttgaattgctttcacattcagaacacacagttctataaatttcagttcccaaatatgacatgtactagccactttgaataattttagatctctggagaaatggtagtgtaagcatgatgctaaacaaaatttaaaagaaaaatttactaatgggtgacactaatttctctcatctgaattcaattgcactgatttaatgatgctgtctcagatggattcagctacttttctcagaaaacctaacgtaccaatgaagactaaacagtgaaatgccaagtttggtcacatgtacataggcatgtactttgaggattctgattcacaaatacaagcacattcccaaatgatggtatatcatatgatacagacctaaaacaggaggacctcccatcatttcatttatcattttccatgaggttagcctcaacctgtttcatcagtataatagcttaatgtgagcatctataaagtcaaaggccagtgttggcaggtattttctgggctctactctgatttacatactacgcatgagatatttcttactctttctcctgggaaagatttggatttttccaaaactcagttctttgttctcaagtggacataactaaaactaaataggcagatttctagagtgactctcctctaacctagatttggctatatatagaactatgagaaattacttttctcaggagttggaagagtgtaaaaaggtctcataaactccaaaatcaaataaaaccttggttagagaacaagttccacagaagtgctagaaagtgtgttgacacactgtgggatttcttaaggagaatttttaaggagtctaggacaagaatgcaaaattttggatgcagttgtatgttttgggagagaaaggaagttctctgctttattaaattctttgaaagaatctagaaactccaaaagattaagaaccacagttctctaggaatggcgtacatagggtgcatattttggggaggagaactagctctccaattttctttgcgcactttggacttacattaggtgacatatgaagtagctgccaatgataaaaagccctttctagaggacttcagtaatgcacaggctttttttttttttttttttttttttttttttttttttagcagtggagtgcctgaagcttttctccttgagatgggtcacttcgactcgcagaagagcaaagttagcatcacgctatttccttggcttctcactgtagttagtgtgtgactagttggaactccttcggcttttctctcctgctctgttctcagccactctccacattagttttgttttcgttgctgatttacttttacattgcttaatcctcctattccctgtctgttggtattttttatttttgtacacatttatggggtatatgtgaaattttgttacatgtatattgtctgttggtattgttaagactttacttgcaatattaactttagcatttttgtctgttttattatccatccctgactcattcttgagtttttcttttatatttatatgaatttttagtttgtaaaagtgataactgactgcaattctaaaattagattaagtttttctttggcttcttattttgattttttttcttttccttctttctcaaatggctggctctttattctctctctggtctttatttcatctggctgtaacttacttttgaaaaactagtataaaattcaaaatataggatacgtggatttcaatatcattttgaagctgagtgtaataacctttaagtgataatagcttaaaattctggaaacatgcagctatgggttcttaaacaaaagctttacccaaatctatcaaatcatcctctaatctcccccattaaacttctccctccttctcccgctccctggataaagcaacaacaacacggcaaacaggtattgtacatttaagtcacaggtaacactgttaacaaaacaacagaagtttgcatgcaactccgtggaatgatacaaaaggaggatctggatggcttccaaagatcctttgatccagtgtctgctgatgtgacaactcaaaccaagcatcagatcttcatgtgaaccctattacagttcagcagaggtagaccttggccaagctcaacaggtagttttcaaaaaagtctgaacacggcatgagctggtggtgccatgagttgcagggccagggctgggaacagggctgggggtgggaatgagttgggggaagctagggttatgaaaacatttcacgtgttagtacattaagcatgcaaatcatatgcaaattcattctctaattgttccattaactcacacacttttataattaaactttaatgtgagttccatacatttaaagccagagccacagccaaatgctgatccaaatatttacgtcatccacataagttgtagcagccattgtgggaataacaagccccagcacatacattccaatctcggtctggaaatcactgaaatcccttatttgataaccactggaagaaattagtggaacatccacttaaatctgtttagacagcgccatcatctgctctcccatgactccactttgtccaaaatcacaaaccacttgctttgaattcagagtgatctgataggattttccctaggtgctaaggtgggagataattacaaggaaaagaaatataatacttatttcattttctttgtggccttcaaatattgcttcagtccaaatattgtcaaattccctacagggactgaatctacctttctggaaagagacactgaattttatcagatttagtgctatttccagaaattcatttttaaacagagggaaaggtgttcttaagattgaatttattagaaaataaatttcttttctgcctggaaattcatcaacttctctccccacccctgcctattttttttttttttaaacttagatctaaaagtatttagaagactcaatttgtagatgttaattcttctttttggaattaatttaatgggaatggatggactccaacaactggacttaacattacactgtcgtaaaggacaggtatgaccttggcccttggctgggattcagctgtacctggttgactcccagtaagaacaaaagagttcagagaacaagggtgccttaggtctcaaccctcctggaggctgaattacagcaggaatgagctatggaggaattacgtagagtagttactatatggaatggaagaagaggtcaaaaaagaaagatttttgcctcatacataaaatcattttgaactttgaagcctagtgttaggtcttgttgactagtacattcatgtctacataatacttgcatctcctcaggcaaatatttttaaatttagtaattttccacttaaaaatccttattaaatattaaataacagacctaagaagtcttttgccacaataatggtttataatcaaagcttatttttaatgaaaagcagacctaaacacagctaacaacgcaatatttcattagaatagcaaaatgaagtaggaaaagtttagggtagaattctgtcatattttaaattattattgacacagtggtctttgaaaggattccttaagtaatcacaaatgagaaatcaaaatgattcaaggtactcctaataaatgtcttcaggctatctctttggcacttaaaatatttacagaaaatctttcctttaggttcatgtatttgaaagatcttcatattccaagaattttgtcatggcttaaaacttcatttatttggtatttattattattttttatatgtatgcttaaggcctttttttttattaagcacactaaagaacatcaattaaacagaggaaaatgtacatcattagctctcttcttcaaactcaaataaaaactaaacttctaacataaaggaaaaatactttgacattagaattttaaatggagaattgattctgtgtaacacatgtttgcaactgccaactataaatctgtagtctgggtgagtctgaaggactataattgggccacatctaatataatgtaattaaattaaacattctcttataccaacaactgaaaaatacaaaagcatcaatgggatttagttaaaaaacaaaaagcttcacaaaatacagagatttttactggatggcagattccaaattgcagcttttaaactttgcattatttcaacaggtggtaaatagctgcaaatttttagttcacatgcactggacacctacagcaaattctaaaacaaattgtatcaggtagctgtctccctccaaaagggaaactgaatattacatattctatatgctctgagaatagaaaggaaaaacccttctctatgttattttccgtctttattattatttatttttccaagatggagtctccctctgtcacccaggctggagtgcgatggcacaatctcggttcattgcaacctccgcttcctagggtccagtgatcctcctgcctcagtctcccaagtggctgggactacaggcatgtgccaccacatctggctaacttttgtatatttagtagaaacagggtttcaccatgttggccaggctggtctcgaactcctggcctcaagtgatccacccgccttggcctcccaaagtgctgggaattacaggcatgagacactctaccaggcctttatgttattttcttcttaaggaaaaagtttcctaaggatgtcagtagataattaaaagccatgcttacaacttacttttctaacattaatagaaaagtatggcattttccaagccttgtattattctttaaaatttttaaaaattaggatttaattgatttttaaaaatagaacctttaaaatcttttctatgaggactgctcccacctacttgcttataaatttagatctgaatattaacaaacattagtctcaatttcttcagaacacttaatgaaaaactaaaatgattttaaaggacaattattgttttaaggttttactttcaataattatgacaaatttcagagatgggctacccaaacatacataagatatatgtgattacatttactttctgtaatctctaaggctttgaagaatgctatacacagctctatgcttataaatatgcatacgtatatttgaaagtgaatgtaaggaaaaggcttcccataaacattcacacataatgaaagcaggatgttgtagttgttctttcaaaaaatcttcaagaatgaagaattctagtttgatcaaatgcagttggttatactgaatttgttcctttagatgaaaaagagcagagatggctacttacgaacacataaaagctctggttaacatttatgagtccaagaggaactgctgggtcacgtgaacaccagtaccaggcaatgtatagacaccatggtcctcaagagccagaagtcccatgcacaggagtacatatgtgcctgatgcagcatcccaaaaggcacttcacaaaaatacccgtggcatcccttcacatgccgccccaagaatctgctcagtgattctcaaccaagtgtctcaacctctcagacagcaggctatccaatgggagaaattcaaaagggtgtgaaaatagaatagtattttaaaatatggaacataaaaccccaaacatttaaatgtttattttccaaatagaaataaactttttctaaagtatgcaaaggtgaaatatgaacatttgaaaatcatgcagctcagagtaaaatgggtcacaatttcatacaatttgcaaagatcaattcagtactgtcaaatggaaaaaggctgagaaccactttgtagctgtaaccgtgcctctcccagctcacctccccccacatttgcataaaatgtatacagaataacatgcaaatcatactcagaaatttctcacaagtgaagcacatgaatctttgagaatcattagacacaaagggttgaagagtccatgaatatggggaggtacaaaatggggaggaataatgctgatatatacatgtgtgtatatatatatatatcaatttacccttttctttttcctgtaaaagcaagtttaacacagacgcctggaatgaaagccaaaactcacatgggacatattttaaccatacactttaaaaccaagtatgtttcttgttttaggacaatgtttgcacatcaactaatcacaaggcacagtaaatgaagtataatagacaaagagtctcggagtcaccagacattacaaattttctgcattgccaggacacagtacctatagctgttgacaacactgtgcaacacagtacatagcgcaagttcaggagaagaaaagaaccatttgtaaccttacattatgaacctgatggatcgctgagaaaggaaatcctgcgttctgattcgtccatatttcacagacagacgactgctgatataaacagaaaactatcttatcttgtcaatatttaaaacatggcagctaccaaggtagcatccaggaaggaaaagaggaaaataataaaatgcaaagaatcacatttaaaaaaaactcaaaaaatgttttagggtgctcaaggtttaataattgacttccaagtcattctttttgctttaaaacattttgagttgactaaaaaaatcatttatgcatttatgcaaggaaaattaccaataaattcatgccttggaaaaaagcaaactgtattttatatttgccggaaaaccagaaataccttcccccttcacgtcactactttcagaggataaatattttcatcaacttcaggaaaaacaggaaaaaacctttaacacaggtccgatatttttattttcttatcttcaatgaccaagagcaaacagtgcaataaaatgacttttcctgatttagtcattgctctatttgacaaacctagaagatatttatgcctccagagttcttacgggcaaaactcggtagttaacaaaggaagacgtgtcagcttgctacccagcactgggaggagtgaaggaggtggcaggaaggaggctggggcagggaagaactgaagtcagggaaattcagttctgttcctcaagcagaaacccttgggaacagcatttgggagtctaatgattcagctccataattctggctctcccccacaccattaataagataaacttatcagtaatgtttgctcagaaccaaacactaaactaaccagcatcccttcccaggagttacagtagaaaccttcaaagagaccgactgagctcttggcttgacccatcccaagttctgttcccgaatttcatcattctaaaagacactgtgaaattaaatcacagaaaatggcagagcatgtaaacttattcagcaagctctgtgagcatctttagcattcacaagcagtccgtacaaagatcactgcaggaagaaggcaagcacataaccataatatggttaagaggcccggcaaagaactgtatcatcagcaaacaaatgatagaaaagaaggcttatccctagctaaaagtttcctcaccccagaaacgctcaccagcaatttaacacctctctctctagttacaactgcatctccacacacccctacacctttgctttccatgtcttctgttaaccagaggcttgctggggatggttaaggaagttagatccccagggtctgaccaaaggcacttccaaacacctttcacttaaaccagctctgctatcctcagttccctctctaaacttcatgctattttatacatccatagagggttcttcctcttcttacctttctagcaagttcagtcttagacccattcactctgttggccttgtctccaatagctctcctctgatttgaatgtactaactccatgcgttagctggattaccatcttaagtggcatcctcacccagtcctgagctaattctttacacaaatcacatcttctgcaactttcacacacttctagtgttaatctagtgctagaagtgcttctagcacttctagtgctaaataatccagagaccacctgtcatctgatagatgaagacacagacatttaaagaggtgaagtggcttgctcaggtcacacaggtgagtggcacaatgtgtcagcctgctgggatggctaagaaggagtgtgagcctggtactgatgtcaccagaaggcagagggccactccagctatatacagcttggttctactgaccctgaaatgaacagaaactaaaaataaaatcgtaagccccctcaccgactgaacggacccccttgtggccaaggggaccccagaaaaaccttaaaattgagtttctgaccatgatgggatgggaggtgagacaagcctcattatacctcctctttttcatggtttagacacaacaactgatcggaattaatgttaaaatagacatcataagagtgacagaacagtctctttgtggctataagataccaaattatcaacaggacccgaggccatgctaggcaaaggttaagtcacgcacccctatacctaaagaataaactatgttccaactgccacaaggtttttctttttctctagcagctaaacaggtactggccttaagagaagcaatatttaaacaatttgcacctccaccagatgctgattgacccttagcccctgctccaccagccataactacagctggacaagagattgattcagtaactttatccaaataagattactaaccatggactagttctggttggtctacagagattgcacacttgtgtgccttcatgtcctgaaaagcccttctgacgaacagggctaactgtaatatatctacatgttaagtctccaacccaaagtgaacataggccacatgttacatgcatgttggttcaatacacatgtgtcaggaccaccttcatgaatattcacagctcttgtaacacattgaatatatgtgtttagctaatctgttcagcataaatcttctacctaagcccttttccttcgaagtacccgtctctggggtcttggttggaggtgcttcccagcctgcgggatggccatcttgcaggctgtaaccctttagaagaaataaagtctcctctactttactaaattcatatatatatatttaagttaacacaagtatatctaaatgcaatcagttcatgagacagtcttaactgcactggggtccaaacaccaaaaagttgttttaggttgttttggttactcccaaaggggccatgcccagtctgcctgcctgatgggcacaaggccatttaaccttttgggcagactgcatcacttcctggtcactttgagtcatgaagactccattttgtatgaaatccaaactcatatctgattcaaacttttccttccctccttgtgtgtcagtcttggggcttaaaaagcccggggtggataagagaagctcggtctgcgctttgacttctcctaggagaggtgagggcaggtgtcatggtctaccttggatgttccctgccccaagctctacctacttcatgtgtttagttggggaggaagaaacaggaaaaggacgaggtccctttcttgtctggctgttcctctggcagccgcactgcttttcagctaacgttaacatggtctcccatgtgctctacgtagcagctgctccaacctaggttctcctgtgtccccgtgtgatttctttggagagctcttctaggatagagggcaggtcctcccactgcacagtttctgctggcagaaatctgcctctagcttgacttcttccaactcccactcagccctcctaggacacatgcatgccccctgaaggggacccagggggacaaacataaccccagactccttctgcacatccatgtggcccacatgatatggacacacatccttgtcacacagaacagtagaagggcgggctgctctgtgaacactccccctctctgccagggcatccctccccaagactctctgtgtcagctcggtaggtgctatgtgacctgcctggcagaagtccaattatggataccaaggccagttttccctcctgcaggcacccccaagccagatgtacattcctcctggaccccttctcaccaggattggagagcacgggaatgcattctgtctcctctctcatggcaaaggaggaaaagccttagttctttccacaggactcagacaattccctgtccttctccagcactaaccaatgttctgcctatgtggagaggtagctgacaggggcagggcaggattcacactgcctccttgtaaaccccgaactaggtgtctggctccatgattgatagctttctctttagggtgtgcagtgcttagtacctacaggaaaattcccacttagcatcctgggaatagatcttccaatagtgaatagatctttcactactcacagaaatttaccagagttaagaagggaaaagaggatcctacgccatacttatttcattaaaaaaaatcatataaaatttttctcaatgaagaataaagaacctacccctagtcatatacactgagagttcatacatggcttatgtacattttttagatgttataacaaatattttctatttataagctatgttgtaaatttagagaaagtaaaacctctataatttctaataccgtcatgcacaacataacgatgtttcagtcaacgacagactgcatatgctacaggggtctcacaagactacaataccatatatttactgtaccttttgtgggggttggaagaagtaaagctagagccagacttaggtatgtttagatacacaaatactcaccattgtgttacagtcacctacagtattcagtatagtaacatgctgtacaggttgggaggagcaataggctagatcatatacagcccagctgtgtggcaggtgacaccatctcacgttgggtaaatacacactatgacgtttgcatgacgaaatcacctaacgatgcatttctcagaacgtatccccatcattaggttatgcgtaactgtcatcgtgtcagtgcaagtggtaaaaagtcagaatttaaaagagtttaaaagcagttgtgtttgagttgtgaaaattattattttattttttttgacacagaacctttgctctgttgcccaggctagagtgcaggggtgcgatctcggctcgctgcaacctccgcttcctgggttccagtgattcttgtacctcagccactcgagaagctgggactacaggcatgtgccaccatatccagctaatttttatatttttagtagatatggggtttcaccatgttgcccaggctggtggtctcaaacgcctggcctcaagtgatccacccaccttagcctcccaaaatgctgggatgaaaattatttttttaaaaaatcggatgcattccagataccgcagtagttttgttagcagtaaataatttgtcaggctcacagagcaagcgacttaaggcagacctgttgtaactgctgcattcataatatgaaatggctcttctcctagacatagggtcattatactgagtgctggaattaattttttaaatccaagagtttccagagtagaaattaattatgtttatgaaaataacatttcagggtaaaacatgtattgaagtactgagttttgaaaagttttgagaaagaaatataataccagtcataaaatttcatctggggcccaaattcctagaaaagtagtgagttaagtttttttgtttttttttttttcttgagatggagtctcattctgtcacccaggctggagtgcagtggtgcaaccatggctcactgcagactggcccttccaggcttaagtgattctctcacctcagcctcccaaggagctgggactacagggatgcaccacttcacctattttttttttttttttctaaatgtgtagagaggaggtcttgctatgttgcccaggctggtcttgaactcctgggctcaagcgatctgccttcttcggcctccggaagtgctaggattacagttgtgagccactgtgcccagtcttaaatttaagttttgtttttttttttcttttttggtggcattggagacagggtcttgctctgtcacccaggctggagtacagtggcacaatcttggcttactgcaaccactgcctcctgggttcaagtgattctctcccgggttcaagtgcctcaacctcctgtgtagctgggatcacaggtgtgaaccacctcacccagttaatttttgttatttttagtagagatgagtttcaccatgttggccaggctggtctcaaactcctggcctcaagtgatccaaccaccttggcctcccaaagtgctgggattacaggcatgagccaccgcacctggccaaattaaactattttgtttttttagtttttgtttgtttgtttttgagacagagtcttgctctgtcacccaggctggagtgcagtagcgtggtcttggctcactgcaacctctgcctcccgggttcaagtgattctcctgcctcaacctcttgagtagctggcattacagatgcctgccaccacatctggctgatttttgtatttttagtagagacaggtttcaccatgttggacaggctggtcttgaactcctgacctcaggtgatctgcctgcctcggcctcccaaagtgcttggattacaggcatgagccaccgcgcctggccataattaagctttacaatgtcttcatctgtaaagaaggagaatagtacttgacctacttatttcaccaagttgttgtgcagcttcacgagagaggaaactttttcacagctaaatgtttagggcttggaacacagaaggaacacatttttaccgaatgaatggaatcatataacacattcaaaaggccttggtaaatggcaaagcattatgcaaacattagtcactaccgttatccgttatcatttttaactggtctactctattggtgccacttgtgcctttcataagctatgtcactgccaacacacttccggttaattgtaccagaaactgctgacttcctattggaagattcctcatatttcctgataaagacagtaaagggctgccagcttgccgaagagagaaggaacatttgtcattagcatacctaggtgtcaaaaggctgcttgtagagcttagaaacagttccatgaaagaatgttaatcacccctttgcaatttcatttgcctattttctctcaatccctgtcacatatattgcaaagcctcatttagtttttctgaacctgaattactatgaaacccaaacaaataggggtaagtaaaggtagacttacaactgagatattaccaataatttaatgtttacttctttgatggtgaagtcaacacacatttgaaggtgtataattttatcttcagttcagacctctctcttagctctggaaatgttttcttaaaatgcaatgcatgtctcgctcttgttaccgtcttatactttcggttaccatgacttcagctcagaaaatacaacacaactgcattcaaatctaatcacaaaataaaaagaatataaccaatttccaaagttttcctcctaaaggtggacttcctttttgatccagtagtttacaataaattatctccccttcattatggtttgtcctctttcctggagcattctcagaaattgctataacatcttccatcaaaagcaaacaaactccttcccttgccccaacatcaccctcggtttcctgctcaattactctaatcttctttaagcaaaactccctgagaaatgtctagatggtctccactttctcttttcctgtcctcatctgagcccactctactgaaactgaaacaattttctattttccttgacctatgtgacacccttgatcactcctccattccttagcctctttggctgcttcctgttatctgagcatccctggagtgttagtcctcagtcttcccttccttcttggctatactaggtggtctcttccagttgtgactcccaaattcatatttccagcccagacttcttccctaaattcaagacttggacacccagctgcctgcttgatgcttctccttttgcatttattaaatcagctcaaccttaaattaaatgtcagagaccaagctcctgatgacctcacctccctgtgagcttccttgttttggcaaatggcagccattttttttccagttcctcaggttcacaatgctggagctctcctttctcctgtatctcgcattcaatccagcagcaaagcctattgaatctacttctaaaatttcaccttcctgtcactacttgctccaagctactcccttttctcgtttgatttattccattggcttcttacgggtctcactgctgttatccttgcctccttagtatctcttctcagtactacagccaaaatgacccatctaaaatgaaagccaggtcattccactcagctccattcaacacagaagataattcagtcctaacaatgacctgcaaggttctccgttctctggtacccacactgctctacctccctaccctcctctcctacccatcttcgtcttgctgtctgggttcttgacagcaaagcacattcttgcctcatagcctctgcatttgcttctctttctgcctgacatgttctccctctggctactataggcctagctagctccctcacttccttcaagttctattctaatgtcactttttcagagaagccttccctaggcatattacatccaaattaagtctgtgctttccactctataaaagaattattctttcaagcagaaattatttatttatttatttgtttgtttttgagacagggtctcactgtcacccaggagggagtgcaatggcacgatcttggctcactgcaacctccacctcctaggttcaaatgattcttgtgcctcagcctcccgagtagctgggattacaggtgtgcaccactacacctggctaatttttgtatttttagtagagacggggtttcgccatgttggccaggtctcggactcctggccttataggatcccctcgcctcggcctcccaaagtactgggattacaggtgtgagccactgcacctggccttaagcagaaatttaaaatgtaaaaaatgtttggcacataagaacctatctccctgtcaccctgacattcatgcaaaagtagttactggtcatctactgtgtgcaaggcctgggtcacaaagtgagtagggatcaatcttgcttttaatcaacgtttatggcatgaaaattgctttctccgtggacagaaccagtagtaaactgggactgacaggctgatggtgggtctcagaacagagcaagtagatgacagctccatcaactcgataacccctattaagctctggaaagcttctgggagtctgctgatattatatagctaatctaataaagaaacttttatgaatagagccctccagtcagattctaccagagatgaaattttctgccgtgttctagccctgaaaaaaaaaaagaaaaaaagactttttctctgtttctcccttatgtttgtcataatactttcaacacttcagggtattcagaaattgaccagaaagaaaccagcaagaaatatgaaagtttcagagtgaaagctcaaggaataatgaagtgcattccttcttctggatgatagtgcttctaaaagaaaatgaaaacagacttgaagagcaaacaaaacagcttcaaaggcagaagaaaaaagggcatcccagcaaaggaagccttagccaatagccagcaaactcagtggctccttgagcagagactgggatgaaatgagacctgtcaaaggatggagtcaaacaaattcagtgcagtcaaggggtaacgcaccaaacaccttgtatgcatattttctttcagcagtgacagccccacagttgcttcttctgtgggcattaactgaaccctgcctggaaaatcagaaaattagagccttttgtttcttgtgagttacccagaggccgcaggccagcatctgattacttcttcctgcccaccatcggagacagaggaacactcctccttctcacctcttgagtgagttttgagatacacactcagtcctgtaacaactgcatgggatttagattcttctctgcaaccacactgttagcttctcaagttccctgtctgtgtctatttatttctagttctaaagtgtgaaaaagttatgcatgcacccactgaccctttttataaaaggtctcagctgaactatttcatttgcaggaaatgctagagtcaagaaaatgctgcttcctgccatttctccatctttctgaagggcaatccttccaaaacttcatgatcgtgaccttcccctgtgcctgtggggaggatttttggacagatcagttatcacctgctgggaaggaaaagccaggccaacagttgtttctctaacaacatctgcacgtgtgacccatgattgctggagtcagcattaatcaacctaccaagagtgggaggaagtaaacaacacatttggttccatctaagtccactggcatgatataaattctaacactgtcttcccaagtttaaggttttccttccattccctttccaaactcccttccctttcccattcctctccagttccctccctccctccctccttccctccctccctcccttccttcctctcttcctctcttcctccctccctctttccctctttcccttccttccttaactctaattctgggactgatatcacataaaagaagtcctcggctactaaagtaggagagaaggagagaactataggcttatgatattcctgttattcatttgtagaggtaatatataacctgtattccctaatatgacagctgtagccctaaatggcattacacaattgtttatgaaatccctttacaagaaaaaaatagagcagaggaaaaaaatgagcattgcctgtacaatccagctctcattgtgcagctccccaggttccagggatgttgcagggaatttgagtcaattgggatcatgctgtttatagcaatatgggctgttttacttgttctacctcaaagtctggatgctatcaaacgtttttcagggccactaaaaagcagaacattaataactaattcagaaaggcagtgatcagctttttatcataacatgaatggctgaaaaaaacctagattttgcaaagtaatgttgttctttgtaacatctctttacaatatacattatattcctttcttgcaaagtgaggttgtcatttcctttacttaaattcatttattaactggagcccgactgtttgtttcctgcttctgacagaaaagatgcattgggcagagtcatttattcaatgatgtttattgagaccccaccatttcttcattttatccttgtgaaaaatatgaaaaaacaaggtgcagttgaacaatcctcttgaacgatgccaagctaagaggtctctagtagaaagctcacagtttttttttcaattctactttaatcaacacttcactcaatacactgatggatgacttcaaaggtttgttgttttgaggtaagattcttaaaatgagcacattacatagttgaaaaggatcactgatatactgagtggcaactaagtcttagaaaggtcttgatagactaggattattggatgagtaactttataaaaactgctttatctggaaaaggataatgtaaatccagcgctgctgagaaaggaggcgtagctattgataaaggctgggaaattttcatgaagaaaagcacagtaagaatgaatgacatgttaatgttgatctgcccagagctggggaaccaggatgctgtacggcccacatcccccttatcacatgggattggcaaggagctggagacatttaatatagtgaagggaaaatatcaaattgtcttcagtcttaaaaaaactcttcccagcaaaagggagcagatgtattctttgttgtttcagaagatatcatgaactatgtaggagttatagggaggcttatttcaattcaatataaggcaaaagttatatcaactagaccttttccaatcatggggctgccttacaaagagcgggccagctttccagtcaagtttaggcagaaacttgtggctgtctgtaaggatgtattagaatgggtgcctgcatcaattaagagatgggactacatacattttctggccccttctcatcttaaaattctctgcttttctttaacagtacagttggtcatctgtattctcagttctgcattcttctgactgcacagaagaatcttctagctattaatgcatacagacaaaagcaagttatcacaaattttgtgatcctgcattcaaacctcattagaatagaggcccatacagaaaggaggtcatatcatttcacaatgctttacatgaagcaattgtttactatctctgatttgtaaagaatgaaaaattggatgtcaggagcaaaggattttcttcaaatacaatgtttatccatgctactttagaggtttaattctctactgaagttgcatttacataaggtattagatattcttaataggatttttcaaggaactcaaaacattgcattggagcatttggggttttggaatttctggaatgtgccacgtccgctagttcccagtttgcagagacaatatggggtgttcatcaacactgtggttcacacgacagctgtgaagctaggctgctggcattggaatcctggttctgtaccttttaatttttgtggccgtgggcaagccacataaatgctccatgcctcagtttcctccttataaagctgtactaatcagtgctggctctgacgatgatgccgatgaatcaccaggcctaagctagaccgatgatacgctattgttccaggcagtgtatttccctaaaaaactggagaccatctcaatttgtgtccaatctgatctgtcgtagagccctgtggttttatgatgcctatagccttacataaagtaatttggtcaacagtatttacagagtgtttattttagaggaattaaaaaatgactacggaagagtgaggcattgcccccacatagccaacatacactttaccaaaaaagaagcaaacatttaaaaatgaaatataatgaaatattttgaaatacactaactcataaacatcctttaatttttaaaagtatttaagtatggatatcatccataattccttttccaaagagcaccagtgttaactaggttataacatgaataggagcttcttggacagtgtttgctttcataaaaactatgatttccaagtcagtgaagaggtattagtttgggcttacaagctggaaaacagaaacagttttgcaagatgtagctaaacatgagatttactttaaaatgcatttactcccagatgcagttgagaaagcataatgtagaagaaaactagaagttatctcaaaataataacaataatttctaaaacaacccaaacgtatagtttcatagtttgtaaaacacttcgaaaaaataccattttatttgtgcctcacaacaatgatgtggggtgggcattaacctcactctaggaagagaaaactaaggctctgcatagctaagaagcgtgtccaaggttacagaggaaatagacatcagagatgggatttttcaccatgatctcatttcttcaaacctggcattctaacaaagctcatcaaattaagtatgaaaaaatgaaatcaatactcatctgatatagcaattttccatcagacaatctcagaattccaaagtcagagtggatttattcagatgcccattattgctatttctgcctgcttagaaaccagcccctcttctagcagcagcggcctggctgttcatgggaggaggtgcctccttactcctcagtccacattgttcacatggagctaaaaccacccctggtgtgggacctctgtcttgctaatcaatctgtctgtctgtctgtctctctctctctgtctctctctctcacatatacacacccctttgcaattagctcagggaaggacacttgatccaatccaggctcactggaactgatggaacgtaatactgagactttttcttttttgagacagagtcttgctctgtttcccaggctggagtgcagtggtgcgatcttgctcactgtgaactccgcctcctgggttcaagtggttctcatgcctcagcctcccgagtagctgggattacagacatctgccaccatgcccagataatctttgcatttttagcagagatggggttttgccatgttgcccagcctggtcttgaactcctggcctcaagtgatccaccggcctcagcctcccaaattgctgagattacaggcataagccacgatgcctggcctgggactttttttttttttttttgacactcttggaaagataggttctctttcttgtaacttcaagttaaacagcaatttggcttgaatctctccacacggagagggaggctctttgggaaaagagccaacacagaggacagcagagccaagagaaggagagccagagagcaatgcagcaaaacagcacctggatccaggactcctgcccttttctgcttaagccatcttgagttggattttttgttacttacatgcatctggaaaagtccttgctgataaattactttaggcctatacgcacagaattaaccaagacagggccacacaaacagccctatttctactagatgttaaaaaaccttctttttattttttttaccactggaaaaagaaagggaagaaggagaaggagaataagaaccagagaattctcctacccttgaaaatttagcaagggcagattataacagccaaaactgacctgtggacccaagaactggactgcatgtaataagaaacattctgaaaatttaacaagtggaaaaataacctgctgggcctctttgtgaacaagctgctcaatgtcaacaagcccaaggcaccactaaatatcacaaggtcaattccactgaaatagggtttttatatattgtcagattttttgtttagttgttttgaaaacagaatattttctattgatatcttctttttctttttttaaatccatggtctggttttaactgcaaacaggacccttggttaagcaccagcacatggagacaaggtggagacgtcagagcttctctagcaaaacgactggaggtgtttagggctgacgggtctatcagaatcaactctggctaatttgccttcttgatgaccttgacagggaagaaaacaatctagacctgtaagatgagtatcaaagcctgaaaaagaatccatctgagtgattctcccacttcttccaattatttgttttaagactatagtacagtattcacaagacactaatcatattgacattagtgttgcccaaaagacacttaatcatactggaatttctaatcccaaagttgtctcagatagagcagggtgtatttgctaaaagaaaattaactgaccatattaataaaaaaggtgtacaatacatcaggtttaaattccaagtatggaagcgctattttccacttttgtgttggtcatagctggctagtggcctagagttcttggcttgaaatagggcacagatatcatcaacattccagatgatctctgaagctcgggtgtcagcttgtcaacttgacgagctgtcaaatcggaagctcctgacggaagagcttattgagtgcactcttgaccttcttttttggttatgtatgatctgtctgtgcttaagtattaagagttgctctttagaccttcatggaaggaaatgttgaaatcatggacaagctgagcctttctgagtagtggctatgtgatgaaaatctaaattaaatctaggcattaacttacggacattaaacaaaaaatctgatgtgacacagtaataggaaaacttgtttagtttggggaaaaaaacactctcttttctttgagacagagtctccctctgtcactcaggctggagtgcagtggcaccatctcagctcactgcaacctctgcctccagggttcaagcaattctcctgtctcagctctcctgtctcagctgggactacaggcatccgccatcatgcccagctaacttttgagtctttagtagagacggggtttcgccatgttggccaggctggtctcaaactcctggcctcaagtgctccgcccgctttggcctcccaaagtgctgggattacaggcgtgagccacggtgcctggccaaaaaagccactttccaaaatgctgttcctttcttggttgtgctattttctgaaaactgattctgtaaattccagtaatgccagagcagtgggtagaatttctgggaacaacaggcctattctctcaggaaaagtatataagaggagaagttactgtcctacttctttcccagacatggcaaagtgtttgcctcatggctttctgggatatccatgctttttaagctaacagttctgtgcacaatatatttccataaagttccaaatttcacttaaagaaaaaaaagccctctcacttgatattttatctaacaatgttacaataataacgtgttattaccatatgatattttttgttacaattttgtaacctgaattggtagagaaatatggcatccattctctgctttccctggctttgacatcattctacccagatccctctgcatcgtgatatatgctccttggcagatgatgtgtttacacaattaaaataataaaagaaaaatgcaaattccattctcaatctacatgctaaatatgggtaacactggaacaaaagatggtctttatagaatgctacaaccaccggagcacttgcccttcaactctctttgtcattaattggcctacaatgagcagggacctttgaattagggactgacaggtgatgggtctgaaccgatagtcatatctgtctatatagtgctttacagtttagaatatgctttcatataaattatctgatacatacaggcctgagaagcagacattatccacattttaaagacaaaaaaattgaaattcagagtcaccacataactcggtccaggtcacacagccagaaagaaaccaaatcagaattccaaccgaagaagccactaagaaaacagcatcgactatttggagaaacaccacaagcaagaatttgtttgtagacagagttaaccccacacctacctacaaagcttttcacaaacatgggagacaggcagcgttctgacacactgtgcagggtctctgctgaaggatcaacaaataaccagtgcagttttgcatttaaggatttcatggtgttaaccacgagttgattcaatcagtttccactaaactactgtgattttctcttctgcttgctgtgcccacataaatggaatctattatggcacatgagaaattagtatttgttgaactgtttttaaaatattttatatcattttaatacagaggcaggcacagggcatcagggactatagaagaacaaggatagggttaggcaggccagggcttgagtcccagctctaccatttaccagctgtgaggccaagcactcaccctgtttggcagatgtgcacataggctcttgtgaggattaaataagatactgcatgtgcaatcccaggcatgaacctggtcacagcagtgcttctgtatggctcagcttctacttcccttcctttaataatatcaaaacaacaaaccttggaagaactaaaatgtaatatacaaaatgctttcaaatagagaagtaattgacctagttgtacttattaatactatttagattgagaaatattaagcttgcaactgaattaattttctaataatttagaaaaagtgtctttagtgcccccaggtaatactgcttttttttaaatcttaggcaagagcattcaaaacataaagattttatattacacactattctcactaatatttaagctaaagtttatgcaaagatatgcatttcttttactgttgagaagcctttgttttgtgaaaatacaagtactatttcattttctcatacgtttttctgtaaatggaagccttctataaatggcttaacttgcagcatttggaaacttttttttttcttgcatgagtttggagaatgtggccttaaccttattcattccatcactctcttattgttcattttaagggtacttcgacttctaaatatcattcaagaaaacttctgaagactgcaattaggtcctaaatactgaaaatattttcctccttctgatatattttccatttactatctcatttccacataactcagaattaaaagctgatctgccatgtgctgtacacacattaatagtgtgtaggacaccttgtttgtgctaaaatgagataacagatgtcaaagtactttgagaatttaaaatcactatgcacattaaggtataattacacatatgtgaatgcaacatttatttattaggggtgtggaaattggggagtgtttcagaacttctgggctaatgagtccagtttagaattacaggctggagaagctatgttttcaacatgataggaaacccatcattcagatgtatttatatcattacattcagttcatgctgaactcaaattttgtttcttgcatattcatttaaaataatttgatgccagagtactgcttatatcagaataatagcaaacaatactcacaatatttgcaaatcccctgtatcccaagacaggtattttaaatattgtttcaaattgaaaaaatcaattaaaccccattctagtgttttattttaaatatctgccaacaaatttaacaggtaaaatggacattaaatttatctcaatttaactttaagcattgcttttccaagttaagcaaagcacctccaaacatctggtaagcagacctcaagaaggcaaaactcctaatgaattattgcggccaccaagaacttaaggtttctggcccagggctagaattccaaatcactctaatggtagctcagctaaacttgaagtagaggggtttctaagaacataaatctgtccaggtgattttctctcaactgcattctcatttcttttagtaggtaagaaagaaagcctgaaggtggacttttgcattttagtgggaaatggactggttaggcaagcattaaccaagctacagtaagcttcttgggagaaactccttgggaaagaactggaggaatggagctccaggttggaaggaggtataactggctgcttgcttgcaaaaattttaattgctaattcaagtctttaggaagacccaactcgattgtctaaacacataacttcaggggaaaaagtatggtctagagagatatgacaggtttttaaaaaagtatataaatttcaaaaagtattacagcaaatgaccaaaaataaggtagaataagaaaaaaacaaacatcaattgagtagttgagtggtgaaaagtcacataaattgaattattcaacaacaagatgacagagtatttcatattttgacaggttaaagcagtatttttaagaggtatgcattcattgctccatgggttttggccttccatactagcgatcatgctcaaaactgcaattaacaccacccagagagttgcagttccagaatccctttttctcattgatcagattcctgtggtgtcatctcctattttctctgcagcagaagtgctgtattgaacagcaggcttttagaaagcttctaataagctcctgatggctgatggagcctgtgtgtctagcagtcactcgatcatcgttagtactccacatgaggggaatgcatgcgtgcacaggtgctctagttcactacgtcccatcagcctgcttatctcactctgttttctgcttttaggcttttttcacctggccagataaaagcccattccattttctcaaggcaagacaattctcataagggatgcatttctgattggagtgacccgttaaaagatttgtgctatttggtactactgcccctgctttcgaaaacctcaggcagcatgtaagggtgcagtcttgctaggccacctctgagtgtttatacataggtagaagggtaagtcgttttttaaaaaaaccctgcagtatatggagaaatttcataaattatgtgagcagctgagagaggtaattctgctatactgcggttgacacagtcaataatagctaatgctcattaaagaactatactcccttacccagggaagaaatgggctcagaaaagacccagttcatattaatacacaaagacaacatggctcaaagttaaaacaaaccacatctctgaaatgctgtcattagagaaatttaaccacatatgtgactcgaaaatataacaagtaacgaaataaatgaaaagtttggggggaaaaagctttcagatgccctatttaaaagagcaccagtgaaaacagtaataaaaattaaaagacaatacctagcaacagagaaagataaaattattcttatttctcctatattttccatcccctttcaataaaagagtctccataatcccaacattgccattgcctgcacaaagaacccagagaacaattcaaaattaaaggagctgaaagaagacacagtatcccaggccttctctccccaaggcatctgcaggcagaatagccatggtttccagaacattctcatcacatttgtctctcgtgagctgcagcatacaatgtttaccagaggctttaaaaataaaatctcactaaacagttgagaaaaatatttaacaaccaaggcaaagcaattacagtcaaattttcacctcgagattcccatcttaggtgtgggaggcagagagaagactcctgcacatcagtctgaacctagaatgaggatgaaaagagttgattctgccaatggttgacaacaaatccatatttttgaatctcagggtgaaatgcggagctacccgcccatctgaatgtacattaagaacagcgccactgttcggttaaggctgactcaagtttctaagcagcaatccgaggacaggctagacatgaacatccctactaaaaacatggaaaggtctgaacgtgacagatctcccttttcaattacttgtgctagaaagcatcatcattttcaactagtcaaggtgacaatatgagaaaacgcaactagtcccagtagagcatttctgtatgaatgtatagacttgggaggaaattaaccacatcacacagggttaatccttccccccaaacttctgccccattatccaaccaatttacattttgtaatctagacttttattactcattttcattatgatttgactttgacactatattattcccttcagggcaaagactttctgggtgcaatgagatcagacataatttcttcagcaggaatgcataacaaggacatgtgtacacattccattcccagacatttctgtctcggtctagttcagatgagcaaggaatgaaaggcggggcataacatggtataaattctagttaggcacggacaataagcatccataggaagctactgttcactattaaaaggcattacctgatatggttgaaaaatatcacaaaggcttataacaccttacctgagccatctgcctctccagttttgatcggggaatatcatcaaagtagttttcatttcttctcctccttgcatcgccctgcatgataatgtgaggaacgtctagggagccaccagtggtgtaagtgctttggctaagtgatggagacaactgaggaggagtgtgattaccactgggttcctgaatggaaatacatcatgaaataaataccatgttctgtggctaacctttggtttcaaaattgtgaaatactgacaagacaaactgtgggggtggggagtcgcttttgaagcaacagccaaggaatgaatgacattccaccactttattaatggcatgatctagtcaatacgtttttcccctaagtatttcaggtcaaaggtctgaaatatcaagagtcaggttctgttttcctaaagcagcatcatggatggtctcaggagggaggcacacctatgttgggcacctctgacactactgcatgtgtttacaggggaggaactgggccctcatgtgggcagagcgtcctcaccatggtagatgccatgatgagaaagctaaaatgagacccaatgggtcttgatccttcatcaaagaatggtctgacaacagggttgggaagaggacacagtacggcaacacagcatgtcacacgcacagactgcagagcagtgcatgctacgacagaggatgcttttccaaggcaaagacaactccatccaagggaaacgggtcaggaggaagatagggggcatagacagctcagctctactatttgcaagtagaatgaggattgggatcatggtgtttctccagatcccttctcctccggatattctggaccttctatgatagatttaggtcctatacttttgcatggaaatctctgtctttgatctttttttgttcccctaaatctcttccagagagccagaatgagaggttcagaaggggaaggaaaaagagcagggtaagtagcaggaaatgactcctctaaagagtcattttagggtgactacactgatggtgcttatatctttctctccttccatgtagcaaaatgaaggcaaaacaaaaatcttttttttttctaatttatttgaggctcctctttctaaggggtgaaatttctatttgtacttttatgactcccaaaactctcaagtagcctccaaatatcccagtgtaccctaatgcccccagtaattaattaaaccagtattcatgtagtccctacccatcccactccagtctctctcaggaggctaagcttgtcctcctggagccaattctcttgcatcccctgaaatccttgcgcattttcctctccaaagctgaatcaactccaaatcctaacagctcctttcctgtcctgccctctgttatcctgacagtggctatgctgtttgctgaagtttattgataagaggcagcccactgcatttcatcacgatggttacgtccgggtgccgtgcttgtgttcatctcttcagaaaagaaatcagaagcaagcaagtgcaggacaaaatagagagcagagtgggcaccccacagctttcagggagatctcagcttttcgacgaattttagaaaagttcttgtaggactcatgaacaccagtgactgccggccacttcttgccactgccatttttgcctggaaatcatctttctcacttcctctctgccctttcctccctcccttccttcacttcctctttatttctctctcctttatacaggttctctttagtttcctacctcataatttttttttttttttttttttttttgagatggagtttcactctgttgcccaggctggagtgcagtggtgcgatctcggcccactgcatcctctgcctcccgggttcaagcgattctcctgcctcagcctcccgagtagctgggattacaggcgcccaccaccatgcccggctaattttttgtatttttagtagagtcggggtttcactgtgttagccaggatggtctagatctcctgacctcatgacccgcccacctctgccttccaaagtgctgggatcacaggcatgagccactgcgcccggcccctacctcataattctaaagtgtagttgaataaaagaaatacaatttattaagtaaggttttagattctctattctgaatttttgaagtgagtaaagctggacaaattttacttcttgaaaaacagaagaccctaaggttaattttaaattgatctttacttaactgtggtccttgatcaattttctttctgtgggtttgaggagtctgacagaaaacccatttccgctctcttggcgtagatggggtgtgggatgggaggtgagggagtggttctttaaaggtagtggtttgtcaggctgaattccattatagatggatatctaaatctcaaaaatatatatttaaccaatctagaaaaacaaatcttgttgttttgattgtgtcaaacaatcaaaagacagattgttttctacacagatatggtaaacttcatagaaaagagccagcacttcctgatctattgcttcagttgtataaagtgcacgtttataaaacctataaaactacataaaataattcttttattttcttactctgttgcccaggctggagtgcagtggtgcgatctctgctcactgcaatgctccgccttctgggttcaagtgattttcatgtctcagcctccggagtagctgggactacagacaggcacaaccacacctggctaaattttttctgttttcagtagaggcagggtctcaccatgttggccaggctggtctcaaacaaatagttcttaagataagggcagagaaccagatgaatgtgcttggcacttaccctgagggtgatggaccgagggggcttctgtgggggatcgtcgtgcagcctgtctcccagagatgccaaaatacgtttcctgtggccaatcaaattgatttttaaaacctgaaacaacatatatttgggttaaatatttcactggagaacaaataatttttatatgtcctaaaacatgtggggtgaaaaaagatttgtgcaaagttactcctgcaccatgagatgtggtgtcacttcagtgtgaccgctgaagtccagaaagattgcagtagcatctggaaagcctggagtggctaagtatcaggggcacaaagagaagggaggatggttctccttccactcatgctgcctgagagcctcattcccaatgcagcagcctcaagagaaaccagctcttcttataagcagccgaaacctcacaggataaaatctgagtctggactcaggcttcagagggacaggctgccctctgtctctttccctccatccaggatatgcagtcatgccagcctcctctaggtattagaagctccacattcattctcaccttggggcctctacccctgctcaaccacctgcctggaatgccccctctcccctctgagattttcaaataaccagtgacttctcatggttctggacactgtgctgctgatgtctcctcagaaaggtcctcccccgcctccttattgaagaagccatgccctcaacccctgacatgctctccacgatgatccatcctcattttatcacactctaaaagcactttctttacaagcttagtgtttgtgttttgttccaccctctccaggtaagctccctgagagcagggcactggcatatgtagagcactattatttcccaaaagcataaaaggatgactaaaaaaaaataagggattaatgaatatgaaagaatgaatggtaatagagatgggagttgcaaaattagagtcatcttgcataaggatacagttagaatgaaggactgcctattggggtagactcagagcctccccaggatggtattttgaatctgaccatgctgcaaagggcacatggtagaagagctctcaaagggaactgagaattgcagcgcctcaatcctcagccccattcccggtgctttaccagggccacacccctttcaatcttcccaacttctctatctggaaggagttctcacttgacagatgaagaaactgtggttccgagtggttaagtcacctacccaagagccagcatgtcgtggctctgggatttgaatcagatttgcctgattccaaagcatgttttactccaaagtatacgtcacaaaatttgggcatttctccaaatgttaccagcttcttaaaaacacattgtatattcatccattcataaaaatgtgtttacctcttccctacctatgtgtagtcccaggatataataatcttgttgggtaactagtttccaaagtcgttatcccatgtgtacatttttctcttctcttttcaagttttaagatagaaggtggggagagcgtttctttggcaggcatcccatgataccttgaattttttttaaatttcaacttttaatttagatgtaggtggtatatgtgcaggtttgttacatgaatacactgagtgatgctgaggtctgggatatgaatgatcccgtcaccaggtagtatgcatagtacccaataggtagtttctcagcccttcttcccttcctccctcccctcctttgtcgtccccagtgttcactgttgccatcgttatgcccatgagtactcaacgtttagctcccacttataagtgagaacatgcaatatttggttttctgtttctgcgttaattaacttaagggtaatggccttcagctgcatccatgctgctgcaaaggacatgatttcattcttttttatgtctgtgtagtatttcatctaccttgactttttatttgcctatttgttggttaacttacgggccttttggcctaaactgatgtagattttaaactcacactacgccctattcctttgacagccaccctctgacccatgtctgttgatgatgaggagggtaaatgttagccaaggtgaatgtccccatgcaccatatccctatgattttataaaaccttcatctccccaggctgattaatcctaatctttgcaagtttgttttcataaagcagctcctcttttccataaatcatttcagttgacatcctcaggactttctcctaccctattatagctgcttaaggtttgctgaaaaaatggctcacaatattccaggtgtaagtgaaccatggctttacatttatgcaggatactgttttctgcttttaatacccgtttaaaatgtccttcctaagcacacgtgatttctagctagccttttagctgcagtaggaataaccagggacaaaagtatacactgactataaaatcccttaattttgttatagctaatagttcaaagccctttaatctaggagggatgatttgagttatttttccctaaatttcttatcttacagttgtccaggcagaagcccatctgccatccttctgcccactcacacagccctatgttagctttttgcatttatattaaccagtttggcatttcactacctggaagagcttagtgatttttgcatatctggaaatttcactatgtattcctttcagatgatttataaatatgctaactaagtgtggccctactgctgattacttgcaggcagcattgtttatacgatccatagaaatgcccttatattcttgtattgtttctgtttttaagcatcaagaccaaataattcctccatctcagaaaaaatatgataaccttttcaaaggtattttgcaagtctaaatacagcatattttctaattctcttttattctcatcctcaattcctttgccaaaggcttctattggatataaattcctcccataaaatcttcaccgcctttctcccagcaggtagctggacctcatgctgatggtactaccttgccccctccctgagtcctgctagaaatgttttttataataaagacatttgcttaattattattattattattattattattatttacaaaactgacactaaataacacataactgtggtacaattgagctgatgtaatccccactattgcttttggtttactctcccacaactcaattttgggcaggttacctgactcctctgatctcaggttttctcacatataaagtgaagaagttaatgacaatttcaaatgtggttgggaagatgaagagtaagttgtgagaataaccagcatagtgcctgacacatagaagaagcaactttcacagtgtgcttattccagtgaatgggttctgagggtgcacaggaatcctggcccagaagaacaaggacttgttcattgtcataaagtcaatcatgttaaacaaatacactggagctttggatgaagagatgtggctaaccttgggaaagccctcaatgaagtaacttatcctagtaggaacatggctgatttctagctattagtctgaggccagacccaatttaaaagaatatgctcttctgccatccacatcgcttaatcttcaataggaggtaagctgaggcactcctctgcactgaagcttcattgctgtctcctccatagagctacccagatgagggtggacggatgaatgaatggattgatggatagatgatagatgatagacagatagacaggaaacgaattaacacaggatggttagtactatcaagatcacctggataactctcctttttatcagaaatgagcccccatcactgaagatactgatggtaacttccatttactgaacattttctatactctagttctatgtcctagttgtgctagaaactaccaagtggttatacacaaatataaatatctcctgtaatccttacaatagcatacaataaaaccattctcattttagagatgcaaaatctgagattatgaaatgctaagtaacttgcccaaggtcacactgctaagaggtacatggctaggatgtgcacctgattcttaaccagcccttcactactctccttgctcttcttcttgctgttaacctctataccttttgacctttagctacactattggttatgtcatcatgaggcttcttaagatgttgcttcttactttgagttatcatgtttaaagcatttatatagggttttgagcatctgaaaacattaaaataattcactttttagtaaggcttatagcattgttaaagctacaggctacaagggcaggtacctcacagtattccctgtgaaatacacatatagaccaaggacaggaaaccctcatcacccaagattcaatccgagctggctcactgtggagtggtagagagggtgacagtgggcttcaaaacgcccaagttgacagtaagaaatccaattggcaaaacaataacagagagaatattccaaagaaagatggtcattatggaaaagtcaagtctgaaggtggctgggtttgccttgagtgagaaaggctttatagcagactgtctttgcaagcagatggggttcctgagtagtggaatcctacaaccccaggcatcatgggtgataaccagtgtgaaaactttagttttcaagaacaccaaagcaatggttactgcagtagagaagaattctgtgttttcgttactgtttgggttaaagttaactgttcagacaagaacataatgggagtaaaagacaaaataatggtaatatattggagattcagttattctaagatgttgaagcaattcagttcggctcaaaaaacaatactgaatttctgctaccaattatttggaggattcaaaggggaacgtctatgaacagagcttacaatattggagagatcaggcacaaataactacattatcacaccattaactaagaaaaattattatacacataagcataagaatgtggctccaactgctgagttccaatagataagaaataaaagttggccaggcgcagtggctcatgcctgtaatcccagcactttgggaggctgagatgggtggatcacgaggtcaggagatcgagaccatcctggctaacacagtgaaaccccgtctctattaaaaatacaaaaaaaaaaaattagccaggcatggtggcgcacgcctgtagtcccagctactcgggaggccgaggcaggagaatcacttgaacccgggaggtggaagttgcagtgagccgagattacgccactgcactccagcctgggcgatggagcaagactctgtctcagaaaaaaaaaaaaaagaaaaagaaaaggaaataaaagttatggcatgtgttcttaatggtttttattacaactattgtaagaggaatgtgggtcaaaggcaaggagtattgttgaaaccacaggagtcagccacaggtgggtatccattcatcacagcagtagccgcctccaggaattttctccagtatcacttaaacaggataattccggaaaccccactgtgaatctcagcaacaggagaataatcatgctggatgacaatcctataatatcacgtcactgctgtttatgtttctgggtttggctgtgggaattctgccagacagtatcatgatatacccttacatggaatagcttacttcagaatatatgtcatagcaaagctgaaagtcaatgtacttaaacttccttttttcttttaaaatttaatgtgatataaaattaaacatgtttaaatttatatcacattaaatttaacatgtttaatttaaacatgatgtaaatgaagcatttttatctgcttttaaaaaagtaaataacattttgattataatagctatactgctttcccattttagacactttataaaatacagaaaaacaagtaagagaaccagtaatccacaaactatatctaaatagatatatttcatttctcccccatgattatgttttgtggtggtcatatcacgagtaccattttcgccttttcttcagttctttaaagctaaagaacttttctacatatacaactctcagtagacattttaactaactccatattatcacattattgtttcagagaagtatgtcataattcactaaacatttcccctatcattgaaaattttggtttgtgctcctttctggatagcaaacattccacatgcttaaataattctatcatcctacaatttccgttctcaatgccatgtttacatagacacagcatagaaaacaccaaagaagactgcaagaatcacacaagtcacgcagaaaagtcatgtagcaacagtctgtctctatgttctgcatgaaatctcaatccgtttattgccggctggaccaactcctgggaaaatcacaaacccacataatgttcctcagtgccatattttgcattttgttatgtttttggagttcagatttagctgacagatgtgaaacagcacatgtagctggaattcttcagagagtacacatgcagcgatgctgggcacacaagcgattctagttctcaccaccaggcgactgcatcctttttatttctagattgttattgagggagggagttcatcctgcatttggaactcccttccattttagggggtagattatttcccctttcctttctagatacttggccaactaaagagaacagctcctatgcaagtctgtagagctcacctggcttcagagtagcctcttctaataaaactgcaagtgttctgagcagttctggtgttcctaaatgccaagaatggaagttgcggtggaaactgatctgctttgttctcatctgcagaactaaaattgcaaataattgtcaaagttttcccccctgcctgataacaatttctaaacactttccacctgaaagcatcaaggcaaaagtgcctgtgtaaaattccatttcgaattcctgcaatcttagaaatcctcacttgaacttgcatacagttttgaccatgacatttttctctcttatttcttgaactgcaataatccatgtccagcatgggatggtgaacagaaagacctcaggagcagaaagtcatgacatttggttcttctcttactcttcttctagctaagtaatctttaatgtctttgagttgtaatataaaggggacaataacagtcttattcaacaaatatttcttggatgcctttcacatataaccaccatgttatgcaatttgtgagccacaaagaagaaaaaatatcgagtcctccagggctctcaatccaggcagtaaaaaaatattaaaaccatgtgaacgtatgtgtgtgtatatttgtgtgtatgtatgtaggcatctatgtatgtatgtatgtatctatctttctatcatccatccatccatctaaatatatacgtctacacagccttcccagcctaaaaggggtttctgtggaatgaatgagaatgactaggaagcttatctggaaattataaagcacagaactaaggtactaactaaggtattatttctcttttaagtataacagaaacttaaaactttcttaccctatcaacaatatttagatattacctttgatatttaaatgtgccattatggatatctctgggtagattttagatccagaatcatgccttccacttctccaatcttctctcctgttatttctttgctccatgtatacacacttgtgcatattccagagtgtctctgcctggattttcattagaatctcacaaggatgaaatcgagatccacctaaagccttgcttgctcaccttggattacatagacctttctctctttgaatttctttagtatctgtggtctaccctgtgctgttgacacatgatacatcctggtgggtatagctaactctcttttttttgcgtatgtgtcttacctgatcaactagactctaggcgctgaaaagtcagatatagtgtcactgcatctcagggtccctgaatgcatctagctcacgaatacaactcaaaggtgatctctaagatctcaactcaaacccctgtcaaggtggacaacaaatgaagcaggggagatgtctctaaaagaaaaagagggaaggaaaataacacctatgtcttatttcattccgtttctactctcaagagtcttctattctttctgagctttggcaccttaattcctacacacagtcttgccacgggtgatgcaaaacttccttacatcccaccatctgtaactctttccctttacctctgccacttcatctaaaaaaaatccctctgactacagtttccaaattcccttttccttctgctattactttccaaaccaactgctactaaataatcagcaaataactgtttgacagatgccaccgaaatacaactgtactaacctatggaaaggaaaagaggttccaagttatacagctccagagagagcaaaggatagtgagaaagagcgagggaggaggaatgcgtgttttctgaatgtagtctgtctcattaaataggaaatactaattatgaggaaatgagatcatctttgcatggaaagagagaccttaatggtataattgcctctgaacatttaagggctctggaggtacaaagccttcttttgtaatcaatgagaatcttaggtttatttgtaaagctctctgaattacctcttgatgaaggtactaattttctgattttcatgtaaacattgcttcagaagattaaaaacacacacaaaacaaaacaataaatcagttcccaactaatttccctgaaagttacttttaagtaaagcttgctgccagttaagtttttataggagaaatttggtttacattgctcaataacccaatcattggggttattgaaggaaaaatttgttacaaaagaaaatgggaagtatgtgcaacatcccagatctgaagttattcttggagatgtgaagatgtgctaatagcatctgaaaagtgcaaatctccctgcagtactatgaatacataaaaatgctctgcatcttaagaagtagagagactgctgttttgctatattttgctaaccatgcaggatatttactgctaacgagggtattttctaactttatttcctttcaatttttgagatcataaaatttatgatcaattatattgtgtgactgatgctctcagtattgtaaaggaaattatggttaccgaaattcattaacatatatccatataaaataaacagaaacacgcaacatacatgaacacacccatatttgtaaaagaagctctaagacaaattgagtctcaagagacaatcctaggtaagtgagggcctggttactccgtttttggattataagtggtcttttctgctctgttgctgctctgcccctcttcttgaggtttagctactttaatggcatataacaccctccatcagcagacagaatagtgaaagaggcagtgaattcaatccagccaattctgtttctgtcagcagctctgataaaagggttttatgtgggaggaggtaaaaaatctacctaaaactagctaaactaaagttttaaaaatgcatccacagattttacttagcctagccagctactactgcactttagaattggacatttaccatatttcagctacgtatggaggcaaaaaggatgttaaggttaaaagaaagtattataaggaaagcagaggttgagtcccaaggatgagttcaaaaagaggaaaaaaaaaggggtaacaacagtgagagagatttcttatcgtcccttttctccctttgtccccacccccaccactatccccttccttatcttctggagagtcacatcacagagtagagctaggaatcaccctaaacccataagaatggctaatgttagaaaagaatgaccctacctcggatgataaggatgtggaggaactggaactctcatcttgctggtaggattgtaaatggcacagtcacttttgaggaaactgccagtttctcaaattttgacccagttttctaacatataacccagcaagttgactctagctagcaactcctagctaaaaatgaatacatatgcccacataaagatgtgtacatgaatgtttaagcaacattattcataatagctaaaaattagcaataatccaaatgtccgatcaactggtgaatggataagtaaaatacagtatattcatgcaacaaaatactgcctaatgatacaaaggaatgggctacatgatacaggctatagcatcaacagacctcaaaaacattatgctaagtgaaagaagctgcacacacaagatgatagaatattgtaggattccatttacatgagtttctagacagcataaaactatatgtacagaaaacatatcagtggttatctggagtaggaataggagcagggattgactgcaatgagcataaaggaactttttagggttatggaaatgttctaaaatgggattgtgttgatggttggatagctgtataggtttactgaaatttacccaactgtatacataaaatgggcgattttcatgatgtgtaattaaattgcaatgaagttgtttttgaaaaaagaataatgctgggagaatgcattcagtatgcagtatcgtataaataaggccattcctgaaggctgtaatccaggctgctcgagaagacctctgttgtcttggaatataccacttatcagctggatggaagggtgagcaacatatacactgcaggatgtcttaaggaaaatgtgacctgcagggtagctttgttctaggagcctagtactatttaactataggctaatagatcagtagcatattctttattataagtgcacaatacagtaaattagtacgactttcctatgtatgtatatttttgagggtcttaatcctccaagtcataacacttcagtaaaaatgtttatgctttctaagtacttacaacaaatggcttatggatgtttgcggagtgatcactaggagccaacatgggttctctctggatgggtaacaggtggtgatcatgagatgacactcaagaaccagagaataaggttgcattctaagcaccaaattaatcacatcaacagtgctatgatttgagttttctctgacaaaaactcagctttaaattggatctccaatgtggcagtgttggcagatggggcctaatgggagatatctgggtcatgaggtggcgaatcctccttgaaataacttatgccattctctcaggagtgagtgagttcttgccctggcaagactggattagttgtcacagggatgaattagttcctgcaagagtgggttgttaagaagccaggacatcctgtgggttttgcctcttcacacgtcagcttcccctttaacctttcaccatgttgtgatacaacaccagaaattctcaccagaagctgagcaggtgctggcaccatgcttcttgaacttcctagcctgcagaaccatgaactaaataaaccttttcttctttataaatcacccagtctcagatgttctgttatagcaacacaaaacagactaggacaaacaaagcgactggagtcagaatgactttctagcccatgaagagtcaatgaaatagactggcagtgtgactacagtttaatcggtgatactgaaacccagctaaataaagaaggtgtgccagggtggggtggagaagcaagggtagagggcatattgaagcagtgaaactatctagctttggcagcagcatggggagacactgaatcttaacataagtaagctccctgattactcaaggggttattttatcaggttttgtactgatctaaatgaaacatccctcaaaattccctttccttcaataccacatgtaccaggaagcagtaattgctgaatcagttttctgagtgcccagatatgagaagaggaaatgttgaagacgggggatcagggaggggagcatttggtcagagaatccttcccatcatgtattaacagaatggacatcttgatacattgatctctccttaattaaattaaatccacaccaccgaggcacagaacctgctcaggagggcatagtgattaagagcagggcttggtgtcaggatgacctgagtgtgagtgttggtactggcatttactctatatgccttttggtcaattacttaacgtctctcagtatcacctaacttgtgtaaaatgatggagctaagaaacagtattcgcctcttagtgtaattgttaggattaaatgagacatatgcaatgcatttagcacagtgcctggtataaaatgagcttcataaaattctaacttcattcagtgttttgattaagcccagtttctgaaatggaagggctgagccctcccctggaaccccaccagaaggagctcagcagccagccatgcaccttttccctggcaacaatccctgcatcatcagccactcttcaaactttggtggcctcattgaaaatcagtttttgccaaactttattgactttctttttttgacaggtattagtatgaggttgacagaccaggagaatgtcatagatatagtgtctttgattccaataaagcacttgatgaagtctttcattatctgcaagatggtgggctctatgagggaaaaattaagtggattcacagctggttgtacatctatagccaagaggcttgatgaatggctctgtcataacctgttgggggaccactgattgaatgccacaggctctgcccctggattctgctctattcaatatttttattaatggcatcaaaatagacataagaagaatacttatcagatttttcaatgacataaaactgtgaaaaatatttaatataataataggctaatgtaaaattcaacattctctcaacgggctgaaaaggccaagctgacaccaaaaagatgcaatttaacagggataaatataatgtcttacattaaggatccaaaagaaatcaattgttcaagttcaagatgggaaagatatggctgtgccacagttcaaagaaatagctgaatttttagttaaacgtaggaaggggtttagcagaaagaatgcaaaagtatgggtctaatggggagggaatgaacccatttagaataattttaccaaataaataatctcatttaccttgctattacaacctaacaaggctggtaattaccttaactttagaaatgaattaactgaggttcaggaatttaaggaacttgtcaaagtgatgacaaaatcaggatttgaatccagttccgacttccaaaatttgtgcactttggattcattctatcttgctgccacttctctcccagagatgctgtgtggctcaagtgagacaattttaatggacgtacctagcacagtgcctggctcctaccttctgctcaaaagtggctgattatttttctcccagagactcattaaatgtaaggctgggtgcttatatgaacaaccagtactttattattataatatgaactctgcagtctattctaagtcttttcaagtttatccattaatatacctagtgcagaaatgattctgttgatttttattctctcattcaccattatttccaaatccttaatgccagaagaggaagtccagcctggaaaaggcactggaaaatttgagggcaatctaaaaatctctgtcagtcagtaatgattcccagataattaaaacttttttttttttttaattaaggtaactttcaagggctgcattagtggttcaatgctgcgtattaacatgacaaaaacctctattacctttagataatgaggtggtgtgttaagtaaccttagtacaatgatatgcatacagaatgtacaaaattttcaattaattcaattatttaattagtttagcttatggttaaaaagatacttttttttctgttgttggaggtcttattagaattcttcatatatatatatatacacacacacacacacacacacacacatatatgtacacatacacacatatatatatatgtatattttgttctttcctgcctaagggtggtttattgacagtctttaattcttccctagatatctggaatactgcattgcatctgagtcatgctctgtgtagactatttgtcactgggccacagtgctgctgcaaaaggtggctgaggaatgcacactggctccagcagtatcctgtaagatttagctcttttaaataaaggaattcttaggagcagttagttttcattgcctcttgcactaaaagcaaggcctgacaacattagctatccaaaagttccagttaatgaaggtttcattgtaaaaaagaatccatttgggggaaggtgcaaactctttgtaattttctctccctctttctcttggcctaggccagccatggttcacaaagctggagaatggagaatcattagctgctgatggtgctggtcatcccaccctggcaaggaaaggaacaggtatgttgagtgaccaggttgacctgtgcagtggatgagccgaaaacctcttttgtaagctgttttgtaaagatatggagacaactgatgattctggaggtggaggatgctttgagggccagaacacacactctgcaataaagcaggtcacttccttcaggttttaagctaaaatgtgaacacatcagtggactttcacataagctgtgctttctttctggaatgtctccttttcctcttctccatctagtgaacctctactcatcttctactctttcgagttaaatactacttttgaacaaataatagcaaaagaacaattaacggcaacagaactttggaatgacagttatcaaactagtcctgatccataaacaaaagtctacttagcacattgtgtgaaaaaatgaagtctctttgtttttattttcttaaaccactttattccagtatgactgacatgtaaaaggttgtacgtatttaatgcatacaacttgatcaatttagggataagtacatacacatcaaaccatcaccaccatcaagactataagcatacccatcagctcccaaattttcctccagctcctttcattattattatcatcatttttgtgtgtgtggtaagaatacttaacataagatctcctcttctggcaaattttaaatacacaatacactattgttagttactggaactatgctacagtagatctctagagcttatttctcttgcataagtaaaattttctatttaaccatcacctttccatttctgcccccagcccctggtaaccaccattctactgcctgcttttacgggtttagctatattagattccacattgaagtgagatcatatagtatttgctttctgtgcctggcttatttcacttagcataatgtccttcaggttcatccatattgttgcaaatggcaggatttccttctttttcatggccaaataatattccatggtatgtatacactacattttctttattcatctaatgatggaaatacagattgattccttgtcttaggacattgtgactaatgctgcaatgaacacgggagtgcaggtatctcctcaagatcttaattttttttcttcttttgagatggagtcttgctctgtcacccaggctggagtgcagtggagagatcttggctcactgcaacttctgcctcccgggttcaaacgattctcctgcttcagccttctgagcagctgggattacaggcatgcgccaccatgcctggctaattttcgtatttttagtagagagggggttttgtcatgttggtcaggctggtctcaaactcctgaccttaggtgatttgcccgcctcagcctctcaaactgctgggattacaggcttgagccactgcgcctggccaagatcctaatttaaatttgtttggataaatatccagaaacagaactgaagaatcatatggtgggtcaatttttaatacatgtttattttgtatcaggttgcaaatttgttgatcaaaattatgagttcaagatgaaaaagtgaaaagtagagcaatgctttctaagaaatagatactgaatcatcaaatggaaaagtaatatccccacttgctaatttaattcatcataatttacaagtctctaatgaaaaccaagcaacaaacaatgacttagtatttgttagaaaacagtttaatctccagttgtcactgaactcattagcaacatatgtcattcacacacagtgaggaattattaatttttcatttcaagaaaattgtcaaattaagctggatagaataacaacatacaataaaaaaattggtaatttattcttatattgccctagaatgatgatagtgtgtggcatgtcattaattaataaacataatattattcacatagtgggcccttgatatccatgaaatgtgtaattaatgatgaaaatgctatagtgttactatcacacttactgatcacatcgaagttttttccacccacacttaaattaaatctccctgaaatccctggttcaaatttcatgagattcaagtaatttgtgatttttttttttttttttgatgcggagtctcgctctgtcgcccaggctggagtacagtggcatgatctcagctcactgcaacctcctcctcccaggttcaagcaattctcctacctcagtctccagagtagctggaattataggtgcatgccaccatacctggattaatttctgtgtatgtgtggtttttttttttttgagacggagtctcgctctgttgcccaggctggagtgcaatggcgtgatcttggctcactgtgacctccgcctcccagatttaaacgattctcctgcctcagcctcccaagtagctgggattataggcgcctgccaccacccctggctaatttttgtatttttagtagagatggggtttcaccatgttggccaggctggtctcaaactcctgacctcaagtgatctgctcacctcggcctccccaaatgctgggattacaggcatgagccactgcgcctggcctgatttgcgatttttcatgaagaattttttaaaggccaaagttcatcctcaagataagaaaaatgattgtttgccatagaattcttctaatctcaacttttaaaagaatttattaacatttcaggtcaaatgcctcaaatgttgaaatctcatattttaattctttgagatgaagtgttttccccagcatttcttttttttttttatttagatttagtcttaactcgcatcaaggtttataaaaaatgatatttctatttcatgagcatggacagaatgtgttgaagcctccctgcaggaaaattatgagcagaggtaaaaatccttgcagcattcttagctccttagctgtagtgtctcttagagaaatgttgcatataaggaatgctaattaaggaggctgggagaaaagagatgccacctttccaaacacaacatttcaaaaacaagtattactaacatggtggttttatgaagcacttgaatcttacataagtatggcttgttttttgtttcctaaaaaaagactgcatttgagcaaaccaaaacccgagtaatttaaatcatgaatttcagagaaaaaagttttgcatctagctaggaacttaataaaatataagttttcaaatactttttttttctattttaaaatcaggtacactgctatttgcaaaatctctagtcaagtagaagcagaaaaagaccgtcttaattttaaaagagtaaccctgctcccatttatgaggatttttgcagggagaaagattttataagatattcacttcaatacaaaagggcttaaattcaagagtatttaaactttgaatttcaacttatcccttggaatggcctcatggctaatttcttgtctatatacaaggtcaaatagatgtatgtctttggttaatttggactgactgccaagcaatttattaggaagctggaggatctaaattgatcatgaagacaacagaataaatgggctttgtctgattacttccgtttacctgatgattaaatcctgcctgcagaaaatttatgtgacttccaaataacacagagacagacagacaaccccatgacacactatttaaaactcttatcttcattaaatgaaaaaaaatcaatttcaaaagtaccttttgttctttatgtctttgttaaattacgtctgaggaagtaaaagagcttcttgttgccgtacttcctggtctattgtcatatatcccacaattggagactttttgcaagatgggtaatttggatatcaaatatgagaaattataagtgcctttagcagatactgcttttccaagagttcagtgtgatcttggataaaaatttgggcagatggcttcctttggaggcttatacattgttttccacaaaatgtagttgatggagaccagagaagcattgcattttttttttttttttttttttttttgagacggagtctcactctgtcgcccaggccagagtgcagtggcgtgatctcggctcactgcaacctctgcctcctgggttcacgccattctcctgcctcagccttctgagtagctgggactactggcacacgccgccacgctcagctaattttttgtatttttagtagaggcagggtttcactgtgttagccaggatggtctcgatctcctgacctcgtgatccgcccgcctcagcctcccgaagtgctgggattacaggcgtgagccaccgcacccggcccagagaggcaatttttaagatggaaaaaaaaaaaaagattctctccaactctctttgcccagcctgccaatgctcccattttcacagcacccaggccagccaagacctaaccttatgcagaaaaaggaacaatgctttaactaggcacagagttctattacttttgctacctaatatgcaaaacactaaaggaagagggcttattaaagaaccgcagcatgttttgtaaaagttggtcactgagtctttgacagaactgctacagtactacagttctaagttcctactggcagcttctattttgagagtcatgccttgatgggagctacaaacaatgcagcccacagtagtacacattcatccatccattcattccttcagcaaatacacattgagggtggaatgtgatggctgatgttaagttggttaggagcacacaaaaatgcacaggacatacttattgctttgagaagctctgggcctagtggggaagatgaagtgacagatgctcttagggagtaggttcagagtggtgtgaaaagtagggagtggcaatctctacctggggagctggggatggcctcacggaatagaagacaggcttcagggctgagaaggagatttccaagtaaagagctataggaaggcgattctacacagaggagacaccgtgtgcagtctcagacgtgtgcaaggacacaacaggacatgtctgtttatggtttcaaaattttacttagttccctattaattttgctaagggggaaccatatgtgtgagtagcaggactgggggatatgaaggtgggtcagagccagattgttaagagccttcaaaaggaatttggtcttcaacttaaacaaattagaaaatacgtgtaaagtgcttggaaagatgtccagcatatagtgtatactcggtaaatacaagctgtttctgttatgttgaagtagacaggaaaccaaccaaggttttaaagaagggaaaggatgctcatgactataatcccagcactttgggaggctgaggtgggtggatcacgaggtcaagagatcgagagcatcctggccaacccagtgaaaccccatctctactaaaaatacaaaaattagctgggcatggtggtgcacgcctgtagtcccacctacccaggaggctgaagcagcagaattgcttgaacccaggaggtggaggttgcagtgagccaagattgtgccattgcactccagcctggtgacagagcgagactccatctcaaaaaaaaaaaaaaaaaaaaaaaaaaaaggagggaaaggatgatgatggcagagttggtttataacaataattctgatgccaatattgagaatgggctgcagtggggaggcactgtccacaggccaggaaagggaaataattcaaatagtgaggataaggctcagcaattagaacttgttcattactaaattcccagggtccaacatagtggctacttgcagtgggtgctcaatgaatagttgctgaatgaataaatgaatggcaatgggaggagggagcagatctgagaaatctctaggcggcagaaacagcagggttggtgagtaccagatgtaggcgttaaaggagagggaggtttttttaaggatgactctggaaattaggcttgggaagatggtgttgccaaattctgcaatcaagtagaaaggaggaagaacagggttggcagggaacatgaggctctgggagtactactttctatgcatctgctgggtttagcctcttggagtgttgagaaaaagtgggcaagggaggacaaagaaccctcacatgggcactgagctgggtgttttcctttttactgtgtttaatccccacggactatgagtttgatattgttatccctgtttacaggtggggaaactggggctcaagatgacacattagcgaggtggcagagcccacattaaaaacacgtatctttctgccacaaagcctgagctttttccccccctccatccatcaaattgcctcctccattaaaatgaacatttggaatatgatatattccatatttagaaggctcgggggtgcagggtgagtactttgcaaaggaaccaaagcctaacttctgttaactttctgcttcatcgatactccaaatctgtcttcctcattcacagagtccctatgaggatccaaaaagatgtgagaaatcttttgaaaaatataaagcgttctataaaaacaaggtgatatcaaaaatgagaagaaaaatatgttcagattcttgttaaggaattctagaacactgtaaaagatgacagaagctggatactgtcttaggaccatttgactggcaacagcctctttccaactatggttcagggagcaggttgaggtttttctgtctttaggggtcagtcttcctaaaatatgaaaacccgggtttgaggtatggggaaagaatgaattttgccttccaaaggcagagtttacaacttgacggctttcactcctctttcaaaaataaacctaaattcctatcagttgtctgcagagttccatcagggacttggtagagtggcccctaactggggagcaggaattatatgtgcttcctccttgttctgcaaagcctctgaacaccaccgagggcccatggagagcgtgatgatgtgtctcttggcccatcacaacgtaagcatgctgagcagaggctctatcccacatcctcactgtagccacagtgtccagcaggaaggggctcactgtatgtaactacaagaactttcggtgtttgcattcttccctttgctctttaaatggctggcttcttcttcccactcagttttcagcttaggtgccacgctgggagaggcctcctgtgactgccctagttaaatagatcccccctgctactctctatcactgcactctgtcatttttcatgtggttcctttcagaatttataatcacacatttgcttgtttggttatctgtgcctccctctcaaaccagactgtaggcttgagggcacaaagcatgtcaactctattcagcccagcatctagcatggggctggcatgtggtaggcattcagggtctaactgttgttttaatgaacaaacagacctaaacctgagatggtgggacaaccgacaggaaagcagaaggccccctcagcactcgggggctgttgttccataatcaggcttcattatgatctgggaccagggatggagccgtggattggctcacatgtggactgggcccacccctctggactcatcagcaagacatgcaaaccacatgagtcaatggtccacacacagccccaaaggagaagaacacaagtatcactattcctcaactttggagtaggttccttggtctcctagttaaatatgcatggcacataaaaataattgtgcagacagaaggactcacagttgcttaatgtagaccaggaaagtgtttgaaccattcagtgggtggtgcgactcctaggggaaaccagccacgggtgggaatagaaactactccaggaaatggtactgtatggaacaatttacatattttggggcatgggaagttttggaaatgcatttgttctcctccatatctaccactgaaataaatccttgagatttaaaatgagtagatgatatttagtaatatgactgaaaaatcacataggactcatttatgagccaggctttatgcgcaatttacaacctgtatggaaagcaacaccatcccctgttttacaaagaaggaaacaagttcagggaggttatgcaagtctgttagattttaacacttgcactcccttcaccatggagccaaagcctagacttaattgtttagaatatcattctaaattgctttttgcaatgtcatttcttatgcatttcttacacaccttttaggtgccaggaacgtatttctaaaggcaggatagcattgcagaaatgctagcctccaagagatggggtgtattttccattgagaagcagaattaggggaagggtagttttacctcctcagtgtcaactgaaatggcagtcattcaacatttcactcatttcccatcagacaattttaatctgaataaagtttttaaaaatctcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcctagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaatctcttaagaaaccatctccttacaaattcccttcttgcaaaatacttatttttcagtaaatatcttcgttgacaattctaacaaaggtactcaaattctatatcctggctatgcctgtcaagagagttgaaggaggcagtggccatatttagagggccaaaacctgttcttctggtggtatattttgctgatctgctgatcttgaaggactccagtgccttaaatttacccacatgtcatttattgctgcctaatgtgcttattcattattttttgaaaatagaagcatattcggaaacatatttaattttacgatgttaaaaatgatcacttctggttcttcaccagaactatatggagtacctggaatacagtaggtactcagtaagtacactattaataaatgaagaaaatatacgcaggataaaataaactgtttttcataattctatccatatatgatttttaggattgtactggcttaaaagctgggactatacaaatacatcatcaatgtgaaaagctgggaaaatgggaatgcgaaaatcaaactggctcttggccagtgattttttttaaaaaaacaaggtcttcaaatgtttgtaaactgcaaaatgtccttgttgtccttctccctttttttttactactggcattgtcatacaaactttgtgtctcttccaaattagtctgttgtttgggatccttaactacggagagtgtcaactgtgcgtctccaagacaaacaggttgatgcgctgtctttctcagacctatgctttaaagcccaggctagggtcatgctctgagactagagcattctgactttctctggtctgctcttttctggtccttgattttcttatctgaatcatggggtgtccattgtttagacggaaggttgcaaatataaattaaataattcctcagcaaacaatatctttctgtgaggtgcatatatcagtggctaggaaaatatctgaggcctgctacatcatggtttagtgaataatttgcattttatgatgtatatacagtgtagctatgaataatctgccagaaattatagctatacatatataagccatacactcactaatggtaacccattctccttatttttgaacccattctcggtaccagtaatagagagctcactggctttgatttgaggcagacctaggtttgaatcctagctctaatatgtacaggttgaatctcagggaaagaattcatctttctcagctttagtttcttcatctgtgaaatggagataataccaacttcataggcctattgaaggcatttaatgtgttgattatatgcatgaagactgatttgttaacaaacagatgatttcatgtgtgtgtgcatgagttgggtgcagccttaataagtgttccccttctcttctgttttgctatttaatgtgatggtgaggagagtggtcagtgtttgtctgtctcttccttctagaagttagggtggcataagatgaggatatgggggacagcagcctcagggagatactgaataacctctgggagcctaggaggacagatgcttgacactagctggggacaaaaaaggaagagcccaaacagtttttaaagcagaatcttctgtgtctagaagaatcaataggaaggtgcatcatcaaaagaactagagaacacaaatgacagggtatgacatgagtgttcactttcattaagtaaacactgctggggtttacttaatacctggtgagagggaaaaaaagcagtattactccacaaacatttgttaaaatatcaactatgtgagcaagccatacaatggagaggcaatgattcctaagacataacccctgcacacaatgattcctgacataacccctgcacacagtgagttcttagtcacaggggaagcacacacagacacaagagggctgtgattaatcctatatgaaaggacaacatgccatggagcacagaggaggaagtagttacttctaagaagaccaaagacattttcaaagaggtgaggatattttaagcgaggtcttagaggacgctgttcacagggaagaggagatgtaaaagcattctaggccaatgcacctgcatgagaggagtgggatacggtgtgagcaatgcttggagaattgcagctatttggatactgctgggacataatgacctcggcagccaggaattgtggttacattgcagggggccttgaggctagagagagagaactgattgagcttgaggagggagagtgggaagggacccagagcacagatggagttattggctttggagataaaaagggacacatgtttctctgagtaggtgagtctgggtgttacttggataagtctagagaagaagagacagtacgttctaacagaacatgccttgttaccttcatgctctcggtgtagtgggaggcaatgtcactggttgaataaatatgaataaatgaatgaatgaataaatgaatgaaggtggctagggtagaggattaagaagcattaaaatgaatatttcaagaactatttatgggggtcagtaaatataatatttctaaactcaaaacttctaaactcaaggtatttataagctagttgaagatgtaaagacatcatacatcttttcaaagcacaggaagttaaatgaatggttcctaaaatatgaatgttcagagggaaaagtacgtttattaactgcttgacaaagaagtatgtagctatattttgtgtaacacactatggtgtagtcttatctttttgggtatgtttttctttcttaatgttaaaatatttcatagctggtccatgtaactatagttatacttttagttttactcaggttcccgataatgtttgtcgcacagacaggtttgtgtactggttttaataattccattgtactttctacctcctcctccgcccccatccccagggtcttcaggtcacagttgggacctactctatgtactctggtgctctccataagcaaatgggatgatttctctgaaaagacagctctagattatagtcctgaaaaagagagctcttgagtcaatgaaaaaatcatagtttagagtagaagagaaaggtaagtatgttcagaggaaaagctggtcagatgaatgtaagagaggcttcttttatttgttcatttaattttgagacagtgtcttgctctgtcagccaggcttcagcgaagtgctgagatcatggctcactgttgccttgacctcctgggctcagccattctcccacctctgcctcccgagtagctaggaccacaggcccatgctaccatgcctggctgtttgtattttttgtagagatggggtttcgtcatgttgcccaggctggtcttgaattcctgggctcaagtgatccgctcgcctcagcttcccaaagtgttgggactacaggagtgagccaccatgcccagtctcaagaggaaattcttttagcagagctttgagagataggtatggaagaacaggctggggttagagtatatgttgctaaggaatctgaccctcactccatgggcaataaggagccatggagcagggatagaacacttctctggcactactggaagctgtgatgtccaatgtatgctctctggaagatctaactaaacacaaccttagcacttctctcaattttctttgaaaaggcaaatcttgtgagtcatttgttctctgtaaaatgagagaggaacatacattatcaccttatattatcgatttacattaagaagacttccggattctcttagggttgttgtgtctttctaagatttcaggcaggtgggtaaatccttattttcatggattttctattggctaaaggaacgctgtgtgtagtttgttggaatatactttgtagaagacattcttgcccttgtgaaccagtttgattcccgaatcacacaagtgctgggttccagaagagattttggatataacgccaggatttctgaccctacagctaagaataggcagcaataggaactcaagttacaaaaaatgacttcaatagagcattcacatatgtgatggtatcagagcccaagtcttcaaagagaaatattttgaaacttctccctggtttctggcaagagcagcaaatcttgatttttcaggcctttataaaaataagaaaagactaacaattttaaacctgggcattaatcaaccatttaatgatgccaacaaatgagttttactgtaattcagtgcggggagattaaaggaaacctaagagccacaaataagccattatgaacagtttacagtgattgagtacataagctgtgattaataatgatcagaagtaaatctatgaataacaacaaacagaaaggacttgttagattgagaattttatcagaaaggtataatttggatgttgactcagtggtaacaacaggaaaaataaattacctttatgcattttagtttatgaaaatcaaatagataatatatgaaacaacatttaaatcgatacagcccaggagatataaaagtataggtttgtgtggtcttctaattaactgacatttacacatttttcttaagatcactgtaagcaaaatgggaaagctctctaaatttttggccttttgggagggaggcttttcagtcttgctcatatttgagtcaatacactgatgtcttgacttgcgaaaaaattttcacatccctgttttgggctctcatattttctttattacacaggaaaaaaactttattgcacagacaaacagaagttaaattgaattgattttataagctgcaataagtacagctcccagaaacaaatgcaaatggaatgaacagttcttaccatatgtttcacataggctactcacgttttctctcgttccgagatgatttcaaaaaacctgttctgttaatgtatgtatgaaattctgcaatcttaaagatttaaaaacctatatgttttcaaagacctgaatatcctgatacacatcctttcacacctggatgccaaacacatacactgaaatatattctatgaacaaaggaatttgaaagggaccacaaatttcgcattgcatgctgaagctgtcctgtgtcagctcttcaaactggggcctctgaattttaggaaaaagtgctattattctggttcagtaagtttgaccctttgttgtctatctctgctccttagagacacaagcaggccttgtgcttactaagtgaatattaatatcttcattaaaccttgatagacaagcacactacagccctcatccaaaatatgcacaaaattagaaggcaaaaataaaaaaagagccagacattataagcccgtcaatggaagcagagagccacaccattaatggtggattgaaaaagactctgtgttgttcacctcccacgtataaatgagaacacacggtgtttggttttctgttactgtgttagtttgctgaggatactggtttccagctccatccatggacacagggaggggaacaacacacactggggcctgtcaggggtcagggggagggagagcatcaggataaacagctaatgcatgttgggcttaataactaggtgacaggttgacaggtgcagcaaaccaacatggcacacgtttacctatgtaacaaatctgcaagtccggtacgggtatcctggaacttaaactaaaattaaaaaaaagaaaaagacttcctcagttttttctctaatggcctgaagcaaaaattactctcatttcctcttcattgatataatttgtttttgagaggtgaggggacaatgggaagagagtggttttaagtcactataaaaagattattgacagatgcgtggtaaaatgaaagactcaaaaattcctgaccctttctcccctccagagttaggtaggcgggaaggaccccaaacttccatacaagagtctcttaaggtaaaattaagacagcttccccttcggagtttatgctagtatttcataattttccagccaagagctggaaattatgaaatagttgcataaactctgttaatatagatggatcaggctccaatcttgattttgccatttctcatatcatttttctagggctgagggggcgcacttcttggagtccagtttctgatataaagagaaaagccatttagtgtcttggaaaaaaacaaaagaaggaaggaagggtgttgttgatttaatagatcacccttattgttctaatggctccagatggctctcctactgtgtggatgagatttgacagtgccttcttggggagaaacagaagacttcactagcttcgctcagcaaatgaccactgattgcctggaatggaggagttaatgtgatcaattaacaatgtttgaagaaaaatgatgtttgccagctgttgatttcatcagcaagaaaaagcccacaataatcatcttagaaaagaacttaattagttttgatcctaagatagcatgcaaaagttctggactaatttctagtctgaagatattcataacatattagagctggcatgaactctggtgattactagaaaaaaagatttttaagtttgtgaaaacagagatgtgctcaaggtcacccacagttaacagaaaaactggggctgaatcctggggcttctgagctctgatatgctgctttttcccaccacaaatcacagtttttgagattcacactttgaaaagaatgatccaaagtaacactgccattttggggtgagtgttctcttatgacagatgagtttttttttaccttcctgtttccatatgtttaaaatgctattagtatttcaaacctcattttctttctttttaaaaattcagccatgattttagagtgacagatttgccatatcaatttctaaaggtaagtgtttgggtcagtttgctttttctctaaattgtgtttgtcatccctcagtgtagtaagattttggtgtggttatgctgacattaaagtttccttttcttaaaataaaactaatgacttgaccttgatattgtataagagtacaggccctagggtcagtcatcctgggttcagaacccagcctaccacttctcagccatgtattgcgggagagttatttatggttccctacatttcagttctctcatctataaaatgggaacagtaataatcccattctcaaagggttgtttgtgtgagaattaaatgagctgatctatgcaaagtacttacacagtgactggaacatagtgaacactcaatgtagctaacagttattattattattactagaaaaaaattgaaaaataattttatgtaattgttacttacatgagtagcggggtctcagcttcccaacacaccatgagaatatgaaatttcatcaataaattcaaatagacactttatgtaaaaccctttgctcaaataatgtaacttagcaatgactgacttttagatactggggaaatgcattcatatgaaccagtgcgacattctgaaaactggttcattgaatcccaataatataggttcttactctcaagtaggaatcaataatgcacatcccctctgtacccacatgccccataaaaaagctgttcaggacaatcttgctttatatattatacacattcagggcacatttagagttctgaaatttgaggtgcaaagtaagcattttgatagggatatttttccaaagaatgtttttggccccagcataaaatgaaaaatctctaccacagacagttgcatttcatggtccaatatagtctctgcatgaaaaccaacagatcattctacatgtctcctgacacatttacaacaggcactctgtgtaaaacccattcgcatcactgggggttctcaccaattcttaggcccttgacttatttgtgactgggatacctttatcacaaagacatgctttacagatattttcacggacacaagctattccagtcttgtcctgcataattaagtttttacattcagtaagtagagttcacctcttcctcctaatggtaagtgtttattaaccataatgactaataaagaggttctggcctccgtcacctgagaagaacaaaacagtggggtttttctgcagctcggctggatcccagcttctatgacctctgctgctaacaggctctccacaggcaatgaatgggagacgccagctatgcaaattagagtactgatgttccttgtcagctgcaaagcccaaatggccctgaaggtgacccaagtgaggcttctgtgctgtgtgcctggttaggtggagaccctgattagtctgattatggcaacaaattttttaattgctttatggggtgcatgaaaattatatgtttatctccttttattgaataaagtgtgttggttgtatatgttcaatgttggtagggaggaaggtattcttatatataaagagaaaatctgttactctttatgtcagatcagttgatagatattaaacaaatcatgttgttttctcatattgagtatagatcactaatgaccagctggaacagaagtaaacttgtacattagccagtaatgaacaaaatgctaaagatataactagagaaattctagaggtaaggaaatagtccacatatattaatacattttttcccacagtcatcttggtagaaagttgaccgtgatgtcgatgatataactgggtcagacaaataccttttaatagtctgtattacttacacacgcatacgtggcaacagatttaccttagacataaacacgagtttatattcctggaggtgtcctagaagcatgctgactgttgtgtcctcagtattattcacttcaataaccgtaagagctggcgttctctccaagactctgttccttgaaggaaggaactatctactgttcccctagtaagacctggcctacaataggtgtctgtgatgctttttttttttttcatttttaaatgtccattttgtttattgatacataatatttgtgcatacttatggtacgtgtgatattttgatacatgtatagaatttgtaacaatcaagtttagaatatccatcacctcaaacatttatcatttctctgtgttgagaacatttcaagtcttctcctctagctattttgaaatatacaatatactgttgttaactacacagtagtcaccctactgggctaagggatggttaatgtgtctactcagctagatcacagtgcccagatatgtgatcaaacattattccagatgtttctgtgaggatgtttttggatgagactgctgttcacactggtagattttgagtgaagtagattactcttcctaatgtgggtgggcctcatccaatcaggtgaaggcctgagtagaacaaaggactgacctcccgcaagcaggagggaactctgccagcaggcagcctttgggatcaaactgcagattctggacttgccagcctccataactgcatgggccaattccttaaaacatacctttctatgtatgtatacttacatcctagtggttctgtttctctggagaaccctaatactgtgtccagtaaaaatctgttgtctgatgaaggaaagataattgcctgcctctttccatcccttcaacactcaccctgactctcagaacacacgctgtttggcctcatcctaatctccattccctcagtttctctgttacatccctgccatttatcccatttatgatatccctccttccttaggcaggataaacttgaagatactgttttcatcttcagcatactacctcctttgtctttcctctgctcgccttgtaaatcttcaacatctaatcaaatcatgtgccttctctaacctcactgttgttttctgctggagagaagccctgccaccagccagtacatattcataatggttgactgtatgtggctgggccctcagaccgctcagaacaccttttcatggtccttagtcagcccctactctctaccaccccaaatctttcttgctattcctctggtctcccatttctatcttcagactctcgatcttattgcctgacaaatgtttcaagcagaactcatcaccttccccacttcttgttcctcttgcttagtccctgttgtgataaattatgtccctcccctccccattcatctgcccaagctggaagaaaatttggcatcatccatgcctcttctttcatcttcaattccatcacccatccagttatttaacaagcgttagctgagtggctattatgttcctggcattattctagagcttgggatataagagtggacaaagtaaaacaaaaacactcctgccctcatggagcttatattctagcaggggagaaggatcatgaacataagaataattaaatttacagagtatattagaaagtgaataaacgagacagggaaaaatagagcatgaaaagggtgataagaatcgacgtgtgtgttggtggggaggtggagtgtgcagtgttaaacatggtggtcaggatatgcttcaatgagaagatggcactggagccaagacttgaggtgagggagggactcacacagatatctggggacaaatcactttgggtcaaggcaatagctggtatagagggcctgtcttaatccatttgggctgctataacaaaatgccattggctgggtagcttcaaaacaacaaaaatttatttctcacagttctggaggctgggaagtccaagatcaagatgctggcagattcggtatctggtgagggcatgcttcctaatagatggccgtcttctcactgtaacctcacgtgcaagtgttagaaaagttgggggagcctgagggtgtctctaggttgttgttgttcttgttaaggtactaagcccctcccaaaggccccacctcctaataccatcactttaggagttaggatttcaatatataaattctggggagacacaaacgttcatatctaaagcaaggccctaaagagggcctttttgagcgaagtaggccctaaagcaagagtgtccctggcatgttgctcgagcagtcacagcacttctgcgaatcttcagttacagcactcctgtgaatctccaactgtccatctcactgctactacctcaatctaggctctgggccttctcacctaaattaatatactgatttcctaagtggttttcttatatctggtcttgctgcatgcccacctacttcccacaccgagctagaatgacctttcaaaaacacagatgtcacctcatcagaattcttccatggctccccactgcccacaggctgacatgtgcacattgggagggcttagccctctcccacctggctccagcccactgctgcaatatcacaatatcacctcgcccatccttgacgcttatccagaggtctgtacataagattctctaaatgcaccaagttccctctggacccttcacctttgggacactgcttcctcctcataaaacacctatctcttttgctacccattgcaaccctcctcgtgctagaaagcatggcctggtcagctcagtctcatttccctttccctatacaacattgcttcctgcagaaagttcctcctgcccttcctctctctggcttaggtaccctccactatgcttccacaagagtgtggctatctctactgcagcaatttcatactgtatcttcacagtctctttattttttgggctcccctagtaggttttgaatatgggcaaggatcatgctttttaaatatcccagcacttggagccttacttgatacataaggagatactacataagttttggtcaaatgaataaacaaatacacaaataagccccatgtggaaaggtgaggattatatagatgcataaatagggaaaaactatatgcagaaactgtacatagcttcctctaaaaaggaatttcttatggaagcagaatctgtaaccatgaggcagccacccagaggagtagagtaatgatttgtgctgctccagtgactatgggttaggatgagtttccaggtcaactggattactctgatccctctttagagccattgcaagaaatcacatctcaaggaaagactcttctggcacctaatctcttttgtactttagtccagacagtgcgaggccatcttcaaataaaacaatctctttggcttcacagacaagaaaaatgtaatctatttcctacacgtgacaacaagagaaaatctaaaatggcacaaaaatgtaatggtaatatcctacagagaggaaagagctgaatcaaaatgaaatatgaccaaatgcaatcagcagctaacagcaggaaaaaggcagctgtcatcttcatttctttcataaacttcttagaacaaattatgtcttttagaatgtaagtcagtttgtcgggcgcagtggctcacgcctgtagtcccagcactttgggaggctgaggcgggcagatcacgagatcaggagatcaagaccatcctggcttcatcctggtgaaaccccgtctctactaaaaatacagaaaattagtggggtgtggtggcgggcacctgtagtcccagctacttgggaggctgaggcaggagaatggtgtggacccgggaggaggagcttgcagtgagccgagatcgcaccactacgctccagcctggcaacagagcaagactccatctcaaaaaaaaaaaaaaagaatataagtcagttttctttctggatactacttcgtaaagcttctgccgtttatgggaggtaaagcattctctgcatcacccaacttcgaagctggcctgcatttgcttagacatttcattcatgaaagcctgccctctcttagcagaggagcgatctaaacaccacagtcccaaacacctccatctgactgtctcctctgtttgtctatcaaaccactgattaaaacacattctgcattgattgattaataaacaggtttcagcagctctggacactcagagtctagaaggagaaaagtctagactcaaatagataaaaacccgtaattcaaggcagaacacaccctgggcccgagggggctggaggagaggtgccaagtgtgggctgcgcatggaacgggaacactggtgttaggtgtgggctgcttggaacgtcccaggagtagcttgcctcatgttgcagactaggaatccagctgtctggaggtggaagaatccatggatggtgcatattgcagagacacggtttcaaaatcttttgcaggatgcacatgttagaaaagagatcttaaaaaataaaaaatcctctaatggctttaaatgagcatgaagcattcagatgttaatgtttagctgtgtagacaaggtgtttcccaagttatctcaaaggttgatgacatgacgaattgccccctttaaagaaaataccaaatacacgaacaacaaacttccccgaatgtgttgactatcttttggaatgaagagaaaatctgggtcgagttgaaatcaccaaaagtcaatccacaaagtggaatgacattgctaacacacttagcatgagacctgaccccatctgattattgctcagcaaatgggggctgtcctgattgattactatttgtccagtctctcaccagctgagctctttcctctgttcctaaaataaagggtagggtgggggactttgtgccagataactaatctttactcagtaccttttctgtttcaggcattctgttagcagcttgatgtactgttctcatctatctcctcaagagtcctttgagagatatattttataactgttttgtagaaaaaaaccacgaaggatctggagatgttaggtgtatccaagggcacaagatgattgggaaggagtgaagatatggatgccagagcctgaaaacactccatgtgtcccatggtagcttgttctttggccaagtagcccttgcacacccccgccttgtcttgagacatgtcaccaaagacactcaaaccataagctccatgaggaaggaattttttattttcaccattaattataccccagttccttccacagtgcttgatgcatgcttggtattcaatacatatttattaagaagtgaatagacccaaggcctgggatgaagtttctgtctccaccaccactttccacccattcaagagtgagctgctcccctacgaggactgggcacgagtcaaaacactcctgggaaggatgaagtcttttggggagttcaagaactcctgagtccggacaagacttgtgccaacctgggtgacaaaggaactgtgagaccctggatggagttacaacccgaagatatgcctgaggcctgtcattcagcacttaattcctttttctggtgaaaattaaagtaactaaaatcctggaaccctagaggcttccagaattgtaacaactgtcttcagtagccatcaatctaattacatttttgcaatattctcattttgagctacaaaggtacaaattacacaaaattgtgtgtggaatgcatacatatgtatgtgtgtgtatgtgtgtatatatatgtatatatataaacgttaacatttagatgttaatgtttagccatgtagacaaggtatttcccaaattatctcaaaggttaatgacataattgtcccctttaaaaaaatactgaaaacatgaaaaacaaacttccctgaatgtgagcctcactttgttctgtacaatggagataataaaaccttctgtttcacatgaagagtacatgatggaatatggcaaaatgtcctgaaaaccagaaagtagtcttgtcaatagccaagatctgcctgactttttcacttggggtgcagtagttaagagggaatgtgctggagcccagctctggcatggccactagcaggtttgggagagcctgtgcttcagttgctttacctgtaacagggagatggaaatgtacccagctcctggaattgtttgaaagattcaatgtgaattcaatgatataacacatctaaagcacttagaagagcccagcacatgaacaatgcttaaacaaatgtttgctgtgattattactgtgctttcgggatcactgtgcaaatgacgattctggtcagctatgcattcccagagcagtggaagggttcactagcagctatcttcagtaatacactgcagtgaggggtagtcagatccaggcccacaatccaataaaggtggttggtcccagaagttattttgccagataggcagaaatcaaattgaagagaagagctttggggagcatgtgttctttacttccttttcctccctccctcacccttttcttttctttgctatttaaataaaccaccactttcaggcctgcctgggagaagatattagggcagcagggagtccagctgggagatgatgaggaaagcagctgagcccctgctattccacctcatccactccatcctccccaattaactggtaacgaggtggtgacgccctaaccacatttcacttcctgctaacaaagcttgtacaacaaatgcaaacacttggctgtcagcttctgtccagcacacagcctcgttatccatctcacccttctgcatctatgtcagcatccaggaggcaggcccaggacgacaaaccttctttgtgctacactcaatgccgtaccaggctctgatggtgcttacaaaatgcctttgcccgacagtaacaagaaaggtcccttatagatgattttgtaagaggagacatattctgtgcaggcttgtgtcattcctctgattattcagactgggagtaggggcagggaaggtgccaccatttcatttcttcctttctcatctgataaaaatttcttcccacctctttgaattgaggtcaggtctttttcccttttctaaatttgcctcaaagaagtctttttcatttttccttaagaatgactttaatggtctacattttaacctcttcctcatgtaatgtaagtgatctgcaaactttcttatatcttattccttttgaatttcaaattcctttttttctaaatcaatcccattatggcaagacattattactttctgctcacataaatactatcatccataattttctctcttccctcataaagcatgatttatgttgatatttaaaagtaaattctgatatttagtctaagtactgtcttacatattaattcaataacataatttctacgatagaaaagtacataagagtacaaaatatgaaataagcttgatatagacatagttatctgcatttgaccagtgaggaaacaaaagctcagaaaaattagataccttgcacaaatcacaaagaaatcagtggttcagctgaaaattagaaccaacatcttctgatgattacacaacttttctggttgactaccaaagaagatactagaaaaattactaatgagtgaaaataaaaagacatttcaaagtctttcatatttaacacaaaattatttttccatagaagatattcaagaagcagttacacatttgaggagctgtttttttttaattaaaaaaaccatattctttatctacatctagataatgtagattgatgatccatctaaatcaagaatttatcttctacagtgggaacaaattactggaatttaagcaacgtgaaatctcatcactttagcaatgacaatgaatgtgatgtagctttcaatgcagtactgaaaaagcttgtacactgtcacatgtcccaggcccttaggaacaaagtttagtatgcaatgagtgacgagctctataatattttcattcgaaacagagctacacaggaaatctaggatgtttataataatatttggaatatttggtataaatgtaaaacattgtaatagttttctgggcagataagagctcatcatatatccttttagttaagtcaagtgactctggagtccagttataccattagttcaaacactaccaaagactaaatacaagctcttacaggctgaattgcatctccccaaattcatatgttgaagccctaattcccaatacctatgaatgagactgtagttgaagacagggctttaaaagagctaattaatggctgggcatggtagctcacgcttgtaagcccagcactttgggaggccgaggagggcagattgcttgaggtcaggagtttgagaccagcctgggcaatacagtgaaaccctgtctctactaaaaatacaaaaattagctgggcatggtggcgtgtgcctgtaatctcagctactcgggacgctaaggcaggagaatcacttgagtccacgagttggaggttgcagtgagctgagattgtgccgctgcactccagtctgggtaacagagctagaacctatctcaaaaaaataaaaaagagagctaattaagttaacatgggggcattagggtaagccctaatcccataaaactggtgtcctattgagattaaaacacagacattacagagggttgaccttgtgagggtaaagtgaaaagggggccatcgccaagctaaggagagaggtctcagaagagacaaccgtgctgataccttgatcagctgacaccttgctgataccttgatcagggttctggaggcaggacttccagcctccagaactgtgagacaataaattacttctgttttagtcactgtggtactttgttatggaagccctagcaaaactaatgcacttaacaaacttaacacctactttcttcctccagcctctgtgcctgtgtttcatgccaacttttagtttctccttgatctgccagtaatacaaagatgagaaggtctggaaggaggatttaggataagctgagaggatccatcttgtaagactatactttcctatgaaatgctgtttcctccttgttgcctggaaaactcatcctcaatcttctagacctacagttgggttattcttcttcagaaccttaatctcttcaaggtggtgcctctgctacaccctataaacccacctctggcacagcacatatcacaccatgttagaattgcttccattggcaactccttcctgatcttgtgaatgatttgtgctgctccagtcactattaggatgagtttccaggtcaacctcctgttttgaaaggagggacttacctttgtggtcatgtatttgacacctaagacttactcgttaagtgtttgttgaatgaatgaatgaaataaaatgatctccattcctattcaaataagcctgtaaataacagtttaagcatggtcatatttgtttgttgagaaagagaagtattaagtgatataaggtttaaaaaagcaataaaatctgcaaaaagaaaagtgtctattgatgaatttattaacaggaaagaaagtaatcgaggataagaagatggaaaaggtggaagaagagaccttgacaacctgaaaaggttatacccttgtgcagatgtggtggacaaatcctcacctgagaggaggaatcaaaggggcaactgctctgaaaccggccctagagcatccaacctaaaaacaatgccttcatcatgaagttccagaaccaatgattcaaaggataccccactgaaaaaagacagtcgtcgtcctagaggtaaaaatcactttacttgccaataaacagaaacatgagcaaatgggaaataagcaaaaatgaaatgatgtgtgtgctctcttccaaagggcagcaaaagcagctgagttaatgctaatggctcacatatggtgggtggggggaaaggatgttataagtcacaaaaccctggaatggagcagaggcctgtcggcaagttaggtggtgatgatggagtcaggatgacttggaaacactgtgaaaagatggcttcagataatgggccattatctgtctgcctcttttcactttgactactgtcctctataaataatgtagctggctaatctaaaacatacagaatcaataggaagccaaatatttaggtaccacaaaatgaggcaaaaaaagagcccagattttcaaacaatgcaagtgaccctgaaaattgtaacttggcaagtctgcaatattgtgagagcaataacaatctgttaacatctagagggaataaacccaaaagaaataagaagccgagctttatgaagggaaaaaaaaaatggcacgccaaatttgattgcttttctgatggaattacaggattactagtttaagggagtggagcagatgtgatatatttgaattttattagggcatttgggagaacgtctcacacaatttccttcacaaaactaagtgactttagcttgaacatgaactgaggagataataaatgaagggtaataatacgttacagtcaatctcatcgggaggaaggtgtttaagaggtgacactaaggctcctgttgtttggggtggatagaacattgattttaatgatctgtaaaaaaggaagaataagagtgacagagaggaaacatggagatttattggacaaaaagactaggaacctggttaaaaatacctgaatatagggaaaatgcaagctaacaaatatatctgtatgtttagaaaagtaaatatatttggaaaaatatttgcagaaatgcacacatgaaaggagaaaaatgagaaattaataacactgaaaagtacacaggagaagctccttgtaataaacttgaactgcaatacagatataaaataagagatcttaataacttatactgtcataacaatgacacacatagcttgccccaaagtaaattttaggttcaaaaagctaattttactcctctttgaattgtatcattataaattttaaccttcaagtttagcaataaaatgacttaaacagtttaaacaaaagtgtaacttcctataatgacagcagcatccatcgaaatactgtaccatctgtggactagaaactacccttcttcatcctagactttgccctcttattcatctccactgaatcacaaatcttagacaattctgcctccttgcctctctttgggacctatccttgctccttgttccatagatgctaatttggttccagccctcattctttcttaccagcattattaccagagcccagtattgcagtatcacatctgctctctgtgctgtcagaacaatctttctggaaagctgaccatgtaaattctccctgtttaaaaacctccagtggctccccatgccctataagacaggcctaggcatagtgttcaagcccttgaggatctggtcccttctgatctctttagctccttctctttccaactctctcctccctttccacactctggcctgaagcccttccagttctcggcagctctgttgtctgtttgcctgtctacccctccttgcttcctccttcaggatgccatgcagatgccatattttgaaggaagccttcctggtttctttctttccactcttgtttctttagtttgtttatcatgcaattttttctactctatctataaatggtgggaggcaggggctgttttaatcctctatgttgctagcctgggacacacagtaggcccgtatgtacatgctgaataaatggacccaaaccaccaatataatcagggactgtgtctactggtaaggcaggcctgggtttgtgataaaaagtgcattggttttgtgggcagcatagtggaggcagaaataacctctaaaaggactacagtgatgacacaactgacacactgctgtaacaagccagggggtaactggggtgtgcacctgttggccggtggctcttgaattcagtcttcctcattcatctggcctacaaaataccatagtttagatcagaccctgcaggaaccataacaaaaactgaaggacaggctggtctttaagtacaacttagcagagcatgacaaatgcagattgaaccaaagtgacccttcccacctacaaatatagtcatactacacctctgcttaaagtcccttcaatggcttcccattgctaggaggctgatgtctaacagcctcatgtctctcctcttcctcacactcactcatattacattaccactggttgccacaggcaccacatgtgggatgctcccatgccttcatccgtgctgtttcctgtaactgctggaagtgccctttaccctcaaccctttctcaggtttcctggtgaattcctgatcatccttgaagtcatctcaagtatgaccttctctgagaagtctcccacaacctttctaggtagagctgagcatgcctactcagtgtcgccaatgcaccttgtaatctatcaattaatgtaattgaacagattacaaagtgcattggtgtctgttacatgcttgctcctgtcccacgttatgggccttacacgtctttgtattctgggattctagcaccatacctggcccagatcaaggactcaaattatgtgttgaattgaatttgttgaattcacatgaaagacaatacttatccaaagcctgaatggctaaagtggttatctttgggtttcttttgacaataggaagcatcatcagaatggactaaaatgatcaagaatgtgcagaaggacctccataatcagtaactatagagataccaaactttttagttacataaattgaagacaagagcaattacagaagattatatttaatggccttcaggtacaggtagaaatcacatgatattttagactgctttctttaaaaatgcatcaaagcactgtgaaaagccaaaaacatccttttggaagcagcattttataccaggtatttaaatctattttcactgtgagtttattcagagtaattgtataataaagaaaagcacttggcttcaggtcactatgcatatatagctaaattatgcaattagatgacatgtaattaaccagagtagcaacacagccaatctaatggggccagttggggtctgagtgactcataaaaacattatgtagttaagcgataggcacctacaagaacaatgaattttggtctacctgcagcctaatgagtccctcctgtgactaaagaggtaatgcaaagagaggtctcagagacagggcagtgtcaatggaaattctgtctaagaaggagccaaggtatcatcttgattcttattttccaaaacttctaatgagataagaaatctctccaaacgtactgctgccaacattaccagcttgactcttccattaccacaaataataaacaaaaaacattagttaaagcttattttgaatgaacttgaagaaatacttcctgacccattactcaggtagtatatacaacagattgactattcagtaagtgaaaactaacggcggaagaaatccaaattagctttcttccttttccttcaaggatgtatacatggcaagcatgcatgaattaacacagttatgaacaagaaatattatctcttgtgtaaagatcaaggtttactgtctcattgtgtttggttttgggaacgtagttttgattttgtttgcttaagagatggaagaattccagttctgaaagaattcaagctatgaacaggaaagtatacttcaataattgtcccagtgacccttatttttattaagaagaatctagcaactgtcatacttgctaatgtggcaataattcttctaatcttaaatttttaagtaaggaaaaaatgaatatgtagccatttaatcacaaactcatcctctatttcccaacaccacttattccatatatatatttactgaatataaatatactaggcctcagtggaaacacgaaggatgtgcaagactcagtacctgcctttaaatagcttacaatctactagaggaatgaaatctgtcgcccactcttttattttcttcttcgaaatggtttgagtatatacagtatactctaaaggtttaattaaaatggaatatataaaaatctgaaaggatacatactaaaatgtaatctgaaagaggggtagcaaattattctttttgctctctacattttctaattttttttttccctaatgaggacgtactacttgtgtaaaaaggagaagaaagttattttatgaaagatgaaaaaaaaaaaaacacctcactctggttagcctgatattttgtccttttgaacacttaaaaggccccattaccaggcagaggttgcaatgagctgagatggttccactgcactccagcctgggtgacagaatgagaccctgtctcaaaacaaacaaacaaacaaacaaacaaacaaaatgccccattgcctaaactctgaaaaagtcaatacggggttgttgacaaaatctattattactgcccatctggtgatctgctgctcccctaccagtgaggaagcttcttgaggtcggggactctgtcttgtttgctattttgtttgttcaattcctaacagggatcagaggacaccatagataggtaataaacgtgtggggaagatgggaggacaggagagcaggaagagagcagggaaagctgaaggtacacacacttctgaggcttttgttaaaattaagtatttaatgcgatcactttggggaaaccacattgattaaactgacgggaggcatgaaaatgacataattgatacaaccgataattttattcttcaacaaaatctactattggccagagtgcccctttgagagataatggttcatatcagggagcaatttgctttcaccccttgcatacaaagcgggtttcaaaacctatgtagtttcggaacaaaagaaaaactgtaatgtcttaatttttaagcttttttcaatgcagagactctaacaaagcagatctaatgaacagggcatcatattgcatactgtctgtgtgattggcgccttctggagttgtgcagaagacaacctgtgaggccatatttagccactctgggcttgcttcaggctttaagttcttgttgttaaacttaatttttcagatccatgtggtttggaagcattgtgcttatgcctaactttggtgatgtattgacctttgtggaccaaggatgaaagctggcatgaaataagtacaggaaacttcataaaataacagccagcattaattgagcacctacaaactgtcagagggctatccatctatgtgtctatctaatatttagtcttcagaataactgtgcaaggtagatatcatcaccattttacagatgagcaaaataagtcttagaaaggtttagtttagtaattttcccaaaagcacacacagctaataagtcatagagtgaggatgtaattttaggtctgatcagcaacctcaatatgtcattcatcctcgcctttcctctgaagaaaagcagcagcttgtcttatgtattttaataacactggcatgttataaaaagttaacctttttgttttgcagttcctcatttttctttatgtatttctcttgcttcttgttttttttcccctctcctccaatatcaattcctattcctcttacgtttttgtggcatttgagaaaccttcgttgaaaattctttgacagtgtctgcaagtcttctgagacaaagtgccacaaagataatgtttaaataaaataccacatagtacagataattatatttaggctttcagtcaccctgaatattggacaaataaattctcttggaatcttcatattgatgtacataggacacacacacatgcacacatatgattagaataattttttccaaccagaaatgacatttgcttttgaaatgattaaatattaccctcaccatcagccaagatttccatgacacttgaataaacaaaaaaggagttgattactgagattctttgtttttcctcttcctttgcacagtaggaaaagtaatgattaaaaaaagtataaaacacatattaatgatacaaaacagaactatctccaatgctttgaagaatgtattcttcatatccactagggtgctaaccttcggaaagctacaaaatcaatcctgaaagttttatctcccatggcgacagagcccttttttaagtcagtaaatactaaaagtgatacaataacagctcatatttaggattaccaagtttctctacaggagacaggctcaggtatcaagaggaaaacaaatattcattaaaataatttagcaacaacaaaagacacgtgatgatgaaagtctgttcaaataacaagtgactaaaataagagtgctgataaaaaggaaggtagcactgatatggaactgggttttggtaacaatatgccaatcaggaataaaaatataaatcaaacttaactggaatgcataagtatacccagctttacaagatgggtaggtttctggccgggcacggtggctcatgcctgtaatcccagcactttgggaggccgaggcgggtggatcacaaggtcaggagatcgagaccatcctggctaacatggtgaaaccccatctctactaaaaatacaaaaaaagttagctgggcgtggtggcgggcgcctgtagtcccagctactcaggagactgaggcaggagaatggcgtgaacccggaaggcggagcttgcagtgagccgagatcgcgccactgcactccagcctgggcgacacagcgagactccgtctcaaaaaaataaaaataaataaaaataaaaaataaaacaacaacaacaacaacaacaagatgggtaggttcctaaaaagctttgtataaatacagttgctccccaacccccataattactggaaggagagagagaaagaccctaatgaaatcttgcagtaaattctaaattacaaaccgaaaaaaaattttgaatggcaaacagacactgctttaattccctgcttggaaagttttttttaaaaaaaattttttaatgaatgatgatttgaatagcagtatattttttaaaaattaggcaaacacgtatatcactgcaaataatatggaaaatagtatggaaagtggagaaaacccccaaagagctaatttccattttatatttggtatttaaatgccacattgataactgaacactgtagtataaataaattattgttaaactgtcttataaattgctcagtccttcagtccatagtcaataaaatataggccttgcctgtggtttactcaagactatagaaattcagagtaatcaatcattccaggtggcttttatagctttccaggtagcaagagctatattttattgaatgaggcatttaattagtgggtattattaaagtgcaattttccatattaaactgttttctatataaattggcttcctggtatgctgacttgtaatgacaggattatcttgcattcactcttgtagagacaggtaataactcatctttgtgcctgttttttgattccacagaatgttattctttctgctgtcatcaaaaaatagtttctgaacaaatattatccaagatttttcttatgctattgtcctataaactcaatattttaagactaacctgaatgctaatattatatattgtgatatttcttatgttataaaggaaattgtaccataatttctaattgtagactaatcgcagccattctaccacaaaaatgccatattcaacactttttcctattacagtataaaacaccatttgaccttttattttaaaaagactgtgacaaataaatactaatttaatgcataaagtctaataatgatctagatttaccagtgtaagtgacaggaggtaaattaatatggaataagtatatacttcacatgtttcttggcatatatgaagaagcactgaagcaaatgaatctatctcatgtaaggcaaatattatggaaaaactccagaatcagtagaaagagatatttttgccttttcttactatggaaattcactgttataatacttaaagctgcagatcttttctttaataataacttctgtttaaaaatctgtaacaagagataccattgctgattacataacattggtgacatactactgtgattttttcagttctgtaccaaaagacaagaaaaaaacaaaaaacaaacaaaacgataaattctgccaatgtttttaaacaagaatgtcttctacaccaagtgctactttcagatacagggctacagtgcttgaacaatcaccgtattagaaacaataagtgatacaaagagtaaaaacaattttcaaaaaaatcaaacttttataacatttacatagacaccaaagaggacaaaatatccatttccagaagatgtgcagtataattagtcagaaaggtatcgcaatgcttttgattatgatcagccagttgcaaagattatcaaataaacaatctagctattgctgctttgctagaaaaatgatcatcttagtggcaaagattaataactgctttttaaaaagacaaaaactagctttgtgatttactgtgtactttctcaagaatgcacagtaagtaaatcaacagtttgtttaatcactatcaatgtggcatgctttaatatattggatataaataattgtcactaaaaaatcatctgctgcatgttcagataaagctgtagagatctctgccttgttacctagcaactgggcaagtaactgccatactgcaaaaaaaaaaaaaaattccttattatttaggtaaagagaatgatcataaaactccacattaagatgttaatgaagccaaaatgtatattaagatacaacagctaacgattttagatgcatttatggccttggttttgaaataccatgcagtaatgaaaactgtaaagatttaaatctattatttcagcttgtcacaaacaacaacgttctttagagtgtatttttaaaagaccactgttattattaattttttatttgtactctttcacagacaaaggaatttcaaccagatcttctgtactgagtctatttattgaaagggtgatgcttacttgtttaaatacaataaaactgttctgagtaattagttcactgcaagggatcccaaattatttcttatatttcatataacagcttaatgtattaattttataacatctggaggaatctggcttaagttctgtttcaattttgctaaaaatctggattccaagattgtgcataaaatctctcttaaaaagcaataggggattagggcaattataaaatttcacttctgaggtccaaaattcagcatatggccagtcttcaggcctcaatctgaaagtaattctttctggtgtgtgatgaaggctgactggtcagagcccatatgacgatggtcacatgagagtaaggaaaccactcatcattgcaacaaacagagactgttttgtgaacagacagagctgtgcttgatgaaggcttcacaggaatccaaaccccatagcttacatggcattcctctgttgatttaatgtacgatgcttttattcatagtcacttacaatgcagggacacaattcaagaaagctcttcaaattattgcatggaattaagtttcttgataaaactttacaatttaagataaattatgctgaaaagttaaagggaaggttggctttacaaattaggagccgaaagcccagagagattgagtagttggaagttgtgcaacgatataacttcttataaaagtaaatatatataaagtgcatagaacagtgcttgccacaccagaaggattatatgtgtttgatattgttattttttattagtgtaattattattagaagtattggatctagaatctgttttttcgtttccagaacaatgttcttttcactaagcacattacctcaaaataaagcactgttttaagatgcaccatgtacatcttctatgagccaaagctgtattttaatgataaaggtgtgtattaaatgaagatgtatacgtagattcacattaaaagcagaaaaaattgagtcttcataactagtaatttatagttatttgtttaaaatcaaatctgtatcaccttcaaatatatatcatttacaggctaatagctaaacgcaagtcaaaatggtatcccaaaggaaacactttactagtgttagtgtatagaccaagatgtataaactttcccatctttaaatattttctctgagttacattttcactaattcatatcaaccattaacctgttatttttatttttataacattaactttacatacatataacctgatacgtttgtactgaaagatttcagacatttgttggattaagaaaagtttactctgagcctaaagagttcatacatatgtacttcttgatcttgattagtatatattcatcatatgcttctctgtatttacattctctctccctagctggtctcatctaggcacgtggctttagaaactatctatttgggggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaaagaaactatctatttggggagtctctcagatgtgtatctagcatcctgatctttcccctgagttccagactagtagacccaatgatctgcttgacaattccatgtggatgtcaagtttctcaaacttaaaataccacaaaaaaactcttgcttccttctttcactagtagcctaatctgttcatcatccactcagttgcacaggccccaaatttagaagtcattcataactcctccctttttctcatctttcacattaattcattagcaagatctctaggttccatctctaaaatatacattccagaatctgatttaagatggaaaatttaaactgcttcacagaacttcccttcctcaatatctaaccaaaggagaaaaaaagagtaaacattagtaaaatgaaaaaaagaagttccaacagtaaccactcaaggaaaggaacattaacaactataataaacttcaaaactggcagccaaggaaagagaagattctggaacaggctaaagagacacagtgttccttggttcttaaccctgtgttcaaccctagagaggtaaacaaaattctgagactttttgctaataattctaaatttagagaaaaacacattcagtgaacatccttatgtttccttttactactaaggagtaataggaacatgtgcaatgaaagaagaagatcaaagggctgattcaacagaagtgaacactccagggctgcccactattttggggaaacccatcaagccccagattatctcgaggatagctactagctcttatggaaccctttagttaattataaaaaggctatccttggtatctctccctccaccaccccccttgcccgccccgtcaatttggtgaaataaaggctgataatggagacatttaacacaagttaaggaagcacggcccaggaaatctaacaaagattgcatacagcttgagttgagctgagctgtctacctccctctgcaatttctttaggttgcagaaaagtggatagatccaagcaataaaacatagctcaaagaggaagcaaactggtctccaagaaggtgggaagaaatttaagaagttactcacactatgtctggggaaagctgcccaggcaccagcaagatgaaaagaaatagcacggcagatatgcaagcattctaagggagggaggcaggaggagggaaaagagaggaaggaaagagggagggagggagagagagagagcaacaaagtgaagaaaaaatataaaatgaaagtatcacagcatataggaactaaatctagaattttattcaaataaacagaaagaaatcctcacacaaacttcctactgtagaataacgagttcaatgaaaattgaagtttaaagacagaataatgaagaaatctgaatgagatgaaaaaggatattgtggacctaaggaagcaaattaaggactaaagatcataattttagaatcaataaacaaatcagaacatcagaagcagagtagacacttctgatagttgaattactgacacagaagaaaggacccaggtaccatgaatggagacacttctgatagttgaattactgacacagaagaaaggactcatgtaccatgaatggagatgaaaatgacaacagattttcatcaaatgataaactaatagatatggaagagatgaaagatgatccaaaataaggataagtgatgttcctgaagtaggtaacaatgtaagtagaataaaaggtgttttcaaagatatgatacagtatctgatctaaataacacatcatattgtggaaaattcttaagcagaccatccaacacctccacatatcttagctatgttattaagctatgtggataaagaaagaattccttgggataaaggcagaaaaaaaatcacctacaaagggtggcctcagactatacagagatattcaatgctattaaacaatgaagtaatagctgcaaaattataatggaaagaatacatgacataagaatacaacgttcggccatgatatattgttcgactacaaaagcaataggaagacgttctccaaaaaacaaaacaaaataaaacaaaacaaaaaactcacaaatgcagaatccatgggtctttctcgaaaaaaagaaacaaaaagcagttggcaatgaaatctaggcaattcagtgatgaatcaaagaactcagtcagaatgaagaagatatactaaagggctgggaggcaatggatccatttgaacataggaatttatactaaataaccatagtaattatgattacagaatagaaagtaaatattataaacacaggcaatataaattagttaaaattgttagctgaggagaggatgggcaaaagcattacctttcaaagcaaggaaccaatctgatgtgtttaaaactggaatatgcagcttaaaaatgtgattccaactctgaggtggatttactgttaacgctaaggaagcttaagttccaaggttttttatctacacaggtgatttgcgttttcccatgccctggaaggggtcacagcagtgcattcatattgtcatatttttgtaaaatttgtaaaaatactccattttcttaaagagggcccccaaattatataaccttcccacagaaatcttgatccactcctgatcaaacctcttaacatttttcatcgtattttttcttaaccataagggaaaataataactcccataataaggagacacttattggaagttcaacaattatttagtttttctttattttttttctgctgttaaatacaataaaaccattttttttttgagacagtctcactctgtctcccaggctggagtgtagtggtgcgatcttggctcactgcaacctctgtctcctgggttcatgagattctcatgcctcagcctcctgagtagttgggattacaggtgtgtgccaccacactcagctaatttttaaaaaatatttttagtagagacaggatttggccgtgttggccagactggtcttgaacttctggcctcaagctctccaccggcctcagcctcccaaagtgctaggattacgggcatgatccaccaataaaataaattttaataatttttatttaaaaatagcatcagcattatgactccacagttataaagtctttctttctatccgcacagtcatgtatcaatccctttgcacatatttatagaaagatgccttaaatgatataagtctactgctaaaggtggttatttctgggcagtggtatttggggtaattaaaaaatttaatctttgtattacatgcattgtctgaattatttattgtgatcatataacaaatatttcaaaaataatacaatgacttttttccttcaaatgccaagatagtaacagatattattttggatggtgagaactatagggaactgttattttgtactttgtattttcctgtgtttttaaaatttcaaaaatgttttccaaaatttgatattctgaatcattccacatctctccctttttcttcttccagccaagtcactattatttctcacctggactactctcatagtcttctgtgtggtcccacctgtgtccatcctagccctggtattacccagtctttacacagcagccagggtgtgctcctcaaatgtaaaaggatcacacctctgctttacattccccagctgcttcatattgtctttagaataaaacccaaactctttgccacgaccagcaaggctgacctgagctgaccgggattcagtcacgctggactgctctctgtcccccacacactgcacttgttccccctgacagatattccatgagctgttcccctagcctggggtgttctttctccagcatctccgtatagctggttccttctattcaggtctctgttggagggccaccttctcagggatacccccaaattttctaatttctccctccatctccctctccagtgcttcaccctgctggatggccttcatggcctttatcaccatctgaaatgatcttctccatttatttatttacttcctttgtatcaatcctctcccactaaatatctgctctagaaaactaggaccttgtctatcttgttcatcattatatctcctgctcaaagaatgtgcccagaagatagcagacacttaataaatatttctccactcaatggatacacacagagattgtttctcagcttaaaaaggcttgtgtttgcaaagctgtcttttaagtcagttgtttagaattcagaatgcatgttctttaaaatgagtcacagtacaaattcaatatcaagcctagctcacaaagtctactggacccataatgagttaaacttctgtatatctgcaacaaaaatgctagaaaatcaacatgatgaattatcactgggaaaataggaaattaaaaagaaacatttcaactgatctaaatatgaacaaactatgactattatttctctctcatattggtgaagacttttgtgaatattctgaagggaacgtcagaaccttttttattttttttttttttgagacagtgtttcactcctgttgcccaggctggagtacaatggcactatctcggctcactgcaacctccacctcccgggctcaagcgattctcctgcctcagcctcctgagtagctgagattacaggcacccgccaccacatccggttaatctttgtattttttgtacagactggtttcaccatgttgccaagactggtttcaaactccggggctcaagtgatccacctgcctcagcatctaaagtgctgggattataggcgtgagccaccacacttggcttcagggcatttttaagagctgcagaagtttctggttttttattgtgtataacttcatccaaaaatgtgtagcttttggctcctttgataacagaccattaaattagaataatgtttgtaactatgagttttattatctgtttttggttttagttaaagcttgggaatgacttgcacgtagttgtaactgcaacaggtggtatgttttgtgaatgcttacctgtcattacttgagtcactgtttgtgtcaaaaatgtaaaagaggaacgagtttctgggaggtattaggaagagaggggctcagaaggaaaggaattaaagaggacgtgtgattggaaagatatctgagataagagcagcgaacgagaggaaagaagaaattagtgatgaatgatcagaagaagacagggaagacgacttcctcctgctagctactaggaaatgttatcttccaagacagcttggttcctgtctagagtagctctgggtgggtaaatggagggagggccagtttgtaaataacgctgaaatttaagagactatatattatctaatttgaggctttgtcccaaatttggtttggagtgagtttttatgactaatctaccagtagggtgaaataaatagcatcattcatatcaggagtaccaaccaaccccataagagatattgaagagacaatgccaaccttccattctggagtaaagctatagtgcaagaaaacaatttgaaccaattattttcatactaagttgacagttaagacagaaaaaaatatatatattaagagccaagagatactgcatatggtctgcaagtcttttctggagaaatgaatcatgaagataaagagaactggcttatttttacagttacattttatatttctagaaaaataactacaacatggtcttgatgtctaaacatagggaaatgagacttttatgaacgttacacaacacaaaacataccacttgttgcagttacaactacgtgcaagtcattctcaagccttaactaaaaccaaaaacagataataaaacatatagttacaaacattattctaattgaactatactttgaaaatgactgaatgctcaaatattcttaaaatacaatgttctcttgccaagaaaagagtgttggtcttaaaatggccacaaaacctagccccgtcccatgttactagagctacagaatcaagcaccctccaaatatatggccaagcagccttggaggcacctaatgagtccaacgcagtcttcccatgtgtctcagaggctgctgtctgtagtgacagaggtgatagaatatggtaaagttgcgtatctaggaaaatctcaatgtagtccctgatttcccagagaatgttcttgtggcttatcctctgaggttagtagtttcagtttagtacattaattccaaacactaaagagatgaatccattcaagtcatttacagaaaaattgttttgagatttacccaaaaaacaaacacactataaagaatttagtaacagagaagattagaacttgcacttttgcttctgctggttcaagttttgttctgatattctctgcatttcctatttccatatgagaaaaccaccagtacatctttgctgtgtgaataccaacactgagaaatattggccaaacataaagatttttagagaattaatttttgatattcatctaaacaagccaatatattctcacaattttttaaagaaaaaaaaaagaactcagcttaatcatatatttgacttctaaaaaatcatctcatgattccatgaagatagagaaaaaatcagatgaacaggaatggttttcatttcacactggaattataagaaaggttaatttttgcataaaaattacatctacataaaaataatttctggaacaatgcattattgacagttatgtgggaagataaatgcattcacgtaaatgttctttctcaagcaaattactaaatatattgacagcactgcactttgaaaacaaccattttaaggcaaccaaatacatatacaagagtaaaaacattacatataatagccaatgtaatgtttcactcaatgcatattcactcaaatatgcatactttttttcagtttattgatatatactgctattaaattaaatagcaaacacttatgctttgttgttggctattgcccacagaaggaaaaaaatgggtagtcaactggagcctattcacacttctgttaattactggtggtccatggaagatgttatagtttgattactagcacttgtaaatattaaccaagtctaagttactgctataaaatccaaaatgtgtaaaaaccaaacacacctatacaaatacaaatgttttactcatgatcgttaatgactttaatcaagcagatcttctaattaattttgctaattgttcattcctctcaggacatttattggtttgatggatattactatgacatatgttgatgccagcatctggtcagaaatgagggcatcaataaactctccttggtgtttctacagaatgtgccaatgctataaacactgtcaatgccacagcatttatttcaatataagattttgagaacatgtctgcctttcatttagagaaaggataaacctacttcgaaacacacggtgctcaaatatgcttattcaatgaatggtgcaatgagaatggcttgataacaaactggaaaacatctgccaacatttaaaatagaataataacatcataaacgattattaggaatggcttcccccacaatgtactctgtcaatttataccctatttcgaatatgtagactaactttaaacaaatatagtaccgctatcttaaaggaagtgatcccctaaacatttctgaccaaaggtaatcatatgcagtaaattaatagacaagaaatgcatcagaattcgattcatgtatagaaatttggctaaacttgcaaacttttatgttgttagtaactattcagagattatcactttaaactgctgacaaataagtgcacttatgcagttttatttttaaaaactagttatcccaaaatatcatattaaataatacaccatgctgtatctatatttcaaaattattttaatggagatttgatctccaggtagaggcaaaacactgttttctccttctggcccccattagggaaactgtaacagtatggttgtctcccgtttctacacatgaatctattgtcactctactgtcatggcttaagaaaaaaatattgcttctactcaaggtgccaaactgcaccaagcaaagtaactccaatgcagtaacattaagtttggcaactgcaggacaaggtttccatccttgaacaaggagcactgatacttcactattttgccccccaacatcatatttccccctgcattctgaaggtttttttaaaaaatatttgtaacaatgtttttgtatgacactggcatcaagtctcccaggcagcatgcatctgttttaatttcatttgtattcgttactcctttcttctctatctgagtccaagagaatcactgctaacacacccagcactactcaggatagacaacgacagaatgaaacacttctgaggaagcctttccggtggcataatgccagcactactcattatagcctattttatcacagagccgtcaacattacggactcgaataacccagataccagcggcatccccttgcacgagctcatctgcggagtacaaggaatacagatttggaagaaacctctgagaggttttctaatctttcctctcttccttctgacttctaactttaacgtgagcccaccccaaagaagagaactagactctcttagtaacttgtgcaaaccttcagaaaagtcttaggttgtacctaaattcctcatgttgccattccaacactatttcctgtagttttccctttccagatgcaggagtccacagagcaagtatccttataagtgtctaagaatcatcaagcaattccaaagttcccgtgtctctaatctactgatccaacgtgcccggcgcacataagcagcaccgcgactgaatttcaagtcttctcaaactcacacctcagttgctcagagaggagaaatgcagcgaggactcgccttcctggccagtctctgaaaacgcgaaaccttcctgagctgtccatttgttttaggggctgtttataaacggctggttttcttggaggaaaaataaacaaataaatacggggcgatggcagcatcctgataaacacaggaccttgtttggcttttggcaagttgtaacctggagtaaaatcacatccaagttacaagcacgcaaattggaatttcgctggaaacactgacccgaccttcaccgaagcagcaaatcgcagtctctgctgctctgctcctgctctccaaggcttaacattggaaagtccatgcccacgtccccctctaattaatcaatgtagaaagaaatacgagggaagagagagggagcacactccacaccaaccttgccagcttctattcttcctgctattccttaaaggcgatgcacagcgcacctggaaattacgtggacttggcatggctttttaatattaaagacaaacgacctttggaaaatatacactgttaaagtcaaaccatttggagagacacccagcaatttacctcctcaaactcctcggaaccccaagaatgaggaaaggaaatggaaaatgcgcttaacccgggggtggtgggggaatcgataaccagaacaggtttgaaaaaaaaagcccccctcccgccccctccgtagagaccgctagctgaggctgcaacacctgccccggcaaagcgtctccgcagccttcccggcttgcccgactcggcttcctccgcctctgccccggctgcggcaccacttcttggagccacgtctcggcgagcgggggccgcggagcgagggggccgctgtgccgctactcacccgagccgctcgggctggccgcgagccgggatccgcgagggctggcgggctctggcccccgaggacgcagacatgtggcttgaacctccgctcccctagccgttgcctctgtgcatctttctgggcgcccccagcgaatgcgagcggcgaggcgagggcgagcgcgccgaggaagggcgggagaggcgcggagcttggccgcgccgcgctgcgccgagcgccgggctctccccgcgagctccccgggcccgcgcgcgcgccccccac

SEQ ID NO: 1476 - DNA, 420009 bp, Homo sapiens
ttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttgaaaaacatttttggattgtttcattctttgcttgtcatttatctgttgattagaccactaaagtgaaggattcaagctaaatacatcaacctttctatttaggctttatcagctatatgtaaattcaattctatcaaaattttctgagtgcctcctcagtgtgtctctctgatggttcctgcccggtatggctggcatgaagaagatcctgtaaaaaagagaattcatttatttattcacttagtttgttcatgcatttgtttaataaatattgagatgtaccatgtgcctggcattgtggtaggtattgggaacacaggagtgagcaaaacaaaagtcttgctctactgcagttaagggccagggagaggcagaaaaagtaaataagtaaaatctatagtgaatttggtggtatgtacaagcggaggggaaggggttacggttttagatggactggctctttcagaagctgacacttgtacagacctgaaagatgtgaggaagtgagctatgcatctgtcgggaaaccattctgaaggatacagcaggtgcagactccagtgggatggttggtgtattctgggagcagccagacggcccatgtggctggagaagggtgagtgtgaggagtctaacaggagaggcagagaggaattggggtagcaccggaggctgcctcttaggccacagtaaggacttcacttttgactctgggagccagtgtaggagttttgagcagtggtctgatttaagctttaacgaatcacccaggcagtgggaatcaactgaaaggggaaccagtgagaagcttttgtaatcatccggacaaaatgaaggtgggccagactagggtggcagcagcagagcttgtgacaagttggattctggacatattttgaagataagagttaataggatttgctgatggattggataaaggttgtgagagagacaagaaaagaatgatgcaaggttttagcctgagcaactggaagaagagagttgccgtcagctgagatgaagacaatgaaagcagctttgcggacgcggtaagtttgagatgcccgttaacgagacatccaggtggggatgctgagtaggcgggatgcaaggctctggagttcatgggaaagctccaccaggaggtagaaatctgagagtcatcagtgaattgatggtatttaaaatcagaggagtagatgaaatcagcagtgaagtgggtgtagatagaaaagacagggggccccaagactgagtccagggcagtctggagatcagtgggatgagggataagcccaggagactaaaaaggaccagcagagactaagagttgcaaattagtgtggtaagtacagtgaatgcagcaggcatgggccccttaacgtcttcttgtctgtagtccttgatcagtctgctcattcacccacctatctatcctgtactccttgagcatctgcatgccaagcactgttttaagcagcagaggaagcaataagtaaatacatttgagttgttgagagatcatggggacaacagatgataagaaaacaggacagtatcagcagttgtcttatctgaaaaatgaggatccgttcctccctccagattgttgtaggatttaatgagataaagctcctgaagcacttatctcattgcctgcactaagagaccgctcaggggacattctgcaatgccatttgagctccctcctctttgcctggcaacagccccagctgccatctctgcctccagttgtgcccttctgcatgatctttccagagcactcatctgaatcacattaaacttctctgtttaaactttgtgtttacacttctgtttaaaccctggacctgctccaagttctcttctgtagctttgtgtacactgttttctctatgctgtcctctcaccgattttcttttccccgctaactccctatgtttcacaaattctttaagatgaccctcaagagctgaagggctgccctgccctctcctagcattctcttttctctgtcatggcttttgttgttttggaattgcttgcttattgaggtccccagtaaatcgtaagctccttgaaagccaggactgtatagagtctaacatgagcctagcattgcaatgagggcctcagtaaacacttgttggatgactggaattcatctcctgagttccatgggatgaatttgcccacgtgttcataacacagtctatgttcttcctttccataaggatatcatgaggctgtcaaatgaagatgtagcatatcaccagcattttatcttgccgttttagtttggcctttttctgtgaaacatcattaggggaaagtaaaactttacttggacaaaagaggtttgctaccaaattatataaaatgaataaacatatccctggagtgtttaagtcagcaagtatggccatctattattccacagacattttatattataatttactcactgaactttaacgaaggagaaaatgattttctaataattcttagtctttgaagattgtcactggaatacattccttgctcataaccactccccttgggaccgtggatatactatacagttattaaaatgcctgaattagaaaatctgctgctcttgggctatgagtttaactatagaagaattactgtatatgctcacacgagaggggcagaagaagggggtcacatttgagacgtagcagagaccaggcctttgaagtcctctggcatcaacaatgacttgctcctgagtcaaatgatgtgagaaaaccagaatttgggaaattttcatttcaattaagattcaggaaaatgagtcactggtgttctttgtaaattcatttatgaggtcaggcccccagaactgggaatgctccttatcacatagaaatgaatagaaaaatctgcctctgtaatttccatcacccagggctagaatatgtaactagagagggtggtcgaggcctgagtttgggtctgggggttcagagcaaccgatcaaactggaaaactgagcaggtgagtggagactcctgctgttctgaggagcacacgttcgcattcattcaaatgtttatcgccgctccactcgaggcactgcccaactctcatttatcttcacagaagttgagtggatctgcagactgcagcttcagtttttagatagaggaagaactaaaccccagcagctaatcggtgacaaagccagggctagaatccaaatctgctattctttatagatagaaaggccaagactcttaggcttgtaagtcacctgtcagtcacaactggaagtagaatactcctgggttcagtggcagatgacatcagcctaggggtcataaggcttggtttcactagctggggaaagtcatccaatagcttacgtgatggttttggagatgttcttatattcaccttcaattagcagtgagcccttcactaagcccttcatcttgggcttattgccctacttgctgtcaattaacctctggagacacaccaagtcttttagaaggaaggaagggagctactattttttgagggccttttatgtgccaagcccacaggctgggcattttccatacgttatttaactgaatcataacagtgctgcaaggtgttatctctttcataggtgtgcaaacagatgcagagaggttaggtttccagggccccacagccaagtggtggagctgggtttctggtccacggccttctgtctccactgggtgacactccctgtaccttctcattgaagcccctgggctagagggtccaagagcatcacttcagttctgcatttcattcgttactcacttgcatcaggacagatgcatcactactaagctctcggagaaggcatcagatgctgtctgctcccaaggagcttctacttttggtagtctgcttaacttgtatctgtgcctgtagagattgctctttgaaaaaagcagcaggaacattctgatagaagccaatggatgggacaggtggggggaatgcgttggatttgccagcacctggccactgcccaacctgctctcaattctcagatgattcaggtattgagcaaggaaggtagcagagctactgttgccttccctttggggaagcctgtttctactttgaaactcttaagggattcatttcaaattagtggcaggccttggttagtggatctgtgtgctgtcttctgccatcttgattgcatctccccccttctccttttcctttcatttgaaaaaagatgcagcccctcagagcctcactttcctgatttgtcaaatagggaacctaatgtacaaggcttttgtggggcttagaaaaaacatgtcaagaatctgatatagatctcaataaacagcataatacttatctttcgtcccagttacaaacccccattcctgtactgcccaaatctccatgattcacaaattgcgaccctgctgcttctgctccatggcagacacctagctccaggcaccctcctctaccacctccttctccttatggccattggcttttaggagacagacattgcttacttagcaggaaagctgtcacctgctttcttttgaactatcccgaacttgattctctttgggcgacgcatacacccatcaagtggtaaagaagactgggaatgaggggagaaaagaccctgggcttgttgctggggccagtagcttgggagtgtggtggtatgtgtgtggctttggctgtcaagtggatctaagttcaaccctggctacactgactttccagctgtgtgacttcagcaaatgggttaatctcctcaaggattcacttcctagggaggctttaaatgtccccgggtgattccagtgtgcagtggaggttgagagccagcgccctctactctcacccttgatgcccaaccaactcattgccagtctcctcctttagcacagcccatgatgctgcgatgtctgccaatgcagcatgcccctttgtgcctgctctgcccataacattctcaggagcttgctggacagcacagatgtttggtgtgcatattaacccagctgtggggatctttcctgctcaggtttggtggctaatttatagagcagctctgtcaggatgatcaccaatccctcttacaggcactgctttctctgttcaagtgtctcacatgtgtgtgcttgtgtttgccttttagctattactgtgatgattcccaatgtagtagacactgccagtgaccaccgcaatatccaatctcccccttttcctcactaacaacccctgcattgttgggggctgcagtgtgctcagctaaaactaacaattgcagccacattttccatcctcctacataggggtggccaataagctgtatgcagaagttgtggggtggagcttccaggaaagctcttaaaagtctgccttattcagctggacaatgcttccatcctatggtccttaccatcttttctaatgcctggaatatgtgtgtgctggaggatgctccagcagccattttgtgacaatgaggcaatcttgaggctaaaagccacttccaaaggatggcagagtagaaatatagaaggatcttgagatttcaatgatatcataaagctacaattccagctctgtactgcctatctctgaagttcatgttacatgagggaaaattcaacccctgcctcgtttaagacattgttattgctggtctttgctactagttctttagttcaattcctaactgatacttcccaaaacaaacctggtgaataacagcaattcaacaaatgtcaccgacccctgaatctctgcctcctccacccactcaccccagctacaaacactctttctttctcctgatgagtaaccgggcatctagctgtaaggttgctgaagctttgtggaatctcagaaagtcataaagctactgaacaagttcacaaacaagtgatgcatagaccacacccagcccacagatgagttctgtgtggctcacacttattttttaaaactgggtttgctgccaacacttcaaaacccaacgattttgcgtgaaaatccagatttcttagaaaatctgtggacccagggtcttcctttctgcctggcaacaatcagctggaactcagcagtggttgcccctgagatgaggcacagccccatccccctcactcatgtcacctgtatggcttggaaggcatgtgagtttgcaacctgctcaaacccacaccccagaaacggcccgctaaaatgggatttcagaatccacttgtacctttcttctttctcagtctcccctgactcaacacagcacactggcattgtttttttcctctcagacaactcagcatgcacttttgagaatcagagagaaatccgcctctcaaatgtcagaaaacagctgatgctgcctcttacttgggggccttttgacttcccacgtgtcttactgccacttgagagggagggctgcaggcaggcaggctccctggggagcagctgttgggatgcttgattgaggccctgagacagccagaggacaattaaattgggtattgaatatgaattgctttgaatggtttttattaccacattgtgagctgactttggttgtaaaatctgactccatctcttgctcttactgtggtgatgagacagaacttcaagatgtcttaaatagcagggcttggaacatgcatattagctcatctgtactcgtgaagtctgtcatctgatacccgcgctcctccactgtctgaaccaagttaggagccctgattaaacctccgcggctgcagtcgccaccttccgccggggtgaccccattggagatgacaaatgaaggatgtcttatttcagcctgatgtgtaagtcttcacagcactggtcgttaactactcttggaaagttaaatgcccatgcagctttttttttttttttccccaaacaaacataggtctctgaggttttggagagaaaaacaaaaactgttttaataataatttgtagctatgctttttgatgagttgcacactgagtgcaatatgttggctgcagaatgaccatctttgcagaagcaactctaaggaaagtgatgccacgctaagcacagagtgagttctcaataagtagaccgacttgagcggaagacagaaacagttaagtggagttggcatttccctggttggcaccaaggtctcagggttatttcgaccacaaaattaagttccagctcctagctactaacagagtcacaatatgcagcatggtgatggtcaaaaggcctgagcaagttcaaagcgccgtctctgccggctttggaaccggtttctgtgggaagcaggactctgttgctggggcaggcagatgcttgtgtccatttgcctagaggcagtaaatgtggggctggctggctggctgttggggagctaggactggaatatggggtgggccagtgggccttgctgcatgtagactctgtgctggctgtgttggctagttagttacccaactttatttcaaaaaatgtgtttcgaaccttcagatcgactagcctatctaaaaagagaacttagaaagttattttttttaaaaaaagtcttcttcctacggatttcctgaacatggccattatattctaattctcttgaggctagatcacttatcaaattttcatttcttttcagaagtaattaggagtgatgctaccttgaatccaggtgtgaatttttattgatttttgaggatttggccacgtgttcctttatccaagcctgtcttctgctccatcttatccaaacaaacattgaaccagcaatattcccaagtattccaacttgagaaaaatcttgtgtgtcttgagaaaaatcatttccatgacttattaatgaactaactagggataattttcatagggttcgttaactcagatttatcatagaatacaatttaataagaaacaattaaatggagtaattgaattcaagtccttttttgagtaatgatgttagcattcaatgaccccccctgcccatggttattgaagttatcaatgtatcaattttccccttgaagaaaatcagctgcaaatctcttcgtcaatgcatgggccgcctctcatctgccccctgcaggcctagcccttccttttcccgtccctgctctggtctatggggctgctgtgtgtatagaaaaaaatgaaaggactgatgaccatgtagataatgtttttccaaacataccatcgaggctgtgctacaaaagtgatccagtttggtggtcctttctcttttagagatgcctgttttgacaattcctccttacagtctgctttaatatttaaaagaaggcagtgggggctttaggttaaaattaaagtttcagaggcctgtgtatctttctcagactggttgaacttggaactgtgcaacttttctcaacaattttgccaattaaaaaagtccctttagctgtagatgctgagaaggctgggcctttggttctgctcctaaatgggagtggggaaggtgctcacagaacgatgccaagcaccactgctgtacaacttctgttttatttttgtgtgctttttttataggatataaataatgacaaaaattacaaaatttataactggaagcccaagcttatttacacatatgcttctgtttcagcaaagctcctattaactttgctcctatacaattgcctcctggtaccatattttagtgttatttaactctcattttgctacatacatatcaacagtgaataggcaaaatatatacaaggaactgttcagttcaagtaatttaatattgtattaaaattcttcaacactgaactaaaaccgtatacatttgttagtttgaaataaaatgtagttattcttcaaaactcaccaactgatgaatgtaactgatcatctcagttaggtttaaaataatgtcagttaataaaaaaacattaagacaattccacaatttatcaatatcgctataatgaacttcaaaatgattcacaatatgattgttagaacaatatacattaaaatgttatttttttctataatgatattggtactgtttatataatttgattctacataaatatacattatggtatcatacaaatactccacagagacattaaaaaattaaaataccttaaagaaatgtaagtaaattttatttaatcaaatagtaagcaaactttttttttgtttgtctcaagaaaagttttattactttggaatttcttcttttttttttttgtatttattttttctagaaaaagaaatttttgcaatagaattttattaacacctttctcaaacaaggtttccatgacagaaatcttgacagcaggagcactagatttttttttttttaacatgttctttaaaacactgtgaagattaaaaaacaatcttggcaggctgatggctgcgtcagcacttccgggcctcctgctctagggagcatcaccagtattttgccaccactgagccagtcctcttggtagtagcagtagaaatttaattatttgaaatgaaaccagaaacatccctcgcaactaacctagttttcttatcaatgcattaatgaaacattcttttaataaaaatatttaatacaagacacattttgctgtgcataataaattcctctgctttgaatcattctttccttttgaaccaatcatttggttgaaaggttttctttctctgacataggtgattacatataaaatccacaaatatagaaatggggaaacagaatctcctggcaatcatatcacgggagttgtttttgtccttttgcattaaacgatactcaatgatagaatgattttacagatgctttggaggtgggaggggtagtgctgctctgatttcacctttaaaactgctgacagtgaaagcatacttttaggcagtattagagatcccctttacttttttttttttttttttttttttaaagaaaaggtattattttccccaaatgaagcaaagcaagtactggggcggagtcatcagaaataccttgggaggtggtggggaggggagtcgggagcatcagggaaaacccatctcaactcacgcctctcaggggttgcgactggaaagtcttgcgttttccatcactggtgcagaaagaacttccccaggaatggccagtggcctttcgcccgtaacaaggccgcacgctcagagcagtcttcctcctgggctgggtggacgcggaggcgcgaaggaaagcctgctccgggaccgcttggcgagcaaggcaccgcgaggacaggaggacggcgagtatcagaaaatcgtggtttcatacttggtattaatgcccctcttggcttcttggcccggctccacaatccacggtagattggccagagtcttttgctcagatgggtcgatctgctttaaaacagaaaggctgatgcctgttatacggtcgccgcgcgggtgcgcgcatgcacgcggacgccgctggcgaacccacgcgaggcccctcgccccaggcgcggggcggcgatgctggtctaggcggctcgcgggctcgctctttggacacacatttaccgcataccgactctctgcagggcaccctgagggtgacggtgaataaggcacagcccttgcccttgtgagcacacagacggggagcagacagaggcggatttcagtgctgagaggtgagatacgaggggaagagagggcaccatgtgggcacacacaccttgggagccaggggggcttcctggaggaggtgaatcaggcatgccactccccggctctcactctccagtggtttccatcacagtcagtcagaacaaaacccgaactcctcaccgtgacctccagtacccctgcccacctgatttttctgctgcagccacacagcttccttgctcttcctgcccgccaagcccacgcccagggcctctgcgctcatcatctgctctgcccgagttcccttctccagacacctgcatgcctcatgctctaatgccattcaggtctctgctcaaatgccacttccactggcacctgtattcctagaagcctttcctgtttactcctacaaaaagcaccccaacttttctgctctcctcttctgccttattcctgacaatacttattgccgctatgcgtcatcacatatttatttgttcatcctccactgccacgtatgctcatggaggcaggattttgtctgttttcatcactgccattttctccaaaacgcagaaaagctcctggcaaccccgtaaataataggcacacaataaatacttgttgaataaatggtatcaaaagaatgaggtaatatttaaatggacagccgaaggaccagcaagtatttgcctgaagacaggaggagggggcatttgaagtagatgaaacagcacatgcagcagtcccagaataatctatacaacagaatgaaacacagcctcatcttccactatatacagaaatcaactcaaaatggattaaagacttagagggaagacctgagacgatgaaagaactggaagaaaacattggggaaacactacaggacattggtctggataaagattttttgggtaaaatctcaaaagcacaggcaacgaaagcagaaagagacaaatggaattacatcaagtgaaaaagcttctgcacagcgaaggaaacaatcaacaaagcgaaaagacaacctacagaatgggagaaaatatttgcaaagtatccatctgacaagggattaacaaccagaataaataagggactcaaataactcaatagcaaaaaacaaaaataaaaaacaaaaacaaaaacaaaaccaactcaatctgattaagtaacaggcaatagaactgaacaggcatttctaaaaagacgacatacaaacggccaacaggtataggtaaaaatgctcaacatcactaatcatcagggacatgcaaatgacaatcacaatgtgatacgatctcacccccgctactattgaatggctagtatcaaaaagacaaaaactaatggatgctgatgaggctacagagaaagggaaacacttctacactgttggtaggaatctaaattaggaaaggcactatggagaatagcatggagggtcctcaaaaaactaaaaattgagctaccatatgttccagcaaccccactactgcgtatatatacaaaagaaaagaaatcagtatatcaaagagatatctgcactcccatgtttattgcagaattattcacagcagccaagacatggaatcaaactaagtgtccatcaatggacgaatgggtaaagaaaatgtggtatatatacacaacggaatactattcagccataaaaagaatgagatcctgtcatttgcagcaacatgaatgaactgaaggtcattatgttgagtgaaataagccagacacagaaagacaaatattgtatgttctcatatgtggaggctataaaaagtggatctcatggagattgagtagaatggtggttaccagaggctggaaagtgaagaagggagagtagggatgaagagagattggttaataggtacaaaaatatggttaaatagaaggagtaagttctagtatttgatagcacagtagggtgactgtagttaacaacaatttattgtatatttcaaaataactagaagaattgtaatttctcaatacaaaagaaaaatatttgaggagatggatatctcaattactgatatgatcattacatattgtatacatgtgtcaaaatatcacatagcaataaaaaacagtcccagaggtaagggaaaatggtcgttgaggggttggggtcagtttgcagggtggggagcgggaaggcagacagctaagggtgaggaggtgagcagggacccagtcaggctaagccttgagacaaatcctaaaatggtttcgtccctgtgcgtacaaatacaacgggacactcctggggcggggccgggctgtccgctctcaggaacggccctcaggtggatctacaccatggctgcctcttcctttggtgtttccaggtctgcctgccctgtcctagctgcctgctcttctcagagcctgaggttgtgggaaggcctctcccatttctctggcaccatgagctttgcagctgccttctaccgtgccttgactgtatctccataaagctgtggggaggacctcacgtgttcttagggatcactgaatatttcttaccaagaaatgcctggggctgaaggaactagaatactaatgcctgtcgagggggactgatcttgaagcacataaataacatcagtattattcactgtatattttcctatttcccttgaaggcatctggatgaatattctatgagctcttatgccacccaaccctttgtgctcttctggaagaagcctgtggggaccagggtaaggtcagatagaggcacctgctgtgaacagatttattcagcccacatgagaatgaatacaatagtctaagagataatctctaaaacattctgcaaattcctggacacttagcagcctaatcaatctcaaagatatgcttgtgaaatccatccacaggccctcattttgtcatccacagatattcactgaacacctgctatgggcctggttccggtggtgacaacacaggtggggtccctgtgtgcatgaaacttacatttttttttttgagacggagtcctgctctgtcgcccaggctggagtgcagtggctcaatctctgctcgctgcaagctccgcctcccgggtgcaagccattctcctgcctcagcctccctagtagctgggactacaggcacccaccaccacgcccagctaacttttttttttttttgtatttttagtagagacggggtttcaccgtgttagccaggagaatctcgatctcctgacctcgtgatctgcccgcttcggactcccaaagtgctgggattacaggcgtgagccaccgtgcccggcccaaaacttagatttttgtggaggaagatagacaataagccatcagtaaaaaaccctcaattaataaatgctacacagaattaaaagcagatgacatgcttgaaggtgactgggtatctatgtcagattgggtggttaggacatccgcctcttcaagtagccgagacctgaatgacaagatgaagtcagccatgcagaaaccgggggaggatattccaggtgtggggagcaggtggcataaaggcctcaggtaggagtgagcattacatagtcaaggaatgggaagagctgagcatcacagaggactgtggtgggaaactgcattctgggtacttggggcagagggtgccatgactgatctctgctgtgtggggaggggagtctcaaggagctatactgcataggcctggggcgaggtggcagtggccccgactggaagagagatggaggaagtggggaagagtggacaggattgagatatattttaggggtagggtggatgggatttgctcatgggctggatacagaggtaaggggaagacagggatccaggctgacttgtagactttgggcttgagttgcatggtgagtggctgtggggtggggaagttggtgagagaagagctttgaggggaaaatcaggaattgtgtcctggacatgctaagtttcagatgtctgtgaagcatcaaggtggaaatgtgaaagaagctggccacgtgagtctggaattggggggtgcccagggctggagatacagaactgggagccagtgtgttgggttgggtcagtgctgaatgggaggaccaggggctcagagcgtggcatcggaagaaagacttcagaggagatacagctcctggggatggctggtaatgagtgatggacacaggagcgaatggccggggctggagggaaagatcccgaaagtaaactgtcagggaactgtgagaccagatgctggaggggtcaatcctgtggatgttgatggtgccaagaagggtgacaggggtaggcccccaaaagaagactgaaaacaagaactgcatgttcacaaagggaggtgcctccctgcaaatgttaaaaatgcctgctgctgttccccatgacagtggaggtgggggctggtgagaaggaggagagacagttccagatggaaggattcgggggcgtgagagcaatgcattctgggggagtcccagggtttctaggatgcaatacggcagccggggcagaaaccagatgggaggctggttgggaatcttccagcttttgaatattgctactaccagaggaggccgctttgaagtcatgcaagcctgttgggacaggatgtctgcagagcctgtgggagggaaggggaagaaattcctggaggaaggcagatgctgagaaggaggggctgcaccttctgaacaggcaccatgccgcaggaagcctcagctgcgggagacaaagcacgcaggccatggcgcaggccttgcatatagcagggcagcctgtgcatccagcttcctctagctggggaccgaggacatcatcactgtgtacctctgcaaacctctctggaggccaggggcttgtaggaggctttgccctctgatgggatggcagctgaagccccagggaacactgctcccaagctttcctgaatctttaggtaagattcaccaagaacagcagtacctgctgctgagacccttcatagggttgctgcaggtgactgagaaagtggatttctctggaggctccaggttgagggagatggtgcccaagacttggtgggaaccaggcagaggtgatgatggacacatgccaggaggaggccaagggaaaggatgaagaagaggccctgggttctaatggcacccacaccacacaagggcctggttagcagccccttttcctcctgttcaaggttttttagaacatctgtatcgtttctacttaccacggacttgcgaatgctaacgcggggcttggggatgggtttggagggtttgttttcaaagctttctggaagtgtggaggagtgtcccccttttcttgcttgtagtgctagctggtaagcgacttcgaatgcctgtcccagggttaggatgatttcataggctaaattctgcaagaaaaatgagaaagcatttgctactggcacactgcaaattagaatgggtcgaatggctgaggaacactgagggaggtgaactagggaggaacttgaactacttcaccagaggcagcagcgattcggtggaaatctacaaagaacaggacactccgggtccaacttagggtttacaccaggctttagtcatttgtgaaaagaaaaatcttgggacctcaaatcactaagacaaacgaaaaagtcagctgggaactgtgttgggcaaacctgccttgcattctattcctaaataagatagctacaaagataaaaaagctacatacctccctcacaatttgcccaaaaggaaatttcctgtggacaaaagacagagctcaaagtcatgcctctgctcatgtgagataaatgcatatcagattgcttcccctgtcctgttgtttccctaagccagactaaggcataagtgactattcctgtaaattgtgtattcagtgaaaggctgatcttcagaaactcaaaataattcaactgtttgtctcttatctacctatggcctggaagcccccttcccatttctagttgtcctgcctttccagaccaaaccaacgtacttcttacacatactgattgatgtctcatgcctccctaaaatgtataaagccaagctgtgccctgaccaccttgggcacatggtctcaggacctcccaaggctgtgtcacgggtgcattttttttcttttttttttttagatggagtctcactcttgtcacccaggctggagtgcagtggcacaatcttggctcactgcaacctccacctcccgggttcaagcgattctcttgcctcagcctcccgagtagctgggactacaggcacgtgccaccacgcccagctgatttttgtatttttagtagagacggggtttcactatgttggccaggctggtctcatattcctgacctcatgatccacccgcctcagcctcccaaagtgctgggattgcaggagtgagccaccacgcctggtccacgggtgcatctttaagcttggcaaaataaattgactgagacttgtctcagatatttttggtttacacactgatagggcactcttgcttacagatccccagttagccccaggaggagcaggccccacagcccagtggccccaggagcccacaccattcaaagctctccctgtgggcagttggtttgtccccaaggccttggaaggtaaggggttactactggtatttctgctgagtcctgggagcacttcaaccttgcctgtgaggatgatcccacacactccacaggaggtgttcctgagaagtttgggtctttttacctcaaacatctgtgattcagtgaacatctacgaaacacaatcaaaatctaatttaggcctagaggagaggcattagtcatgctggtgtggcggctcacagtcgcagcagtgagcacgcaaacagtgctccaacagagccaattccccagctatttcttgaggcttttgctctccctgtgggtccactctatattttatcatgaaatcagcaagagacaggtgattctgtcaggctagatgccacgccaagcagcgcctgggagaaaagttcttttcttccgaccttcaatcagtccttttctcaagatgatttctagctttcttctcttctccaaatgtgtatctttgatttctgccttttcttccaagcacagcttccccttgtcttctctcactgagaaaccatcacattgtctgacccaaaagaggcagggtggccaccacaccctgaggtcacagagcatcagagaagcagatgcatactggtcacagagagtgttctgaaggtcactgtagcagctgagagcaggcatggtctgccccaagctttcttttttcttttttttttgagacagagttttgctctttttgcccaggctggagtgcaatggcacaatctcggctcactgccacctccacctcttgggttcaagtaattctcctgcctcagcctcccaagtagctgagattacaggcatgcaccaccatgcccagctaattttgtatttttagtagagatggggtttctccatgttggtcaggctgagcttgaactccccacatcaggggatccacccacctcggcctccaaagtgctgggattataggtgtaagccaccgtgcctgaccatccaagttttcattctgatgaatgtccctagaatgtccactcacggtttctcaaaaatcacagaaatgtcattctgctgatgctgatattgcaactaagctggccctctctgttcctgcccatctccaccctcatcaagcgctctgggagcccgattcccacactgctgctggggagatgtgtttgcgattgttcgcatttgaagatgatggagaggaagatgcaggatggtgccttctgaggccatgggaaagaggcccaagggttctagaccaaccagattccagatccatgccagatcaattgtgatggtctcagaaccaagtggggaaaatgcctctgagcttgagagtcggtttgagagaggatgtgtctgtctcctttaagtgagttgctaggaaatactgaccctacaagacagacatctgcctgctggagatactgcaccttgcacagcaagctgagcacttccttgcaacgaacactgagcccatgtttgcctccagagatgagtcagcctagtaaattagtaacgcaccagcaaatgatagtggaggaggtctgggagacagctctgaccatcactgcacaaagagggctgagctctttccactgcctacacttggcactcacgtcactgtcagctttgcctcttagtgtttgcgtgggtcccctctgaaaggcaggcagggcttccgacttctgtagtctcacaatgaagacacaggctcttggtcttgttcatgctactgtggaagatggctgattcccatctgttggggacatgtaccagatattcctgttctgggtgggaaactagactaagatgaaggtgtgagattcagtgattctgtaacatgtggtctttatctgctgtaacagtggaacttaatgagtgtgaattcctttaccattaacctaaaaacaagttactgaaagcgagatctacttaaagctccaggatcttcaaaggaaagtaaaaagaccttcatttgagcaagtgaggtttttcacatgattatgggaagcctaaaggttttgggagagaatgtgttagaagtcctgccctttcatttttaattagttcctggtattaggaaactgctcaaataagacacacagaccagactgttggattaagttttcctgcctaatggcttcttctggttccgcttacattttccttgacttcttgctttggttttattttagaatgctttgtcaagtttcttttgtgattatgtatagtacaggattggacactgttacctttcctctcttgtctgcagccctcctgtttgtggtactgatgctggatgccaggagggcccatgggcaccgagacacaccttccaagtgctgtgttgcccatcccgacacaccagggccctttcggggaaacagatgctcatcccatgggacctcaggacacatgtgtgaatggggaaagaacccccatttttttgtaggttcaattctcctgcctctcctattaacatccctaccatctgaaacgggaggagagttgctatcatgtacgaggagactctaccgggatgaggttgaaaattatattgtaacatcagaaggcttaggtgagaagcccatcttgcaaacctcaatgatgctggctggctctgaagagcccatggtgacacccagaaaatctgaaagcccaactgtctctgccttcaacatattatccctgcaactgtggggaggccaacgcctggtactgggtctggcacattccaggtgcagaagaaatgcttgcttgcttgctgaatgaatgaatgaatatccacaggactaactggagtaatcgtaacatttctagttaatactcagtctagctaccattaagggagaacttaataggtgtgagagatgtgccaagcattatctttgtttcatttaagtcttaccaaatcacatgcagtagcatattatcctcattttatagatgaggcagtggaggctcagaggggtgaaataactttccagacatcacagagacagaaagttacagaacttgacatgacccaatatctgtgctcaaaatcccccactcttggcccaacccatgtgtctacccagcttgtctctaagatgactgccatcaactctcccctcccgtgcacaccatggtgttcccctgttgagaagtcgaatctgctctttgaatctggactggttttactgacttgcttgacccataggatatagcagaagcaacatgctgaatttgtgaggttgaatcatgaggagtcttgcagtttcctcctgggcctctaggaacattactctgggggaattagtcatgtaaaaagtctcaccatcctggctggatgcggtgactcacgcctgtaattccagcactttgggaggctgatattgtttagctgtgtccccacccaaatctcatcttgaattctagctcccataattcccacgtgttgtgagagggacctggtgggaggtaattgaatcatgggggtgggtctttcccatgctgttcttgtgatagtgaataagtctcacaagatctgatagttttataaatgggagttcccctgtacatgctctcttgcctactgccacataagatgtgcctttgcttcttctttgtcttctgccataggcctccccagccatgtggaactgtgagtccattaaacctctttcctttataaattacccagtctcgggtatgtctttattagcagtattagaacagactaatatagaggctgaggtgggtggatcacttgaggtcaggagttcaagaccagtctggccattagtgaaaccccatccctactaaaaatacaaaaaaaaaaaaaaaaaaaattagccaggctttgtggcaggcacctgtaatcccagctacttgggaggctgaggcaggagaattgcttgaacctgggaggcagaggttgcagtgaaccgaggttgtgtgactgcactccagcctgggtgacagagcgagactccatctatctttttttttttttttttgagatggagtcttgcccttgttgcccaggctggagtacaatggcgcgatcttggctcactgcaacctgtgcctcctggcttcaagggattctcctgcctcagcctcccgagtggctgggattacaggcgcccaccaccacgcctggctacttttttgtatttttagtaaagacaagatttcaccatgttggccaggctggtcttgaactcctgtcctcaggtgatccatccgcctcggcctcccaaagtgctgggattacaggcatgagccaccgcacccagctgagactcaatcttaaaaaaaaaaggaaaaaaaaaaaagttcttgctatcctgagatcatcatgctatgagaatgcctgagctagccacaaggagaggctgcctggacaggaacaacggtttcagccaggccagcccaggctcaagatttgggagtgaaggggtctcaaagacattggagctccagcagacatcgcttggagaagactcaagacccagacagatggctccagtcgggctgccccagcatctccagccattgcaggcactctggctgaggccccagatgttgttgagcaggactgccacgcccagcccagatccctgacttacagaattgtgaacataataaatggatgttgttttatattttggggtggtttattacgcagcaagagataactggaacaccatgcgatgctgcagaaggctggttggaccctcattcagacaacaggaagatgacccatgagcccaggagctgtgatgaatgctgcttagccaggaggccaatcctggagccacccggtcccctggctgccctggctgtggggaagctcactgatcacagtgagcactaaggtgtcccatcccatctgctggctcaaaccactgtgctgcagtgaagtcagcaaaatcatgctctcatctccagttactacctcccttgggcataaattcaaactcatttagttttacttttattacctcacgtctctcgaatgctgtaacctggcctgtctccgaccttggctcttcctgtctcatataagctcattggaagatacttgctttggtctttctagcataagtcttttgagacacatttattacggcgattggtctggagtattgtctaccttacagagaccaccagtgaaagagagctgcatgtgtgtgcatgtgtgcacgtgtgtgtgtgtgtgtgtgtgcacacggggtgcaggtgtgagggttgattactgaaaacagcatactctgagccttggttttctcatcttaaaatggggataataccatacgcagtaccccctaactggattgttctgataatggctaataatattatttaaccaaatggcaataccggctagcatttattatttactatgtggccatgcaccatgctaagtgcttcaacatgggctctttaattcaatcctaaccgtatctgtatgccgtaggtctattacttccattttgcacatgagataattacgctcagaaaggttaaataacttgctcatgaagtcagcacccagacaaactgggatttgaatccagttgttctttctgagaggctatactcttcttgaccattacaccttaaaactatacataagataaaataaaaaaaattctgtaatctgttttaaaaagtttaaaaaacatgtgagccaattgagcttccaagtgactgacccatcttggctgtggtgaggtcacctactggcccattgcctgggtctcatgcccagtctggctgagaggcagcctccaggccgggggtgtacttcgtgactccacagagaccatcaacacaggaattcttcatctttggcttccccaagggtgaggtaaaagatacgaggcaactcccatcctcagtagtggctatttaggaagaagggtagggagtcccagtccaatggggaaaaacctcctggaaagcacaggaattcccctcttcccttcccttctcttctcttcttccccagggatttttcttttttcttttcttttcttttccttccttttttttttttttttttgagatagggtctcactctcttacctaggctggagtgcagtggtgtgatctcagcttactgccatctccacctcccgggttcaagtgattctcctgcctcagcctcctgagtggctgggattataggcgtgcacgcctggctaatttttttttttttttttatggcagagatggggtttcactgtgttggccaggctggtctcgagctcctggcctcaagtgatcctcctgcctgggcctcccaaagtgctagaattataggcatgaaccactgtgcccggcctgggattttgatctgcgaattaagaactgctacattagaggagcttaaggaaccactgtatcataaagataaatcctaaggcaatcaagggatgcaaactcacttttcttgtgcaagctgaagatatgcaggtcagcttatatttactgtggtttcttcaaggcaatcatggatattgaacatcaccacagatatttaccaagctccttccaagtgttaagggctgtgtccctggtgccagtcccatgcctagcctatagacaatgtccaggaagtgatcactgaatgacatgggggagtaaaagtgtccatcaagactctcattacatccagaggaggctcatggagagacaaagagatcttcctcgctgtcctcccgcatccttgtccccgaggctatacgcagcatattcatcggtctagtatgagaaaaattgcatcatagatggtgggcaatctgtcccctagaaaaagctctagccaccaaggtaattaatttattttaactggtacatcactaagatttttgtttcttagtttgaaaatctcttaggcacaagggttcactgatacatgtgcaaaaatattcattaaagtgtttaaatttttcattattagaggactgattaagtagaatactaggtagccatttaacatgaaaactggaggcgggtggattgcctgagctcaggagttcaagaccaccccgggcaacatggtgaaacgctgtctctactaaaatacaaaaaattagctgggcgtggtggtgcacatctgtaatcccagctactcggggggctgaggcaggagactcgcttgagcccaggaggtgaagattgcaatgagccgaggtcgcaccactgcattccagcctgggtgacagagtgagactccgtctaaaaataaataaataaaataaataaatcaataatgggttaaaagactacgtaaaaatatatgtatacatatacacatagataggatctgtatatatgcatagaaaatagcaatatggatcaaatgtgaatagtagttatcactgcgtattgagactggatgatttctatttttgtattttggaactttatttaaatgaggattaatgatgtttacagtcataaaataatctttccattttgataattaaaaacaagagaaagtcttttgcgtttaaaatagtcttattcttgctttttttttttgagacagggtcttgctctgttgtccaggctggagtgcagtggcacagtcatggctcacagaaagcttgacctcccaggctcacatgatcctctcacctcagcctctggagtagctgggaccacaggtaatgtgtcatcacacctggctgatttttgtatgttttttagagacagggtttcaacatgttgcccaggatggatcttattctttctgcatcaccttggggttctgagggtctcttcattctctggctgagagggctgggaactactttccagcaaaatctggaacctctctgcaggtgctgtcatggctcacctctatgtgccaggaagctgcccattcatttggcaaagaatcttgtttaggctcttcagttttcatactggatgccaattctaacatcttctcagtgagactttgaagtatcaagctcttcctttaagctgcaaccctaatacttctactccaagtgcggaattgaccctttaatggtccaacttctgccaagcccaagtgaaaaatgttgttacgtggatattaacttatagacatgcagtcaatccgctcttgtagctgtgcaaagtttgatctctgcacgaagtcaaactgcctatgaacttgaactgtattttatttcctttcataatgatgataaagcagtggcagcagcaactacacatgatattgcctactacatcctagggacgaggctaagtgccttctgtggattgtctaccccttacaacaccttacagaggaggaatgaccatcctcattttacgtgtgagaaactaaggatcagcgaaattgacaacttggccaagttcatacagcagagccaggattcaagtgcagatctgacttcagattagccagtgtttcatgccactgggctatcctaccttcattgctctcatgaatgtgctggtcttctgtgcctatttcattgaggcaccctctagaacaccatcttgtgttttggagattcactgtacaaatgttggtgaagacattattacacagtatcccctcatgggggcctaggacagaaagttccttcatacttaagtcttattaaaatactattttcggaagggaaggggtatacttttctttcaaagaaatatgcagcataaaattactgcatttccctttttgccttgacctccaggaagctcagagctaaaagctcagagctagagagagcccagctcccatacctttccacaactccatggtctgtatattgatgctacaacttttcccttgatatggagcttccttttagcctatattttccctaattcagatttgtgtgtatgtatatatatattttcagactactatacctattcatgtaggctgtcttcaatccgttatggaatgaggcatggtagaaacactgtccatttgttcacttagatatttattccaggacttactttgttgaatgcattgctgcccaaatggctgacaaggtatgtcaggcataaagcttcatctcatctggcgaatatgacgaaggagtaaggaatctgaggaggaggccatccagggaggaaaggccctcctgacccaggctgggaggctgctctttctgagtggaccattttgacctgccttgcagtgctttgcattaccattagaaacacaatggccacattttcatgactggaatggaatgaacaaatgtattcattccatagcatcagagagctgcaggcccagacaggggtcagcagaagctcacccacaccatgaagagggcacagatgcagacacgttcaagggaagggctgtgtctgtatgtgggagtccagggcagaaaagcttgggtgtcataaagtaccttgagatgtctgattgaaaagtgtctatcagtgaatagaggccataaacagagtccctggatcacctgcataggccagctccaccatgggctacctacctacagcacctattgccactgagaagtgggtgtggtccaggtgacctattggtccctttccaccctgggagtttcaggattctctgattagaaggggctatcttttacccagtcaactacagattcagtttagagatgcacgcacagttgatgctgtgctaaacagtggcatgttacccagaggccagactgcagggctccataacccaccagctagagctcagagaggcagtcaccaccaacgggctgcccttcatctcagaaaacaccttcattccagcaatcacccctaaatgctattccaaatggccaagcatttcatctattacaaaatggatttgttcttggcaatacatgcgtttgccatctcccacctttgcctggtgagttactgcttatccttgaagactcacctcgggcatcatatctccagaagccttctttgaatctcctttcctgtcctcccaaccctggctaagttaggtgcccctcctctgcggtgccacaataccttgggcacagccctacttaccacgtggtatttattatgattttctccttatagggctgattcccccagttgactgagctccttgagggctctggtctcactgggctttgcatctctagggcttagaataggtcaggtgctcaagaaatgtttgttggctaaacacaaaaaggaagttgcctggtaggtccctaagataagggaacttgcaccttaaggttaagaaaagggggaatatggatggccagagccaattccttccttctgtcttctctcccacaggcagacctgaagaacaaaagctagacaagtgcagataatgccacagggggcctgaagacacaagaaggtttttttcaatctgggttctcagtggggtctccagaaagaagcgacatttctttttaggctatattttgcttgtacttgtttttttaagacctggggtaagcctggtctacaacttgcttcacccacgtccggaggcaaaaataacttcgagaatattctgggcatattcacagacttcattgacatctctttagctctacctatagttagttctctcaagtaccagccagaaattagtcttcatagattgtacagaaataaatagtgcccaatcatagccttcagcatttagaaacaaatattagcaattctgctaagatgtctatctggggcaagatgacaaatcaactggccaaaatgcaggtagcttctttagggctaattttggctaactaaaagagccacgagattcctttatctccctaattataacaggggcagatgtagaaaattttgaaaatactaagaataaaggaaaaaataaaattcagctgtgaaattccactgttgggatatggctactgctaacatcttggtgcattttctttttatatttgtatatacacccaaatactttcatttcctatatgaatatttaaatatgaatttaaaaactagaatactttatgagtctaaaatcataacatattttatgtgcagtctcataagttccttttttgcgcaacattatctcatagttggtcttcgcatgccattacacgttcttcaaaaaccagatttttaaagggggtgagcgttccactgtatctgctgaggtttaactttatgcctcaccccaagtataggaggttgggccttactttgttaaaccacaacttgctttcttatattaatagcattccaggttccctgtggatgtcatgcactgcagcccaacacactggtcacctgtcttcatggaaccacagcctaaggtggctggccagcagccctgtcacacccatccagagggactggcctgcctgggaggaagaaacatgcaatctttatcctgtaacttggccagggtttgtgcaaaggtggtacaggaggaagaaatgccagatttcaacctctcccctgctcctcaaaagaaaaagctccagtggaagctgtagggaactcttcactaactttttgtttttttcaagacagggtctcactgtgttacccaggctggagtgcagtggcacgatctcagctcactgcaaccttcgcctcctgggttcaagcaattctccagcctcagtctcctgagtagctgggattacaggtgcctgccaccgtgcctggctaattttttgcatttttagtagagatagggtttcaccatgttggccaggctggtcacaaactcccaacctcaagtgatccgcccgcctcagcctcctaaagtgctgggattacaggcgtgagccaccgcgcctggcttcttcactaacttgtgaggcattggacatgggtcactcaccagattcaaaccttttaaatttgaacccttgttgtttaaatctttctcaaatggatatgcctgtttccttggtttagtcagcacagcaaatataaatggcttttcctttacttattgcagatgcctacctgataccctgagttcactattctaaattgaattaatgagttgccgtgcctccaaaccgaccacgtgttcactcacacagactaagtgttcagcttccaacctgcgcgtccctcctcttggagagcccaccctgctggctgctggtgcagtgcccgggtggcatggatctgattctgttgtaactatttgcttgtgtcccttcatctcctgctggaccatgagctcctggagagcagggatgtgtgtctaatgcatggcaggcactctatcaatacaggaatgcattttatgtggaatctgacttttttcctcagatgtggaagcacgcagcaacaaacatatgtcgtgaatcaaaaaccgggacataaagcctcacacagggtctgacaagaatataagcatcactattaactgcttctgctattctctgtgtcctcggcagctaagagttattgaataccatgtgctggaaatgcgtatgtgtcaccttgtttaatccttgcaatcaccataggaggtgtcctattataatctctattttacagattaggaaactgaagactagaggcattcttttttattttttgagtcagagtcttgctcagtcacccaggctggagtgcagtggcaccatcttggctcactgcaacctctgcctcctggttcaagtgattctcatgcctcagcctcccaagtagctgggattacaggtgtgtaccaccacgcctggctaatttttgtatttttagtagagatggggtttcaccatgctggtctggccagtcttgaactcctgagctcaggagatccacctgcctcagcatcccaaagtgctgagattacaggtgtaagccactgcacctggcctttatttttctgagacagagtctcatcctgtcacccaggctagagtgcagtggtgcgatctctgctcactgtactcactgtaacctccgcctcccaggttcgagtgattctcctgtctcagccttaggttcaagcagttctcctgcctcagcctcccaagtagctgggattacaggtgtgcaccaccatgccaggctaatttttgtatctttagtagagacagggttttaccatgttggccaggctagtctgggactcttgaccttaggtgatccgcctgccttggtttcccaaatgctgggattacaggcatgagccatcgtgcctggcccatggcattctcgcccaaactatgaagctaagagtgcagatctgggattcaaaaccagactgattctaaaggccaccccctgatcatgacacttgactgccagttatttagaagtggggggtgcaacaaatacatgcataaatgctgcaaagcaatctgtgaaaacaatttcagaatgtctggtttctaacttcacaaaaaatgggattaatttaaggcactgaaaactttgtctccccacccccaaaatagggatgagaagatctctgaatatccaaccacctttgtctttgtggcctggttagttctcagtgatttatgccaatggagaggagatctggataaatgaaacccagcactgttaatttatctattcttttttgggaggtggtggtgttagtgtagaaggaccattggaatgcgatgctgtcttttttattccatcagggccatttgctcctcttaggagctgcgtccttcctgcagctgacttgctggtgagtttcagctggctggacagggccagggaacggcttctcttttacctgtaggttgccactttgtatgcagaagagtaaccagggaaagtgttcgagttcaatttttaagggctctatgcattgtgacattttcttatattgccatttcttttcacagtatcacagtcaaataggttgaagtctattttcaggtggagaaaatgagaaacagaatgagagagatcacccgcctccatgatattaattcaattgtcagaggtgaactaacatcaataatagcaagagttcttttgcatctttaagttctcactttgtgggacaatctctgcaacataagccataaatatttttcttcagggacctcaaactactccatggaagtaatctcggcatttaaaaaagcactcaagaatttaaatttttctttcctttttttttgagacagagtcttgttctgttgcctaggctggagtgcagtggtgcaatcacagctcagtgtctcctaggcccaagagatcctcccacctcagcctcccgagtagctggcactacatgtgtgtgccaccatgcctggctattatttattaatttttttttttttttttgcagacatggggttgccctatgttgcccaggctggtcttgaactcctggagtcaagtgatcctcctgcctcagcctcccaaagtgctggggattacaggcatgagctactgtgcccagccaggaatttaaattttattaaactgatgagaaaaccaacaagcaaactcatagcagagccaaagttggaagtggtgtaggtatcactgatcacgaccacgtggttgatgctagtgtttttcttgccccacactttggctggctttgtgcatatggatgggagagtactacagaaggtgatcacacagtcggatgaccatgttttcctgcgttttgtcacttctgtttctccagcttagatcctcacatggcccacattcagccaagaaagcacagggaagagggagctccgtctcccacacgtcccacccaccctgcaccacgtcttcaacattctctacgcactcctgagaccgtctcagcctcgccatgtgctgcacaccgaggagcacaggatttgggagttgcaagtgaaaaatgagcatggttaaaaatatcaaagactgcaaacatattcttttcagaggagtgagaattagcaagggtctggcagcaaagccatggcttttaatgctattaaaaaggaagaacaccttttaacatttaaaactattgaatgaggctcttctcagatatttgatacaaatctgatactcccatggagaatgcatcaaaatctttctatgttgacttacatcaactctctattactgagaaatctagagtaactaagcaaataaaatacagaagacaacagttttgaaattaccttggttgtctctctctctcacctatagtggccttttgaggacgatcacttcagcctcgggatctggtggccactgaaatacccattccctctctggcagtcccatttgtgtagaattctctccactcatttaagagcagaggagagaaaagctgagtccatttttaactctcacaactcctagtctcataacacatccttcttttctgctcaccctacagttccctcttccccaagttctcactgcccagaaggtggagtttggggaagcttttgttctacagtgggtgagatgtgtttcaggcctagcaagttagggatatgattagaaatcagctatgacaacaacgagagcatagactccagaatacagagcaggcttggtgcttgcttgtgtgtatatattggcttttttcttgacaaccctaattctgttttgctctagtctttttattttcatctccccatcatttaaaactgaaaatatcacaagctgaatttatggtagattccaagcaacaaaagcaggcttagagatcatcaaatgtaacattttccaaaatgtgttctgcagaaggccacccctgtggggtgctctctaaaaaaaaaaaaaaaaaaaaaaaaaaggccgggcacggtggctcatgcctgtaatcccagcactttgggaggccgaggcgggcggatcacaaggtcgggagatcgggaccatcttggctaacatggtgaaacccggtctctactaaaaatacaaaaaattagccgggcgtgctggcgggtgcctgtagtcccagctgctcaggaggctgaggcaggagaatggcgtgaacccgggaggcggagcttgcagtgagcagagatcgtgccactgcactccagcttgggcgacagagcgagactccatctcaaaaaaaaaaaaaaaaaaatggctaccatggccaaataagcttaagaagccccgcacactccacccccgcctcacatctgagcacattcagggccctgcagagtcccatagtacgtaaactatgttaagctcacatcctagcttctgtagggggggctccaggcctcctttctcggactacaatttctatgagaaaatgctctgaacttcaaatctaactgtccataaactggaaacttcctagacatcactgaattttcttgatgatatcagataaaaacatgggatatgtgataacagtacataaaaacatgtgacccataaaaggtctttaaggtccaaaaagcagtaacttcacaattaaaaatgtatacatacttatttagctaaaaggttaaatgtgtatttgaggtattatagggtcttctttactttttttttttttttttttttttttttttgccatttggggcagcccaggggactgattcatatcaaaagaattttaagccttcaagactggactggtattgaactgccctacataaggatacaaaatccatgctcaaagaagctttttttagtgcaagtgaagcttgttgcatctcagaattgctcaaagtcccaggtcaagggtggtggcctttgttactaattttgaggtttgacaaactgttcacctggagaagattaaaatggaggatctgtgtaagatgaaagtcctttggagctggtatgagaatcctaagctagtaatgtttacattaaatcaaacatctggatgaaaagataaatgttaaggcaattctctacatgtttttctaagtgtatcagggatataacgttcatcataaaactaaacagttgactatttcttcccccaacatttcacctcagtattctggtgatatatatatatcacacacacgtatagctaataaactcaagggggcagatagtccacagaaaccagttttagtttcatgtggaaaaatactttagatactctgatgaaggcaaattatatattaccttaaaaaccaattttattgaaagaaatgctgcaatacttaggaaaaaggtggcgttcatcctgaaaagtatcagaatattcatgttgatgttcaatgcaaacacggtctagaggcagcaagctctgtggagtcaatgttttctttctgctatttctattttaatgtttatttattgctttcactttttcaatcctttcgtaatggcagtaggaaaactttggaagataaatacacatctgacaaacctatcttatgtcttttagcagaaaaagggtcaggctgttaactgacgtcagcaggcagggagagggaggaggtgaaggaacaaatgctgaacacctgttatttatgaagcactctacatatgttctttcatttcactcctggtgaaaacctgcaaggtagaaactcttgtctctgttctctagctatgaaaattaggactgggaaaagtccagcaacttctctaagaccagagagtagagagatagctgatttgggatgtgaactttggtattccgttctttctatgacatcaatccaacccctatagagaaaggtatttcacataaaccaaaatagatgtgaacaggatgaaatttgactgtataaagaaacaatcaaattttacaagaattgcaagttatgtttaaggcaccagaaacctaacactgcacatccttgtaaaccctgaatgaaatggctttaatcaacactttaatcccgtgcaaacaaacgcttcctgagatatttagagcagtctcgcagggctttgctttgcagtctttactgttaccacagactacttttatatcactctcctcaagcctccccaaatggaagggtttgtttttttttttaaaggcccatgatcattctttcccattttcaatctttctttaaaaaccaaaaggggtgaggaacatgtagcatgatacaaatgctctgagcatgaactgcctgactcacggaccttaagctggtatagattttggattacagttggccttggcctataggtgttcatcagaactggaaaacattgcttcaggcagtcttctacccatgacattgaactgggggctggcctctcacgaatatatgaatacgtgattcctgattctttaaatatgtatatttcaaacccagtgagcagagcagaatcatcaaacttaagtggcattttcaaattcttctgattataaattattaatatactatatcagagatatcctcaagcaatttgtaccaccttgagggcatatcaatcttaaagaaacatttgttatttcctttaattgtttccattttccaagtttgtaatatatgagctagtcttttaggtttaatgacaagtatggctataaatggaagtggtgtaatcccataaggatgtcattacaagaccaactttttttttgagtgacggtttcactctgtagtccaggctggaatgcagtggcacgatcatagctcagtgaagcctcagtgtcctgggctcaagggattctctcatcagcctcctgagcaactgggactacaggtgtacaccaccatgtctggctaatttttttttttttttttaatagggacaaagtctcactatgttgcacaggctggtcttgaactcctgaactcaagtggtcctctcaacttggcatcccaaagtactgggattataggtatgagctgtgcctggccaagagtaactttttttaaaaattgagacagggtctcactctgtcacctgggctagatggcagtggtgtgatcacagcttactgcagcctcgacctcccaggctcaggtaatcctcccacctcaccctctcaggtagctgggactacaggcatgtgctatcacacccagctaatttttgtttgtttgtttttgtagagatggggtttcatcatgtttctcaggctcatcttcaactcctgagctcaagtgatctgcccacctcggcctccaaaagtgctgggatttcaggtgtgagccactgagcccagccaagactaatttctgaatgagcatatgggccaaatcttggagttcccaattaccacctgtaggtatctgatctgactcctattcaatatagaagactgcagatttgtatgaggcaaacacacctattatgccctagtacttagaaatggctactagagaaactgacagacatagtgagggacaaggaggctgtaagacctttactatgttttggtgccagagaaacaaagggatttctcaagtctgaaagtgaaattagtaaatgagtaatggcagttgagatactaggtagggctggcattctaagttgaatggaagaatgaaaatatcgaaaaatctccaaacagcctagtctgccaaaatgtacttggtgttatgagtggaactgtgacccacccaaaattcatatgttgaaggcttaacatgcagtaccttaaaatgtggctgtatttgaagatagtgccctgaaagtggtgattcagttaaaatgaggtcattggggtgggccctgatgcaatctgactggtgtccttacaagaagaggaaatttggacccagacatctaagcacagaggaaaggcgatgtgaggacacagcaagtacgcagctgtattagtcagttctcacgctgctaataaagacgtacccaagactaggtaatttataaaggaaaggggtttaattggctcacagttccacatggctggggaggcctcacaatcatagcaaaaggtgaatgaagagcaaagccatgtcttacatggcggcaggcaagagagagcttgtgcaggggaactcccatttataaaaccatcagatcttgcgacacttactcactatcatgagaatagcacaggaaagacccacccccacgattcaattacctcccactgggttcctcccatgacacatgggaattatgggagctacaattcaaggtgagatttgggtagggacacagccaaaccatatcagccgccatctacaaggcagggagagaggcctcagaagaaaccaaacctgccgacacattggtcttacacttctggcccccagaagctgtgagaaaatgaatttctgccatttaagcctctcggtctgtggtactttgttatggcagccctagcaaacaaatacacttggtatgtatcttaataccgggtaaacaagccaagctagtgtgttaattataagttgggctttcaatacagtccaggcccattctgcaaagtctttaatctgttgaaagggggtgggtactcaccacatcaaaggcagtaaacacatgacagtagtggtgattagacttcaaatcttttgtgatataggcaaatgttgagaggtcttctgggtcctgggcagcacaggagatattacgaatttcatgctcagcaattatgttctggaagaaatgacataaatgatcattgttttcctctgcgaaccagcatatatgacaaccaagacaagtaacccaggaagcagttgctttccttctttctggagtgttctagactagcaacactcaaagtggtccactatattatttgtgggtaaatgaataccagatatggaagaaatattttcatttaattaaaaacaacctaacacagtcatatcctggagctgcagttctcaccagttgctgtgcatagaagcagtctgggtggcggccactttttttttgtttgtttgagacaagagtctcactctgttgctcaggctgaagtgcagtggtgcaatctcggctcactgcagcctcccgctcccaggttcaagcaattctcctgcctcagcctcccgaatagctgggactacaggtgcatgccaccaggcctggctaatttttgtatttttagtagagacggggtttacaccatgttggccaggctggtcttgaactcctgacctcaggtgatctgcccacctcggcctcccaaagtgctgggattacaggcgtgagtcaccgcgtccggcctccactttaaaaaataatagtaattactaagcatttgactgtttccattccccatgtccacctgtagctgtgcagcactgctttctgctaattctgtatggaggggagcatctgtcgctttctctgtatgagaagagatctgacccaatgaggctcttcaaatccctcgccatcatgcttgcacgttgttcttgtgtcctgctcctcctccctcagagcaagggcaggtactgaaggaagcaggcaggtggaagcctcaaggtgctttctccgtggaaactaaggtgcaggggcctgataagagaaacaccatactgcaagattcaggccttggatgccttgcttgatctgggccctgtggctatattaacaacactttcctaactacatccactgtgtataattaggaggtggtgctgttgctaccattatttacaggtgaagcaactggtactcaaagaatttaagtgccttatgcagagcaggtgctggggtggaactgaaatttggggttgtctgactgtggagctcaggctctttgaaatgcattgcaatgcccttcaacgtctccacctccctcttactggcttaacaagaattgagttatttcttctctagcatctctttgtgccttcttccctggtgggagaaaggtttaagtaccattgtcctgaagcacaaaataaccacgaagcagcttggctgcaaaccctgctagaaacttcttttgatacatagatgtgtttaaaaagaaaaaaagaaaaaaattcacataatcttgcaatcattttcttatcttataatatcccatttatgtttttttgcagttgtcacagatctaaaaccctcgatgctttagttactctaattactttttaattgcgctgtcttaaataacctgttggcaatacagtgttccgtgtacagccatcaatgcctaaaaatgcttacaaaatgtccttccctgccagcacccccagcaagtacttcatgtccctcactttaccaagctgagtggttcggaggcaattacagaattaactcacaaaagaaaattaaattaagacatttttcaccgtggccttttgtgttgacattaatgcagtgctctgtcaaaaaataactcaaattgcaattggaatcccataaacaagtaacattctattgcaagataagtttcagactagaaggtgatgatcctcttctggcatccagatagcattccttcaagtagaaaaccaaattagggatgggtgagtcttaaaataatgttaaaatgagaaaaaggtgcaatgtgagatggtgtgggaacctctgccattatcttgattgggggcagccaatgccctgggaagcctgggtggatttggtctcacttgtccaggaggcactgtcacaggaaataggtgcttcaacttttactaagttggcattttgtgttcttgagatcttttgcaagatctcaaggtagatgcacttcttgggaaatgaaaagtgctctgtgatttttattgcactgaactctctgaatcttgccaactcatgggatgccactcttgacaatttccaatggtgcacggcagcactgtggcctgggggaaagttgcaaaggaggaaaagtatatctttggtactctctcctcctgtgtctttgctgacccctgaattttctggagccctcttcttctctttctctctctctctcttttttttgagatagggtcttgctctgttgcccaggctggagtgcagtggcaccatctcagctcactgcaacttctcaggctcaagcaatcctcccacctcagcctcctgagtagctgggactacaggcatgcaccaccagcctggcttattttctgtattttttttttttggtagagaaggggctttgccatgtttcccaggttggtctccaactcttgggctcaagcaatccacttgcttcagcctcccagagtgctgggattacaggtgtgagccactgtgcctggcccagccctcctgttctctattccccaggagcccaggactgtcttttagctgcccagggaggcctgacctctgtgatactccatgttccaaaatcagccttctccccgactgtggaaacttctactactctgttcccattgtctaagctataaggaaagctcatgctagttaaaatattctatattcaggtaggaataactcatcattgtggtcatcctaactggcgcttaaaagatgctcttgaatttgtattgatagcctgcggaggcaggtatttttgaacagacctttgtgatatattgccaatgctagaatggggtaaggtcctgggatgtcactactgaaatactgccatcactctgcattgtctacctgtgcagaatggtgaagccagttctctatgtgcaggacgaatcaaaggtcaaggatactacagttgtagactgtatggagactagatggtagacttcctccttggagaagaagccaaagaggaacacattctttccaccttgtgtcatgcatttatgagtggcttttccacaaattaaaaagtgatgtcatgaagaggtacaggtgatgcacctcagttgaaaactggactcctcacatgttgatcagtctccatttctaagcacattttaagaaggccagagctttaaaaggctcaagagaagaactggggaggggctcctcctgcctcttcttggggatagaaattctggcagcatagcacccttcaatagggagagatggttttgcctgtctgttgtttgccatcatggtgagaaacagctgaagaggtgtcttgctggtaggggtaggacaggattctcgggtccagctaactcatatggtggttctgagaagggcgcgtggtgatgaagtgatgcagcttagaaatctgcctctcgccactgcattcaatctgagccccgacaggtgggacctttctcttgcatctcctcatcagccgggcttttcctgagtgaggagactgcagtgttccctccagggcggggccaacagtatagacctagagctaactggtgatgccctgtggggcacgtgatgctgagaacagcacatgtgcttaacatggccttaatttgtctccaagcttcttaggagtatttgctataaaaaaaaacaatgggaggcccactgcagtgactcatgtctgtaattccagtgctttgggaagctgaggcagaaatattgcttgaagcaaggagtttaagaccagcctaggcaatatagcgagatcccatcactccaaaaaaacttaaataattagccaggcttggtggtgcatacctgtagtctcagctgctctggaggctgaggttgggggatcacttgagcccaggagtttgaggttacagtgagccgtggtggcgccactacactccagcctgggcaacagagtgagaccctgtctcttaaaaacaaaacaaaacaaaaaaacccccaaacaacaggcacttgtttaggcaaatgttccaaagtattttgtgcccctaaaatagcataggccttgtttaaaattggcattccaaaaaaatttttaaaaactcaaaaaacaaaacaacaatgaaagcaaaaaacaaaccctggcactgcatcatttttaatttagccagatgggaaggctgaggagggagtcagcacaggaaggcaaaatgcaacctgctcctcagctgagcactgaatgtagaaaccgtgtctcctctcggaagacctccctccccgactcccccaacctgaagaagggtccgttactaaacagttgcagtcccccaggccgaattccctgctagagcaacctttgggctattgatcaacagaaggctgaggtgatttatctaaaacactttagtgctaaatctattgcaagttccacttttaattcaagatcgctttctgcttcctccttcttaaatcaggattagtgattcaattcatttcctaagttgctaggcaatacatttatgagtttataactaggcctctaaccctttcccatgaattcagccaaacccatttatttattataatcaaaggaaagaaatgcttcacggagggttaatctttcacaaagtctaatgggggctaataggaagggaagagtaattaacacacaatgaattatcacacaatgaattagtttgcacttcaaactaatttgtggaaggtagctgtggagtaacagaaaaagcattaggttagggaggttgaaaatcaagttttagtcgttcttcacgaccaacaggctgtgtgactgcagggcagcactgagccaagggactgaggccttcaggtctccagctgcccagggcagattaaacaatcacctctctgaccaaggcaggggtacgagatgcaaggttaggagagtactgttgaagaataaagtacgatgaaaacataaaatatgaacagtaggctgggcgtggtggctcatgcctgtaatcccagcactttgggaggctgaggcggatgattacctgaggtcaggagttcgagaccagcctggccaacatggcgaaatcccatctctactaaaaatacaaaaattagccgggcatggtggcacacacctgtaatcccagctactcgggaggctgaggcatgagaatcgcttgaattccaggcctagtggcctctagtacctgaaatggtgagatctttaaatatgcttgcatattaaaagttctttgcttcaaatcaaagtggcccactgacacagcactgcccagtgggggaaatccctggtgaaaacagaaagcaggactctggagtttatcaatctgctccttttctgctgtgctctttgctctagaacaaagtagcatacacaggtgtcctcgcacacactgctagaatctaggtatctgggcatggttcctttcacaccacaacttgaggatgatccttcaactgtggatcctccgtcccttctgaagccagtcctcccaccctggctgatggtagtatttctcagtcttacccagtcaaactccaccaatacggccttccactattttctttcttctaacctgctaaacacaatctctctacttgggctccctacacagcaactactagactattgccctgagtcacccacactctccctacccactgtcatactgggggagatcagctaccttgcaggtcactgggatgtggaccctgtatagccagttgaaattaacatccttcagttccttaaaaagccaggcacatgttgtcatacattcacagactggctccacttgccaccaacataggcactttgcctttgctctagattctgaaaatatgttgaggaccacactgcaaagacttgaaaaaatatgctgaccttctttatttagcatctttatttacatagaattatcttttgcatatctttctgtgcttttgcttccaagagtagtcatcagtgagcagaggtttatggttaactcatctaattattggcaattgaagtagaagtatctccttgaggcacaggagcatcaacttctgtgtctcttgccgtgtcagtaagcaacatacaatggaaccggcagagctctctttcattcctctgattgtggagagtgggttagagaaaatgctattaatacagctgcatccagccatacccccaaaatcatgaaatgattgccttaggactgtaggaacttctcagggcaaataccacttgtttagaaattgtcagaatccaagtctgctaaagttgttcatctaagagagtgtcaaattcatccactgaaaatatactgctattcaagctttccaagcataaatgggatagagggagttgtttcaatttagggaaaaaaaaatccaggtgccaaagtctttcttaagatttagatacagcaatagcaatggtatctttgccattctataatgtgttccataaagtgttagaacttttaaaaccaactgactataatttaaggataaagtaattttatataccaggaactaaagatgcttccaagaaataaaaaagcaaatcaatcagcattgttcttatttgagtctccacaattattatctgtcaacaaccatcaacaatattttgcacagttggaatcaccattatgctgatattattggtcagcatgatgctgggttatatgctttttgcctgggtttcagaactttttctataaccgggaggttgttttcccaagcagatttggggaacttgggtttacctaactactgaaacaacaatctctttcgtcacagaaaaccaattggaaaaacttccgattcagatgctggggtttaatagagacaccaaagagtcactgcccgtgagacttttccctggaacctaaatccagttgccttggccctaagttgctgtttcttaagttcacctgtttcatgacttctgttccctttctccaaaacggagggggtccaggtgggaggtctgggtgagaggtccagagaaagaccagcattcaccaatggtgatcacctcttttaccctccttctgtacttgattagttgaaaggatgcaggaataaaacacatgaacgtttggggttttgtgaggaggagtcagtcagctttgagtttatggagagggacaatggtcacacccaagctttctacttcagcaccacgatgctgttgtctttgtcaagaaaggaatgctttttcagtaaaatgcaaccccactgaccacgcttgacatcacagcccacaaactattcccactgtgaggaagaagtcacagcggagccacagcatggcctgggctcttttctgattgtgtctcttaagaaaacagtacagctgaaactctctcccatctcagaggctgggaattaaatgtagttataaaattaaaaagtcagaaaattatcaacagaaaagacacatatatatctctagataaacagaaagacaaatgttctagccctttatctagtaacatctcctctgatggaggagtgatgacattgttgacttttcaatctacaagtgatttttgttttctgtttcaatgttctccagatccaaagggacatgctggataataagtggccacagtctattagagaaagcatcatgacaaagtgaaagcacaatatttatagaaaccccagatcaagcccttcccccaaatggttcctttctgtatgtatgaaggtgtgtatgtgtgtgtgtacatgagcgtgtatctataggtatatgtaggaagcatgaaggttgggggaaagggatgattacagtggggagtgctgggtattataggaagcaaaggattttagatcatacactcaggactgcatctggtgtctaaaccagagagaggagtggtacttaccttatttgttgcatcaataaatttgactcctttatatgagacagaaagaataatagtagggaccttcttcatttgctctgtagacttctgaaattaaaattagaaagctgttagagcagtttgtgttgcgtggcaactgaagcacacaatttttcctcctgaaagataaagatgagctcaaattaaaaacaacaacaacacacacacacacacacacacacacacatcagatacacaccacgcacactctaattttaatgtctgcctctcctctcttgggcttagctatacttcgggcttataaagttatccgtcttgcccttgaggatctaaaaagagtttgttccgctactttgtgtggatgaaggagtacttcttttccctgacactaaagggtgaatgaagaggtctgtctcctactgcaatttcaagtgactgttcctttcacaagagttaaaccacatcggacttaactccaagggtgcatttgacattaacaaaatatatgcacccccccttttcctagttaccttcattcttccaggcacagataatgcttggatgtatacttaaaatagggatgtaaaagatatcactatgtattgttcttgaactggaccaaatccataaatgctgatattatatttacagcagaatcacttgtgaccacaagggatgtaatgatgctctagaacaatgaagccctccaggagcagtctgggttttgagccacagcaaaatgctggacagcccaggtaacctactttatcatttagagctgctacattcccttaggccaagttcttgtgatagatgttcacactggctgaatgtgcttagagtttgcagcttgtacagttttatgcatctgcaaaaagtttctctataatttagtatgtgcctttcctgtttagctttatcattcatcaccagtcaccagcagtcagtttacttcattgccctctatatatactagtaataatcacactaaacatcaagaagaacctacctgacagttagcctggtggattttccagttaagacagatgggaacataataggagagaaaacatataaaaggtgagagagaggaaaccatttcaataattcaccaacagtgtaaattcattaaaaaacaaaagatgccacaaaagaacaggcttcagagtcatcaaagatgcagtgccactgttattttagaaatgctgcaggctttcaccggcccctttctttctctgtttctcatcattctgtttactgcaccgcacagtcttaggactgacacacaagaaccttccactttgagctttcaacaactagttgtcttatgtctattaagggaatcaggaaaaaatagaaactttcttgatttattcatttatatttcccaattttctagttttaaattctggaatgcagccagaattcaggaaggcttttaattggatagtgtgagtgaaactcattgaactcaatgatgagacttcaattgcatcttttagttgagctgtgaaaaggggtgtttcacattttcctgattgttttggcacaacatctttttgagagttactacgcctgtttcaaaaacaatggcttactaaaagtattgttatttaatatctgttgttgtatacaggatgtgaaaaagcagctctcttgctttttaaccagttttgaaattccctggatgcatcagtgttcctttgtgattgccaaaaagagagattatgaaaataaaatataaggttagaaactcgttttaatgcttcttccaaccacttcttaaaaatgtgcaagacacatcaaaggcaggctagaagaaatcatgtgcaatgtgttgattttaaggcaacgcggtggctgaactctgtaaagagggagggctggggcagcccaggcgatagttggaataactgaatgcatatgtgaaaaattttctgcaaagcgtcacagtggatttcggtaaatcacctcacttatcttttgccatgaatccattctcctggacagatctatctgtaatgcaaagcaatatacagctaatattcagatgaaaatctattcgttatttgttcagcaatcgagttgttactttaggcaacccactgtgcttgtcactggaaaagctcgagtctagttcagggatggcagacagacctcaaactgtgtgcaaacaccagtctgctgaaagcactgtgttgagaaagattctgagctgtgtctgagctcagtagaaaagagggctggaaatgatgtctgccatgggagaagaagaggacgaggcggcccaggggctacacatgaacatgcctgctaggtctgataggaagaacagctacaattacaatgttgacaaatgtgacaggagcaatatgaacaacatgcctccaggatagtgaataaaaacagccttattttgcttgacagagtggggccagtcttcattcattcattcaaaagacaatgacggcctattaggggtgattgagctgactcttgatgaataagcattttccaagtagcaaagaggccaaaagaggctgttttagcaacagaactaatacatgcacagaggcctagaaatgagaatgtggtgggtttgggtaactggtggagatgagagtggtagagtaggtttggaaggttgtgacttactctgccaagttagggtccgttggaagcttttcactagagagtgacacaatcagacctgtgttgcagaaagattcttctggtggttgtttatgaaggagggactggaagagctagaggctggatgcagggagtcaggaagttattgtgcaaatccaaaggagagagagaccctaagcacctgagttgaagtagaggcattggagaacaggaggaggcaccacaatgtcgatgaggaagaactgagaggttctgttgattgatctgctatggaagatgaatgggtgggaggattccacagatgaagaagccactgagataaggaatactggaggggaaagtgtttttgcgtaagcataatggaaatgcttttgcacatgctcagtttgataagcaggtggagatatccagtaggaaatgagaatcagatctggaaatccacctacatacatggatggccaaggaggtgggagtggacaaggtggtttaaggagtgaacaagaaaagagggaaggacacacttcaggggaagatgaaatcccaaggggtggggcagaaacaagagctaatgaaggaactggaattgaagttggaagatgcctacaacacagtatcacagaagccaaagaggagagggcttagaaggtaggagcaatgccccatgccatgaggactaacaaggcctaaaatggtgtgcctaccacagtggctggctcacacaggagctgctactttcattgggcttactgggtggaattcctggcttttgcaacaagaaaaaattgttgctgatttcattaagagtagcttcaagaaaatggtggcagcagctggagaggagaacacagtgagctgtgcaatggatgccagttaaaggaagcagaaagctggaacaacaggcaggtcaggacacagctcttgagctgacatgaaggcatcagcggtggttcctgtgatggtacaaagatcccacatcagatgctcggccaagttgaacaaaaaaaagaaaagatgaaggatagtcatttctttttcttccatgggtcccaggaatctctgctctcctaactggaggcagcactatggtgtcagtgatgcaggctgtgcacaggcctctatgaatggcagtgttgggggtggccatgctttccaatctggagcccaaactgtactgctctctccactgagtcatttgacaagaagctgatggatcctgaccagccagagagttcaaagggagggtgggaaatcttctgggtagagcccctccttgaaggcatttatacaccctacaaaagataaggatccatcgtcttttaaaggggttttctgatggtgtactttgacaagagtttccaaagaggtcttttcatacataatcttagcaaaagatgaaaatgcatagaaagaaggcaaagaggctaggcatggtggctcatgcctgtattcccagcactttgggaggctgaggtgagcagatcaccagaggtcaggagtttgagacaagcctggccaacatggcaaaaccccgtctctactaaaaataaataaattaaccaggcatggtggtgggtggctgtaatcccagctattcaggaggccgaggcagtagaatcacttgaacccaggaggcagagattctagtgagccaagatcgcgccactgcactccagcctgggcaacagagtgagactccgtctcaaaaaaaagaaaaagaaaaaggaaaaaaaaggcaaagatcaaagttattgagtcttcagggagtctaatctgggaggcaagaaatctagtaagtgcccacttcatttcatgaaggctttacaggcatcaaaatgtgagcacggggcttcagtccaatcacaggcagtcaaagtccctccttccccattttctcttcggtgttatgatcatcattcttttctccttcccagggacgaaggcgcctactctgaacatcaagttactgagcacgtgctctcaggcaacactggtttctatgacctatctatctgcatgctctgctgggtgtctgtataattaatactcccatatgtttctgttaaaaattcaagctttattgatttgtataaacagaactctgtacttcaggcccatttccccagtgaaagatgctcaaggcgaaccttctgttatcgttttctttcgtttctagttgcttttccctatgccatgctctttgtggcatttttcaggtttcccaatgttctcaaatttaccccccttcagagccagctttacagaagagactaatttgtaatggagacctctgagtacataagcagataaatactcctgggtaaggctccaaattattttaatttttacagcatcttggtcacctgcaaaaagcattatagtgatattcaaatgtattttgttcacaatttcccaaattaagaggatcatacttttatttttccaagagaaatgatatttagttatatagagatgttacgtttctgaaatctaaaatacaatgcaacatttgaatcctaaattcaaaggcagtcttctctttaagcacttgagtttatattgtctataaccattaaacagaaacaggaatcagaatttcatatctggaggtggccacctgaaatattgttcttagtaagtcactgaatgcttttagagcatttttaaaaagaagagattttgaaatcaccaagagaaagaaataaccatctttcttcttctcctttttaattttaaattatgaacggcttggtatcaggtcagaaattatcattggtgcttttattactgccttaaagcatgttctgaaaataagtaggttttctattttgaatgcagaatcagtagtatggagataccctttccagagtgcacgaactctaatctcagagcaagacttttccgagcacgaatgaaagcagaggggtttatgatggggagcacttcagttgtgagctgtaatgctctttgagtctggagtggtgttaatgttccgagtaagaatcattagtgccccatcatcagcacagacagggaaaacagtgaggctaatgtggggaggacgccaccaacccttcattcttacaatgccccgattgctcccagtgtatctgaagcacaggctggggaagggatttccggttggtctgttgccatccaacttacagtatatttttaacctacacatggctatcctgagaatgctttctagttagatattcagtcctgagtcgtaactattaattttggcatataatatcttccttagttagattcaaagcttaattattatattccatttcagcaagtaaattaaaataggatcaagcaattatgtttggtagccctaagtgactttcaaatgattaaaaaacatacacaaaataagcattattgtggtgattttgtaggcagtgaaactagctaggttgtgggattacaagagataaaaagcagaacaccaatcagcaatttgaaatgaactctcaccatttgaaactgagcttaaaggccactttctggggaaaggcttccgcggtctcccaggctgacaggatggcttttctcttgttcccctctctgccacttttcccgtgcactgccctgggtctcagcgtggtctgcttgcttccctatagggagctccttgaggactgcccacacctttcttgatttgtcttcactgtaatgactagcacatggtcttacattgagccctatgaagtagccatttttcaagtcaagaatggctaagtaccagcagtttcataggattcgatctaatggttgctgaactccatgactgttaaaggaacaggccagtgaattaatgtatcgtaacaagcacgtagccagcgttataaggaaccacaggctgggcgtggtggttctcgcctgtaatcccagcacgtagggaggctgaggtgggcggattgcctgagctcaggagttcgagaccagcctgggcaacacagtgaaaccccatctatactaaaatacaaataattagccgggcatggtggtgggaacctgtagtcccagctactcaggaggctgaggcaggagaattgcttgaacccaggaggtagaggttgcagtgagctgagtcggcaccactacactccagcctgggtgacagagcgagactctgggtgacggagcaagactccatctccaaaaaaaaaaaaaaggaagcacagtgccagcctctcaacacgctgagagctcagcaaactttcagagagctctggtacccagagccagcaaagaggccttgcaaagcttgcaggaggaccacaaatgtgattagagggttaccaagacattcctatggggtggagaaaacttcaaagattttggctgggtgtggtggctcacgcctgtaatcccagcactttggaaggccgaggtgggtggatcacctgaggtcaggagttcaagaccagccggaccaacatggtgaaaccccccatctctagaaaagagaagaaaacagacaaaaaaaaaaaaaaagatcatgagagttttcagtctcaaggaggcaaggcttaggtcttcgtttctgcaaagcaaactggctcaaattgcaagcattaagaagaaaagccttcttgacagggtagaaggattcctaagggcagctgggaagtttccccctctagacatctttaaaaatagtttgggttctcatctgtcattaatgaggctaaatgaccttgcaaggacttttctggtcataggaggtctggcacaaaggctgagggaatacagaacctaagaccaggtgacaagaacagacagtgggcaagcagccattgaaaccacacctcctgcatatgacatggccattgtactgcctgtgtaactcacatgctctggagcacaagtctggcacagcacaaagcggtgccctccgtttctatatgctgctgatgctgcacgtctgagaccatactttgagaactactgctctaaaaatgcggtcgatcagtttgattgaaagttactgtcagaactgttctctgctgctgtgcatgtaaactcgctgtactgcatcctacattaattcagaaagaatctagtttatcaaaacacactgttctccacttgacaagtgatttccaaaaatccttagttagcatttagctacagctcttggtcttgagagcaattaacaagaattatttaattcttcatggtttctcagggactgtgaatggataaaacattcttcacataaaacaaagagttcagttcataatgacagattcaagagttgtacccagaatagatgttggccgggtgtagtggctcatgcctataatctcagcactctgagaggccgagacgggcagatcactgaagatcaggagttcaagattagcctggccaacatggtgaaaccccgtctctactaaaaatttaaaaattagctggacgtggtgacgggcgcctgtaatcccagctactcgggaggctgaggcaggagaattgcttgaacctggaaggcagtgattgtagtgagccaagattgcaccaccacactccagcctgggcgacagagagactcaaaacaaaaacaaaaacaaaaaacctgaaaaaacaacgatagagttaataagatcaggggtcttgctgaagatgaagatgtatagtttttttttttttattaaagttcccctattctccctcaaattaagcacatgctcttgagagatgtgacaggcaaacatgaacatgggcttgtgtactgcccctgggagtgtaatctggaagaagttttctagaaggcaatttgggaatagttatccaaagtttcacagtgtgtataccctttgatccagccattctatatctagtggctcattctaaggaaataatcaaaccaactgcaaaagatttaggtaaagggtgttacccatagtactggctatcatttgaaaagaattggaaatgacagaatgaccaacaaggagaactggttaaataaatttggttcaactatggattggaatattgtaaccaaccaccacaaatgatattggggatgaatatgtataggaataaaaatatttcaaaatatattattgtgtttaaaatacacggtaaaacagtggatatgcaatatttccacttcttactagaaaaatagtacctacaaatgcataaataattggtctggaggattacacaagcataagatgttaacagggaggaatttaccacttctaggtggtaaaatcacagttgtttttatttctccttcctgtttttctattttagaagtgaacagtaatgaacgtgtattgcttttgtaataaaattttaaaaatgtatgattttaattaaaaatgccaattgcaaatgtgtgaaaaaacacactgtttgaatctatcacttataagtgcaacttctgtgttttttgggggtgtgtgtagccatcttgagcttatgaagggacccactgaggagctccttcctctgagaagaaaggggtagttgtcagcaaatgagagtacagggtatgtttggattcctggcttagttccattccttccttgcggcgtggttaggtactcaacctccctgtgtcttagttacttcatctgtaaacgggtatgttaatatagcatctacattttagagttgtgaggattgtacaggataattcagtgcctagcatgtagtgaacatcaacagattttagctattactgcttaaaaacagtattttttttggtagagatgggggtcttattgtgttgaacaagctggtctcaaactcctggccccaagagatcctcttgcctcagtctcctaaagtgctgggattacaggtgtgagccaccttgctcggccagctgttattgttattctgaggatagatgctttcacttagaaagtccctctccaaagcaaagcactggcaaaagagagcagaaacaaaattgaaatctgtgtgcataactgaacactctccaggctacttgctatgatggcagggaaatggtggttgcaacaatgaactttcagtggatcaatatacctgggccaatgagaagagactcaatcaatcaacatgtttagaaagagcttgagacaagtgggaattaaagacagaagcagcccaggaaatctttcagtgatgtgaagtagtaagggtgttatatgggagaaaagctagcaacaagggctataaaaaataacaaagagaactggggtttgaagacaatatggaataagatggttggtgctctttagccttctagagtaggcccgtaagaaaacattcacaatgagaggctgggcgtggtggctcacgcctgtaatcccagcactttgggaggccgaggtgggcagatcacaaggtcaggagttcgagaccagcctggtcaatatggtgaaaccctgtctctactaaaaatacaaaaattagccggacgtggtggcggatgcctgtagtcccagctactcaggaggctgaggcaggagaattgcttgaacccaggaggcagaggttgcagtgagccaagattgggccactgcactccagcctgggagacagtcaaaaaaaaaaaaaaagaaaacattcacaatgggaaaggcacatgtgagcaaggatcagcaataaggagttacctatgtggctgtttctttgtgggcattgcgattcaatagacacacaacacacatttatgggcttagaagctgtattcactatgactcacgcagtatttgggagagagtgaaagaaaataattgatgcttccatgaaattgggcaacagagaatttttttttaaagatgggatctggctatgttgccccggctagaatgcagtggctgttcacaggtgtgatcacagtacactacagtctcaaattcctgggttgaagtgatcctcctgactcagcttcccaagtagctgggagtacaagtgcatgttactgtgcccagctcaacagagacttttaaaaaaatagttgtttaaaagttttttttcccagtctgattcctaagaagtaattcttgaagttatatctgaaaatgacaacttgtcacagaaggaatttgtatgaggacagaggaacaaaacatgattttagtttgagtctcttctaagaggaaagaggcttttacatttagtatttccatctaattttaagatctaactttttcaaagttttccaacccattccctctattgtttcctaaaacacataaaaaagagaaaagtcttaatacttcaactagggcatggattattatttggaaatttgtatatttgaaaattcacgctttagaagtgcttctggattgaaagtttaaaaatcatacaaattaagaggaacagattcaatgagaactatggggaaactatccaaatcctttgggaaataaaagttccaagacctaaatacactagatttgcttatttctgacttaaaaataatcttaaaatatttcctttcttatatcaggaaggcagatttctacctcatcttagttgaaaacagatatttcttttttggggaggattattttttaaaaatatcaattgacacataataactgtacatattcatggggcacaatgtgatgtttcaatatatgtatacattgtgtaatgacaaataggggtaattatcatacctggaaccttaaacagttatgatttctttgttttcagaaattcaaaatcctcttctagctattttcaagtatacagtacagcattgttagctacagtcaccctactgtgcaattgggcaccagaacttatttttcctacctaattgtaagtttgttaccattgagcaacgtctccctattcccctcctcctcatctaccctttcctggctttgataaccactgttctattctctacttgtatgagatcaactttttagattccatgtatgagtgaaatcatgtggtatttgtctttctgtgtctggcctatttcacttaacataatgtcttccaggctcatctatgttgtcacaaataacagaatttcattctttttctttccctgaatagtattttattgtgtacatataccacattttctttacgcattcatctgttgatggacacaattttaaataaacacttagcttggatccacatcttggccattgtgaatagtgctagagtaaacatggaggtgcagatatcaacatactgatttcatttcctttggatatatacccaatagtgggattgctggataatatagtaattctctttctaattttttgagaagccgccatactgtttccatcattgctctactaatttatattcccaccaacaatgtacaagggttctcttttctccacattctcaccaacatttgttatcttttgtctttttgataatagccattctaaatggagtaagatgtggtttttgctttgcatttccctagtgattcactttgggtttgctttgcatttccctactgattaatgatattgagcattttttcatatactttttggccatttgtaagtcttcttttgataaatgtctattctggtcatttgcccattttaaagttgattatttgtcaactcaaaatggattaaagacttaaatataagacctgaaaccactagaagaaaacgctggagaaacacgtcatgacattggactgggaaagaattttttggatatgactccaaaagcacaggcaacaaaagcaaaaatagacacatgggattacatcaaactaaaagccttctgcacagcaaaggaaacaacagcaaaggagacatcttagagaatgggagaaaatatttgcaagctatacatctgacaaggattaatatccagaatttataagggacccaaacattgcaatagcaaaacaacaaataatcctatttttattactttttaagagaaatttccttgagaacaaacacctgtgaatgatactaaccatcaactatgggattagagaacgtaagactgcagagagtattaaattgaatataatggcttacctcttacagtaacagatgcttcctaattgtatatttaattagggaagtgatgcattactgtatattagtgaaaattaagccccagggcaaaattcagggttcgggatggggtatgggtaagcctagggaggcaaaattgaagagcagaacctcatctggccagagcaaatccttcacttcaccaaaaactgtatgtcttggaatctttgaagtgggagttattcataccaacataacaacaacaacaaacccactgaaaagtcaaagcaatatacttatggctttgtaaaatccagtcctgtggacacattatttaaaagtggtaattcttggccaggcgcggtggctcacgcctgtaatcccagcactttgggaggccaaggcgggtggattacttgaggccaggagttcgagaccagcctggccaacatggtgaaaccccgtctctactaaaaatacaaaagttagccaggcatggtggcaggcgcctgtaaccccagctactggggaggctgaggcaggagaatcacttgaacccaggaggtggaggttgcagtgagccaagattgcaccattgcactccagcctgggtgacaagagcgaaactctgtctcaaaaaaaaaaaaaaaaaaaaaaaaaaaaaaagacttcctctcaagcttggcaagcttggcgtttggtcgatggggacccatgggggttcaacatgtgtatcaagaagtgttatttctgtctggggcccatccaccctggccatggcaagatgttcatccgcaatgattgcaaggtgttcagattttgtaaatctaaatgtcattaaaaactttaaaaagaagtgcgatcctcacaaagttaggtggaccaaagcattctggaaagcagctggtaaagagcttacagtggataattcatttgaatttgaaaaccgtagaaatgaacctatcaaataccagtgagagctatggaataaaactactgatgcaatgaagagaattgaagagatcaaacagaaacacgaagcttaatgaacagattgaagaaaaataaagagctacagaaagttcaggatatcaaagaagtcaagcaaaacatccatcttatccgagcccctcttgcaggcaaagggaagcagttggaagagaaaatggcacagcagctacaagaggatgtggacatggaagatgcttcttaaaaatctctgtaaccatttcttttatgaacatttgaaaatgccctttggagacttgaaactgctaaattattagcttattttttacataaggccacttaaatgaaaaatgattaaaatatatttttcctaccttgccatctaatggcactaggcagcatttgtataataactaatggcaaaaattcatggctagtgatgtataaaataaaatattctttgcagtaaaatattccctttattaatgttatagaagggaggatacaacaaggaactaacaatttgtatgacagtgtcaaatattatttagattttagaatttcctgttttgcttcatttgcatcttagaagagcataatgacattgtttgatgaagcctaattatgctggactgttttgagctggtttaacccttctgataggtagttgtggatgtcgaggatgagaactgaataatctttgcctgaaatcacactacactctagaatttccactctggagaatactcagttctaacttgtgattcctggtagaacaaactttatttttctagcctagcaatgatctagaagcagaggaatcccagtgccttttaaaagttattatgtggttttcttttaaaaagctcctgtttttggaaagtagaatttctgggtacaacatctgtttattatttgcacataaaataagccatttaaaaagtgaaaaaaacaaaacaaaacaaaacaaaaaacaaaacccagggcaatgaatgttcctggcacattggagaggcagtccagtctctggattcacagtgtgggtagtggagtggactgcctggtttcaaatcctggctctgccacctgctgtctgtgtgaccttgggcaagtgacttaacttctcttggactttgttttcccatatgtaaagtgggagcaatggcaatacctactgtgtggactgagtgaactaatgcacataattcagttgtgcagggcagggtgtacagctctcaactgctacctgttattagccctaataaactgattttaggagggcatgagtatatgtcatttttaagatcgtctattatgatcccttaggctgatggcaacttgaaagtgcctctatggtaatacttctaccactttggggtaattaaatgttcacatgttggtttcctccactggattgtgaactcggtggattttagtcatctttgttaacaaagtacatttaaggaaacattgatcagaattgggaaccacagtgatttacttattactgggagagacattttcattttggctaaaatgcatactttgaacagaaaacatctttttttcaattaaaagaataaacaggtaactcttaatctacaatactttggcctaataatattaccatgaatcaactttttagaccgtctgtgtcctaaagtatttttcatggggagttttgattgaactgggacttttggctgaaatgccaccatgctgagaacagagaaaacagcaacttggggttcaaactgaaaattagctgcaagttgagatctacatcatttatagttggtgaaagttctaattcacaatagaatagttccagatagcagatcaaccctatgcttctggttttgaaagactctggtgaaatgtagtgaatgcaaccttagctactttatcaagaactgagacttacttaatcaagattggaaataagggtttatgatagtccgagaagtaatgaagtttctattttcatgtaaactacataagcaccaagagcagcaaaccagaaaaatgccccccaaaacagaagaatggcttctaaatatatgtttttttctaagtttcattttaagcaacagacaaggatttaactaaattattctctacttaggctactaaaatggcttttctattgctatcaggatgtaatttcagatccactcaatttcatgaaattgactgagattcaaatcatacatctggtatattttaaatgatgctgcatgcactaggcaatactgatgctgattatcacaccggagtagctggtctcaggtaatttagttaagagtattaaatcagagatgcccaattaatttattagacatgttcatgaatatttctaaaattattatgaggcttgatgaatgaaaactttccctttttcttattgttcattggtgacacaaattaggccagataaatatttagaatacaagatttccagaattataaaaccagggagaactctaaagtgtatctagtctaatgttctcattttatatgtaagaaaacagaggatcggggaaacaggagaatgtagtggttaaaagcctgggctctggagtcagacagacccgaattccagtctcagattggcaagttattccctgtgtgaccttgagcaagttattcaacctctgtaagcctccatttcttcgtctgtaaaatggggacaataattgtactaggggacactgtaaagactcagtaaatgttagcagctatcatattatttttatgaataacaggtgactcctaaggcaaataaccagccacggaactaaaacttagagtttctgatatatacagaagcttgtttttttatctaaactcagtacctaagttaaatattcactggtactgacaatttaagtactgtctaactctgcattaaatagaaggataactatttcagtcttttttgctgttgaattgatcaaaatattagtgattacatattgaagtctcaatttcatgaagattcacacatatttagctttccataaacaatggatatttcatgtttaccttcatagctgtttcagtgtaattatatgctcttaaattattttccaccaaaagctgctcatataaaataaacaacaaggtatattggccataaataaaagttaggattgcacttactaatgaccttaaatttgactttagttagatgctatattgaacaagtctgatattctcaatttgtgcagttactcagataccagcatagcctctatacacctgttatggaggaagcaagaacaagggacacgtacaaaaggaaaaggtgggtctgcaatacgagttagagttgctttggctaaaatagactcctaggaatcaagcagccactaatcacagatatttggaattgccattttttttttttttttgagacagagttccacttgtgtcacccaggctggagtacaatggtgagatctcagctcactgcaagctctgccttcaggttcaagcgattctcctgcctcagcctcccaagtagctgggattacaggtgcatgccaccatgcctggctaatttttgtatttttagtaagaggggttttgccatgttggccaggctggtcttgaactccttgacctcaggtgatccacccaccttgacctcccaaagtgctgggattacagacgtgagccactgtgcccggcctggaattgccatttttagttaacatttgcccttaaatagttcattccactcaaagttgaatttaaaaaaataaaaaaaaaaaactgagtaagaaattgcataaagaatattagctttatataatatgctcttaatacttctgcttttgataattttagtcaattggtgatgttttcagtaaatattctcagactattcagtgcgtgcttaaaaccttttgttgtaataaagatcatttttctaatctcgaaaatgatacaattaattttaaatctttaaaaataattaagaacaaatatagtacaaatatagcaaatagacattaactcaaactatagtgagataagttcaagcataaacatgcagaaagcaagagcacctttttatgtaataccaatgtgattcagcagaccaacagatggagaaaatagtaatttgaaaggtggcaatttgtatccatacccagtatttagtatttcagctactagaaataaagtagtttggcagacttacccgcatttttgcacaagcatcttgggttgattctgtccccctaagctcttttatcagcatagaacctaaatactaaaatacaaaaaaaattcaatgatttatgaaatggaatatacatatgagtaatgttttaaaaacaaattgtggaagtattactggctaggtttcctggctgtaagttgttgcataactttaaaaaactgacagtaactaatcctaacaaataaatgcattcatagagaaaatgcagcagaattaaccataagttctgggggctgtaattgctctttataatgaaactgcaacatcttctaaagatgccatctttcaaatcatatttaactgcaaaatgggggcatctaaaaatgttttccccttttttgaggcagcaatgtctgcaaaaataaatcacactactatctctgtaattacagggttgcatgagacagctgagaagctaagcaacatgtcccccatttaggcttattctgctgcataggtaattaatgttaggcttttaggcagagatgcagttttggacctttttcattcacagctgtgtgccctatggttgatccacctgagaacgggatgggagggtggggggagggagagaggcattctcagttgtttcccaggggaagagagctgggttcctggtgcgaagtgccacctggagggctgaatggagctagaaggatgacagtctcccaagaattgccaactactttgttgttagaagaccagaccccatactgtatcatcctggtacaaaatgcccctcgtgctccagcttctggctggggccaaatggttttaaacaaaatgtctgatttgcctttctatcaattgactccccttcaaccttttgaagctttagtagggtttttgccttttgtcattcccctgccccttgccctccccccaccagcccccaaagagctctatatatgttttttaaaaaagtgaattacaataattattttagaagatatctgatggacacttcctgacaagactggagacttgtactctgcagagacggggatgggaaccactcttgtggactagggaagtgcctgacttgaagaagacgtgagagggcacaacagcagaaggcgtggtcagggccttggagaaaggcatgttcagaaaggcttggggacttggggtttggagggaggagccatttcaatcctatggttttgggcagtaccactgaaataaatccaaagctgcaatataagtaagctttagtaaaagaggggcagaaagcagaaaatgaaaaaaaaaaaaaaaaaaagctcaactggtatgagataaccacaatgtccatctaaatcaaatgaaggtgaaatttattatcttttggtaaaatccttatcttttaagttatcagggaagtttgcctgattgaaatgtttctttttaagagaggcagtttcaatgcactgctgaaggttcagccactttttctgctgtcgtcaagacaaccaccacctgacccaaaacctacagtatcttttgaacatttaccagttcctattacatttctcagctaattataattaattcccctcttctaaaaaactaaacaactaacctaaactaaaccaaactaaactaaacaactaaaacagaaaaatagtataatcctattgatgacagtgaaaagaatctggtatttacataaagtggcagacccagtgttttgagacccagtgtttggtgagtgagcagagatatatatatatatatgccatatttacactcatttccattttaagattgtacgttataacatttatttaaaaatatacaactatataagaggtcacaacagaccttaaacttacaagattaaaacggttttaaagctctagttatttggactttctctttggatagaaggctactttaagaaaaagtgaagagaaaaacattttaaaaatttcagtgatggatatggatattttggtatattttcaatgtaaatgcaaacaagctgaaaacataccccctatctccacttaggcccaaatactgaattgagggtaacttacaaaagctttgtaatcacacgactggaagataagcttttctgggtgatgctgccagtactgtaccggggtagaggctgtggcttcattcggaggtcgcaaggtaatggaaggttctccccagtctcctgtctgaaaatgacatttattctagaggcaatatgagcagtcagcaaagttcattccctgtagctaccctgagctcaccttacacacaggtgctgtgaatgtaccaaaatgcatttgggtgtcttatgtgaatataaatacttggttattacatttttatatgtattagcatatctctcaaggctgagttaatttttgaggtgtggagttgaattattctatttttagaatgacatcctaagctaagtcactttaaaataaaacatgaagatattcataaatgatttactaatcacaattttccatcacaacagcaaaggacacacaatctttaaaagaattttgtttttaaacttgactgaaatttttagtttgaattgctttcacattcagaacacacagttctataaatttcagttcccaaatatgacatgtactagccactttgaataattttagatctctggagaaatggtagtgtaagcatgatgctaaacaaaatttaaaagaaaaatttactaatgggtgacactaatttctctcatctgaattcaattgcactgatttaatgatgctgtctcagatggattcagctacttttctcagaaaacctaacgtaccaatgaagactaaacagtgaaatgccaagtttggtcacatgtacataggcatgtactttgaggattctgattcacaaatacaagcacattcccaaatgatggtatatcatatgatacagacctaaaacaggaggacctcccatcatttcatttatcattttccatgaggttagcctcaacctgtttcatcagtataatagcttaatgtgagcatctataaagtcaaaggccagtgttggcaggtattttctgggctctactctgatttacatactacgcatgagatatttcttactctttctcctgggaaagatttggatttttccaaaactcagttctttgttctcaagtggacataactaaaactaaataggcagatttctagagtgactctcctctaacctagatttggctatatatagaactatgagaaattacttttctcaggagttggaagagtgtaaaaaggtctcataaactccaaaatcaaataaaaccttggttagagaacaagttccacagaagtgctagaaagtgtgttgacacactgtgggatttcttaaggagaatttttaaggagtctaggacaagaatgcaaaattttggatgcagttgtatgttttgggagagaaaggaagttctctgctttattaaattctttgaaagaatctagaaactccaaaagattaagaaccacagttctctaggaatggcgtacatagggtgcatattttggggaggagaactagctctccaattttctttgcgcactttggacttacattaggtgacatatgaagtagctgccaatgataaaaagccctttctagaggacttcagtaatgcacaggctttttttttttttttttttttttttttttttttttttagcagtggagtgcctgaagcttttctccttgagatgggtcacttcgactcgcagaagagcaaagttagcatcacgctatttccttggcttctcactgtagttagtgtgtgactagttggaactccttcggcttttctctcctgctctgttctcagccactctccacattagttttgttttcgttgctgatttacttttacattgcttaatcctcctattccctgtctgttggtattttttatttttgtacacatttatggggtatatgtgaaattttgttacatgtatattgtctgttggtattgttaagactttacttgcaatattaactttagcatttttgtctgttttattatccatccctgactcattcttgagtttttcttttatatttatatgaatttttagtttgtaaaagtgataactgactgcaattctaaaattagattaagtttttctttggcttcttattttgattttttttcttttccttctttctcaaatggctggctctttattctctctctggtctttatttcatctggctgtaacttacttttgaaaaactagtataaaattcaaaatataggatacgtggatttcaatatcattttgaagctgagtgtaataacctttaagtgataatagcttaaaattctggaaacatgcagctatgggttcttaaacaaaagctttacccaaatctatcaaatcatcctctaatctcccccattaaacttctccctccttctcccgctccctggataaagcaacaacaacacggcaaacaggtattgtacatttaagtcacaggtaacactgttaacaaaacaacagaagtttgcatgcaactccgtggaatgatacaaaaggaggatctggatggcttccaaagatcctttgatccagtgtctgctgatgtgacaactcaaaccaagcatcagatcttcatgtgaaccctattacagttcagcagaggtagaccttggccaagctcaacaggtagttttcaaaaaagtctgaacacggcatgagctggtggtgccatgagttgcagggccagggctgggaacagggctgggggtgggaatgagttgggggaagctagggttatgaaaacatttcacgtgttagtacattaagcatgcaaatcatatgcaaattcattctctaattgttccattaactcacacacttttataattaaactttaatgtgagttccatacatttaaagccagagccacagccaaatgctgatccaaatatttacgtcatccacataagttgtagcagccattgtgggaataacaagccccagcacatacattccaatctcggtctggaaatcactgaaatcccttatttgataaccactggaagaaattagtggaacatccacttaaatctgtttagacagcgccatcatctgctctcccatgactccactttgtccaaaatcacaaaccacttgctttgaattcagagtgatctgataggattttccctaggtgctaaggtgggagataattacaaggaaaagaaatataatacttatttcattttctttgtggccttcaaatattgcttcagtccaaatattgtcaaattccctacagggactgaatctacctttctggaaagagacactgaattttatcagatttagtgctatttccagaaattcatttttaaacagagggaaaggtgttcttaagattgaatttattagaaaataaatttcttttctgcctggaaattcatcaacttctctccccacccctgcctattttttttttttttaaacttagatctaaaagtatttagaagactcaatttgtagatgttaattcttctttttggaattaatttaatgggaatggatggactccaacaactggacttaacattacactgtcgtaaaggacaggtatgaccttggcccttggctgggattcagctgtacctggttgactcccagtaagaacaaaagagttcagagaacaagggtgccttaggtctcaaccctcctggaggctgaattacagcaggaatgagctatggaggaattacgtagagtagttactatatggaatggaagaagaggtcaaaaaagaaagatttttgcctcatacataaaatcattttgaactttgaagcctagtgttaggtcttgttgactagtacattcatgtctacataatacttgcatctcctcaggcaaatatttttaaatttagtaattttccacttaaaaatccttattaaatattaaataacagacctaagaagtcttttgccacaataatggtttataatcaaagcttatttttaatgaaaagcagacctaaacacagctaacaacgcaatatttcattagaatagcaaaatgaagtaggaaaagtttagggtagaattctgtcatattttaaattattattgacacagtggtctttgaaaggattccttaagtaatcacaaatgagaaatcaaaatgattcaaggtactcctaataaatgtcttcaggctatctctttggcacttaaaatatttacagaaaatctttcctttaggttcatgtatttgaaagatcttcatattccaagaattttgtcatggcttaaaacttcatttatttggtatttattattattttttatatgtatgcttaaggcctttttttttattaagcacactaaagaacatcaattaaacagaggaaaatgtacatcattagctctcttcttcaaactcaaataaaaactaaacttctaacataaaggaaaaatactttgacattagaattttaaatggagaattgattctgtgtaacacatgtttgcaactgccaactataaatctgtagtctgggtgagtctgaaggactataattgggccacatctaatataatgtaattaaattaaacattctcttataccaacaactgaaaaatacaaaagcatcaatgggatttagttaaaaaacaaaaagcttcacaaaatacagagatttttactggatggcagattccaaattgcagcttttaaactttgcattatttcaacaggtggtaaatagctgcaaatttttagttcacatgcactggacacctacagcaaattctaaaacaaattgtatcaggtagctgtctccctccaaaagggaaactgaatattacatattctatatgctctgagaatagaaaggaaaaacccttctctatgttattttccgtctttattattatttatttttccaagatggagtctccctctgtcacccaggctggagtgcgatggcacaatctcggttcattgcaacctccgcttcctagggtccagtgatcctcctgcctcagtctcccaagtggctgggactacaggcatgtgccaccacatctggctaacttttgtatatttagtagaaacagggtttcaccatgttggccaggctggtctcgaactcctggcctcaagtgatccacccgccttggcctcccaaagtgctgggaattacaggcatgagacactctaccaggcctttatgttattttcttcttaaggaaaaagtttcctaaggatgtcagtagataattaaaagccatgcttacaacttacttttctaacattaatagaaaagtatggcattttccaagccttgtattattctttaaaatttttaaaaattaggatttaattgatttttaaaaatagaacctttaaaatcttttctatgaggactgctcccacctacttgcttataaatttagatctgaatattaacaaacattagtctcaatttcttcagaacacttaatgaaaaactaaaatgattttaaaggacaattattgttttaaggttttactttcaataattatgacaaatttcagagatgggctacccaaacatacataagatatatgtgattacatttactttctgtaatctctaaggctttgaagaatgctatacacagctctatgcttataaatatgcatacgtatatttgaaagtgaatgtaaggaaaaggcttcccataaacattcacacataatgaaagcaggatgttgtagttgttctttcaaaaaatcttcaagaatgaagaattctagtttgatcaaatgcagttggttatactgaatttgttcctttagatgaaaaagagcagagatggctacttacgaacacataaaagctctggttaacatttatgagtccaagaggaactgctgggtcacgtgaacaccagtaccaggcaatgtatagacaccatggtcctcaagagccagaagtcccatgcacaggagtacatatgtgcctgatgcagcatcccaaaaggcacttcacaaaaatacccgtggcatcccttcacatgccgccccaagaatctgctcagtgattctcaaccaagtgtctcaacctctcagacagcaggctatccaatgggagaaattcaaaagggtgtgaaaatagaatagtattttaaaatatggaacataaaaccccaaacatttaaatgtttattttccaaatagaaataaactttttctaaagtatgcaaaggtgaaatatgaacatttgaaaatcatgcagctcagagtaaaatgggtcacaatttcatacaatttgcaaagatcaattcagtactgtcaaatggaaaaaggctgagaaccactttgtagctgtaaccgtgcctctcccagctcacctccccccacatttgcataaaatgtatacagaataacatgcaaatcatactcagaaatttctcacaagtgaagcacatgaatctttgagaatcattagacacaaagggttgaagagtccatgaatatggggaggtacaaaatggggaggaataatgctgatatatacatgtgtgtatatatatatatatcaatttacccttttctttttcctgtaaaagcaagtttaacacagacgcctggaatgaaagccaaaactcacatgggacatattttaaccatacactttaaaaccaagtatgtttcttgttttaggacaatgtttgcacatcaactaatcacaaggcacagtaaatgaagtataatagacaaagagtctcggagtcaccagacattacaaattttctgcattgccaggacacagtacctatagctgttgacaacactgtgcaacacagtacatagcgcaagttcaggagaagaaaagaaccatttgtaaccttacattatgaacctgatggatcgctgagaaaggaaatcctgcgttctgattcgtccatatttcacagacagacgactgctgatataaacagaaaactatcttatcttgtcaatatttaaaacatggcagctaccaaggtagcatccaggaaggaaaagaggaaaataataaaatgcaaagaatcacatttaaaaaaaactcaaaaaatgttttagggtgctcaaggtttaataattgacttccaagtcattctttttgctttaaaacattttgagttgactaaaaaaatcatttatgcatttatgcaaggaaaattaccaataaattcatgccttggaaaaaagcaaactgtattttatatttgccggaaaaccagaaataccttcccccttcacgtcactactttcagaggataaatattttcatcaacttcaggaaaaacaggaaaaaacctttaacacaggtccgatatttttattttcttatcttcaatgaccaagagcaaacagtgcaataaaatgacttttcctgatttagtcattgctctatttgacaaacctagaagatatttatgcctccagagttcttacgggcaaaactcggtagttaacaaaggaagacgtgtcagcttgctacccagcactgggaggagtgaaggaggtggcaggaaggaggctggggcagggaagaactgaagtcagggaaattcagttctgttcctcaagcagaaacccttgggaacagcatttgggagtctaatgattcagctccataattctggctctcccccacaccattaataagataaacttatcagtaatgtttgctcagaaccaaacactaaactaaccagcatcccttcccaggagttacagtagaaaccttcaaagagaccgactgagctcttggcttgacccatcccaagttctgttcccgaatttcatcattctaaaagacactgtgaaattaaatcacagaaaatggcagagcatgtaaacttattcagcaagctctgtgagcatctttagcattcacaagcagtccgtacaaagatcactgcaggaagaaggcaagcacataaccataatatggttaagaggcccggcaaagaactgtatcatcagcaaacaaatgatagaaaagaaggcttatccctagctaaaagtttcctcaccccagaaacgctcaccagcaatttaacacctctctctctagttacaactgcatctccacacacccctacacctttgctttccatgtcttctgttaaccagaggcttgctggggatggttaaggaagttagatccccagggtctgaccaaaggcacttccaaacacctttcacttaaaccagctctgctatcctcagttccctctctaaacttcatgctattttatacatccatagagggttcttcctcttcttacctttctagcaagttcagtcttagacccattcactctgttggccttgtctccaatagctctcctctgatttgaatgtactaactccatgcgttagctggattaccatcttaagtggcatcctcacccagtcctgagctaattctttacacaaatcacatcttctgcaactttcacacacttctagtgttaatctagtgctagaagtgcttctagcacttctagtgctaaataatccagagaccacctgtcatctgatagatgaagacacagacatttaaagaggtgaagtggcttgctcaggtcacacaggtgagtggcacaatgtgtcagcctgctgggatggctaagaaggagtgtgagcctggtactgatgtcaccagaaggcagagggccactccagctatatacagcttggttctactgaccctgaaatgaacagaaactaaaaataaaatcgtaagccccctcaccgactgaacggacccccttgtggccaaggggaccccagaaaaaccttaaaattgagtttctgaccatgatgggatgggaggtgagacaagcctcattatacctcctctttttcatggtttagacacaacaactgatcggaattaatgttaaaatagacatcataagagtgacagaacagtctctttgtggctataagataccaaattatcaacaggacccgaggccatgctaggcaaaggttaagtcacgcacccctatacctaaagaataaactatgttccaactgccacaaggtttttctttttctctagcagctaaacaggtactggccttaagagaagcaatatttaaacaatttgcacctccaccagatgctgattgacccttagcccctgctccaccagccataactacagctggacaagagattgattcagtaactttatccaaataagattactaaccatggactagttctggttggtctacagagattgcacacttgtgtgccttcatgtcctgaaaagcccttctgacgaacagggctaactgtaatatatctacatgttaagtctccaacccaaagtgaacataggccacatgttacatgcatgttggttcaatacacatgtgtcaggaccaccttcatgaatattcacagctcttgtaacacattgaatatatgtgtttagctaatctgttcagcataaatcttctacctaagcccttttccttcgaagtacccgtctctggggtcttggttggaggtgcttcccagcctgcgggatggccatcttgcaggctgtaaccctttagaagaaataaagtctcctctactttactaaattcatatatatatatttaagttaacacaagtatatctaaatgcaatcagttcatgagacagtcttaactgcactggggtccaaacaccaaaaagttgttttaggttgttttggttactcccaaaggggccatgcccagtctgcctgcctgatgggcacaaggccatttaaccttttgggcagactgcatcacttcctggtcactttgagtcatgaagactccattttgtatgaaatccaaactcatatctgattcaaacttttccttccctccttgtgtgtcagtcttggggcttaaaaagcccggggtggataagagaagctcggtctgcgctttgacttctcctaggagaggtgagggcaggtgtcatggtctaccttggatgttccctgccccaagctctacctacttcatgtgtttagttggggaggaagaaacaggaaaaggacgaggtccctttcttgtctggctgttcctctggcagccgcactgcttttcagctaacgttaacatggtctcccatgtgctctacgtagcagctgctccaacctaggttctcctgtgtccccgtgtgatttctttggagagctcttctaggatagagggcaggtcctcccactgcacagtttctgctggcagaaatctgcctctagcttgacttcttccaactcccactcagccctcctaggacacatgcatgccccctgaaggggacccagggggacaaacataaccccagactccttctgcacatccatgtggcccacatgatatggacacacatccttgtcacacagaacagtagaagggcgggctgctctgtgaacactccccctctctgccagggcatccctccccaagactctctgtgtcagctcggtaggtgctatgtgacctgcctggcagaagtccaattatggataccaaggccagttttccctcctgcaggcacccccaagccagatgtacattcctcctggaccccttctcaccaggattggagagcacgggaatgcattctgtctcctctctcatggcaaaggaggaaaagccttagttctttccacaggactcagacaattccctgtccttctccagcactaaccaatgttctgcctatgtggagaggtagctgacaggggcagggcaggattcacactgcctccttgtaaaccccgaactaggtgtctggctccatgattgatagctttctctttagggtgtgcagtgcttagtacctacaggaaaattcccacttagcatcctgggaatagatcttccaatagtgaatagatctttcactactcacagaaatttaccagagttaagaagggaaaagaggatcctacgccatacttatttcattaaaaaaaatcatataaaatttttctcaatgaagaataaagaacctacccctagtcatatacactgagagttcatacatggcttatgtacattttttagatgttataacaaatattttctatttataagctatgttgtaaatttagagaaagtaaaacctctataatttctaataccgtcatgcacaacataacgatgtttcagtcaacgacagactgcatatgctacaggggtctcacaagactacaataccatatatttactgtaccttttgtgggggttggaagaagtaaagctagagccagacttaggtatgtttagatacacaaatactcaccattgtgttacagtcacctacagtattcagtatagtaacatgctgtacaggttgggaggagcaataggctagatcatatacagcccagctgtgtggcaggtgacaccatctcacgttgggtaaatacacactatgacgtttgcatgacgaaatcacctaacgatgcatttctcagaacgtatccccatcattaggttatgcgtaactgtcatcgtgtcagtgcaagtggtaaaaagtcagaatttaaaagagtttaaaagcagttgtgtttgagttgtgaaaattattattttattttttttgacacagaacctttgctctgttgcccaggctagagtgcaggggtgcgatctcggctcgctgcaacctccgcttcctgggttccagtgattcttgtacctcagccactcgagaagctgggactacaggcatgtgccaccatatccagctaatttttatatttttagtagatatggggtttcaccatgttgcccaggctggtggtctcaaacgcctggcctcaagtgatccacccaccttagcctcccaaaatgctgggatgaaaattatttttttaaaaaatcggatgcattccagataccgcagtagttttgttagcagtaaataatttgtcaggctcacagagcaagcgacttaaggcagacctgttgtaactgctgcattcataatatgaaatggctcttctcctagacatagggtcattatactgagtgctggaattaattttttaaatccaagagtttccagagtagaaattaattatgtttatgaaaataacatttcagggtaaaacatgtattgaagtactgagttttgaaaagttttgagaaagaaatataataccagtcataaaatttcatctggggcccaaattcctagaaaagtagtgagttaagtttttttgtttttttttttttcttgagatggagtctcattctgtcacccaggctggagtgcagtggtgcaaccatggctcactgcagactggcccttccaggcttaagtgattctctcacctcagcctcccaaggagctgggactacagggatgcaccacttcacctattttttttttttttttctaaatgtgtagagaggaggtcttgctatgttgcccaggctggtcttgaactcctgggctcaagcgatctgccttcttcggcctccggaagtgctaggattacagttgtgagccactgtgcccagtcttaaatttaagttttgtttttttttttcttttttggtggcattggagacagggtcttgctctgtcacccaggctggagtacagtggcacaatcttggcttactgcaaccactgcctcctgggttcaagtgattctctcccgggttcaagtgcctcaacctcctgtgtagctgggatcacaggtgtgaaccacctcacccagttaatttttgttatttttagtagagatgagtttcaccatgttggccaggctggtctcaaactcctggcctcaagtgatccaaccaccttggcctcccaaagtgctgggattacaggcatgagccaccgcacctggccaaattaaactattttgtttttttagtttttgtttgtttgtttttgagacagagtcttgctctgtcacccaggctggagtgcagtagcgtggtcttggctcactgcaacctctgcctcccgggttcaagtgattctcctgcctcaacctcttgagtagctggcattacagatgcctgccaccacatctggctgatttttgtatttttagtagagacaggtttcaccatgttggacaggctggtcttgaactcctgacctcaggtgatctgcctgcctcggcctcccaaagtgcttggattacaggcatgagccaccgcgcctggccataattaagctttacaatgtcttcatctgtaaagaaggagaatagtacttgacctacttatttcaccaagttgttgtgcagcttcacgagagaggaaactttttcacagctaaatgtttagggcttggaacacagaaggaacacatttttaccgaatgaatggaatcatataacacattcaaaaggccttggtaaatggcaaagcattatgcaaacattagtcactaccgttatccgttatcatttttaactggtctactctattggtgccacttgtgcctttcataagctatgtcactgccaacacacttccggttaattgtaccagaaactgctgacttcctattggaagattcctcatatttcctgataaagacagtaaagggctgccagcttgccgaagagagaaggaacatttgtcattagcatacctaggtgtcaaaaggctgcttgtagagcttagaaacagttccatgaaagaatgttaatcacccctttgcaatttcatttgcctattttctctcaatccctgtcacatatattgcaaagcctcatttagtttttctgaacctgaattactatgaaacccaaacaaataggggtaagtaaaggtagacttacaactgagatattaccaataatttaatgtttacttctttgatggtgaagtcaacacacatttgaaggtgtataattttatcttcagttcagacctctctcttagctctggaaatgttttcttaaaatgcaatgcatgtctcgctcttgttaccgtcttatactttcggttaccatgacttcagctcagaaaatacaacacaactgcattcaaatctaatcacaaaataaaaagaatataaccaatttccaaagttttcctcctaaaggtggacttcctttttgatccagtagtttacaataaattatctccccttcattatggtttgtcctctttcctggagcattctcagaaattgctataacatcttccatcaaaagcaaacaaactccttcccttgccccaacatcaccctcggtttcctgctcaattactctaatcttctttaagcaaaactccctgagaaatgtctagatggtctccactttctcttttcctgtcctcatctgagcccactctactgaaactgaaacaattttctattttccttgacctatgtgacacccttgatcactcctccattccttagcctctttggctgcttcctgttatctgagcatccctggagtgttagtcctcagtcttcccttccttcttggctatactaggtggtctcttccagttgtgactcccaaattcatatttccagcccagacttcttccctaaattcaagacttggacacccagctgcctgcttgatgcttctccttttgcatttattaaatcagctcaaccttaaattaaatgtcagagaccaagctcctgatgacctcacctccctgtgagcttccttgttttggcaaatggcagccattttttttccagttcctcaggttcacaatgctggagctctcctttctcctgtatctcgcattcaatccagcagcaaagcctattgaatctacttctaaaatttcaccttcctgtcactacttgctccaagctactcccttttctcgtttgatttattccattggcttcttacgggtctcactgctgttatccttgcctccttagtatctcttctcagtactacagccaaaatgacccatctaaaatgaaagccaggtcattccactcagctccattcaacacagaagataattcagtcctaacaatgacctgcaaggttctccgttctctggtacccacactgctctacctccctaccctcctctcctacccatcttcgtcttgctgtctgggttcttgacagcaaagcacattcttgcctcatagcctctgcatttgcttctctttctgcctgacatgttctccctctggctactataggcctagctagctccctcacttccttcaagttctattctaatgtcactttttcagagaagccttccctaggcatattacatccaaattaagtctgtgctttccactctataaaagaattattctttcaagcagaaattatttatttatttatttgtttgtttttgagacagggtctcactgtcacccaggagggagtgcaatggcacgatcttggctcactgcaacctccacctcctaggttcaaatgattcttgtgcctcagcctcccgagtagctgggattacaggtgtgcaccactacacctggctaatttttgtatttttagtagagacggggtttcgccatgttggccaggtctcggactcctggccttataggatcccctcgcctcggcctcccaaagtactgggattacaggtgtgagccactgcacctggccttaagcagaaatttaaaatgtaaaaaatgtttggcacataagaacctatctccctgtcaccctgacattcatgcaaaagtagttactggtcatctactgtgtgcaaggcctgggtcacaaagtgagtagggatcaatcttgcttttaatcaacgtttatggcatgaaaattgctttctccgtggacagaaccagtagtaaactgggactgacaggctgatggtgggtctcagaacagagcaagtagatgacagctccatcaactcgataacccctattaagctctggaaagcttctgggagtctgctgatattatatagctaatctaataaagaaacttttatgaatagagccctccagtcagattctaccagagatgaaattttctgccgtgttctagccctgaaaaaaaaaaagaaaaaaagactttttctctgtttctcccttatgtttgtcataatactttcaacacttcagggtattcagaaattgaccagaaagaaaccagcaagaaatatgaaagtttcagagtgaaagctcaaggaataatgaagtgcattccttcttctggatgatagtgcttctaaaagaaaatgaaaacagacttgaagagcaaacaaaacagcttcaaaggcagaagaaaaaagggcatcccagcaaaggaagccttagccaatagccagcaaactcagtggctccttgagcagagactgggatgaaatgagacctgtcaaaggatggagtcaaacaaattcagtgcagtcaaggggtaacgcaccaaacaccttgtatgcatattttctttcagcagtgacagccccacagttgcttcttctgtgggcattaactgaaccctgcctggaaaatcagaaaattagagccttttgtttcttgtgagttacccagaggccgcaggccagcatctgattacttcttcctgcccaccatcggagacagaggaacactcctccttctcacctcttgagtgagttttgagatacacactcagtcctgtaacaactgcatgggatttagattcttctctgcaaccacactgttagcttctcaagttccctgtctgtgtctatttatttctagttctaaagtgtgaaaaagttatgcatgcacccactgaccctttttataaaaggtctcagctgaactatttcatttgcaggaaatgctagagtcaagaaaatgctgcttcctgccatttctccatctttctgaagggcaatccttccaaaacttcatgatcgtgaccttcccctgtgcctgtggggaggatttttggacagatcagttatcacctgctgggaaggaaaagccaggccaacagttgtttctctaacaacatctgcacgtgtgacccatgattgctggagtcagcattaatcaacctaccaagagtgggaggaagtaaacaacacatttggttccatctaagtccactggcatgatataaattctaacactgtcttcccaagtttaaggttttccttccattccctttccaaactcccttccctttcccattcctctccagttccctccctccctccctccttccctccctccctcccttccttcctctcttcctctcttcctccctccctctttccctctttcccttccttccttaactctaattctgggactgatatcacataaaagaagtcctcggctactaaagtaggagagaaggagagaactataggcttatgatattcctgttattcatttgtagaggtaatatataacctgtattccctaatatgacagctgtagccctaaatggcattacacaattgtttatgaaatccctttacaagaaaaaaatagagcagaggaaaaaaatgagcattgcctgtacaatccagctctcattgtgcagctccccaggttccagggatgttgcagggaatttgagtcaattgggatcatgctgtttatagcaatatgggctgttttacttgttctacctcaaagtctggatgctatcaaacgtttttcagggccactaaaaagcagaacattaataactaattcagaaaggcagtgatcagctttttatcataacatgaatggctgaaaaaaacctagattttgcaaagtaatgttgttctttgtaacatctctttacaatatacattatattcctttcttgcaaagtgaggttgtcatttcctttacttaaattcatttattaactggagcccgactgtttgtttcctgcttctgacagaaaagatgcattgggcagagtcatttattcaatgatgtttattgagaccccaccatttcttcattttatccttgtgaaaaatatgaaaaaacaaggtgcagttgaacaatcctcttgaacgatgccaagctaagaggtctctagtagaaagctcacagtttttttttcaattctactttaatcaacacttcactcaatacactgatggatgacttcaaaggtttgttgttttgaggtaagattcttaaaatgagcacattacatagttgaaaaggatcactgatatactgagtggcaactaagtcttagaaaggtcttgatagactaggattattggatgagtaactttataaaaactgctttatctggaaaaggataatgtaaatccagcgctgctgagaaaggaggcgtagctattgataaaggctgggaaattttcatgaagaaaagcacagtaagaatgaatgacatgttaatgttgatctgcccagagctggggaaccaggatgctgtacggcccacatcccccttatcacatgggattggcaaggagctggagacatttaatatagtgaagggaaaatatcaaattgtcttcagtcttaaaaaaactcttcccagcaaaagggagcagatgtattctttgttgtttcagaagatatcatgaactatgtaggagttatagggaggcttatttcaattcaatataaggcaaaagttatatcaactagaccttttccaatcatggggctgccttacaaagagcgggccagctttccagtcaagtttaggcagaaacttgtggctgtctgtaaggatgtattagaatgggtgcctgcatcaattaagagatgggactacatacattttctggccccttctcatcttaaaattctctgcttttctttaacagtacagttggtcatctgtattctcagttctgcattcttctgactgcacagaagaatcttctagctattaatgcatacagacaaaagcaagttatcacaaattttgtgatcctgcattcaaacctcattagaatagaggcccatacagaaaggaggtcatatcatttcacaatgctttacatgaagcaattgtttactatctctgatttgtaaagaatgaaaaattggatgtcaggagcaaaggattttcttcaaatacaatgtttatccatgctactttagaggtttaattctctactgaagttgcatttacataaggtattagatattcttaataggatttttcaaggaactcaaaacattgcattggagcatttggggttttggaatttctggaatgtgccacgtccgctagttcccagtttgcagagacaatatggggtgttcatcaacactgtggttcacacgacagctgtgaagctaggctgctggcattggaatcctggttctgtaccttttaatttttgtggccgtgggcaagccacataaatgctccatgcctcagtttcctccttataaagctgtactaatcagtgctggctctgacgatgatgccgatgaatcaccaggcctaagctagaccgatgatacgctattgttccaggcagtgtatttccctaaaaaactggagaccatctcaatttgtgtccaatctgatctgtcgtagagccctgtggttttatgatgcctatagccttacataaagtaatttggtcaacagtatttacagagtgtttattttagaggaattaaaaaatgactacggaagagtgaggcattgcccccacatagccaacatacactttaccaaaaaagaagcaaacatttaaaaatgaaatataatgaaatattttgaaatacactaactcataaacatcctttaatttttaaaagtatttaagtatggatatcatccataattccttttccaaagagcaccagtgttaactaggttataacatgaataggagcttcttggacagtgtttgctttcataaaaactatgatttccaagtcagtgaagaggtattagtttgggcttacaagctggaaaacagaaacagttttgcaagatgtagctaaacatgagatttactttaaaatgcatttactcccagatgcagttgagaaagcataatgtagaagaaaactagaagttatctcaaaataataacaataatttctaaaacaacccaaacgtatagtttcatagtttgtaaaacacttcgaaaaaataccattttatttgtgcctcacaacaatgatgtggggtgggcattaacctcactctaggaagagaaaactaaggctctgcatagctaagaagcgtgtccaaggttacagaggaaatagacatcagagatgggatttttcaccatgatctcatttcttcaaacctggcattctaacaaagctcatcaaattaagtatgaaaaaatgaaatcaatactcatctgatatagcaattttccatcagacaatctcagaattccaaagtcagagtggatttattcagatgcccattattgctatttctgcctgcttagaaaccagcccctcttctagcagcagcggcctggctgttcatgggaggaggtgcctccttactcctcagtccacattgttcacatggagctaaaaccacccctggtgtgggacctctgtcttgctaatcaatctgtctgtctgtctgtctctctctctctgtctctctctctcacatatacacacccctttgcaattagctcagggaaggacacttgatccaatccaggctcactggaactgatggaacgtaatactgagactttttcttttttgagacagagtcttgctctgtttcccaggctggagtgcagtggtgcgatcttgctcactgtgaactccgcctcctgggttcaagtggttctcatgcctcagcctcccgagtagctgggattacagacatctgccaccatgcccagataatctttgcatttttagcagagatggggttttgccatgttgcccagcctggtcttgaactcctggcctcaagtgatccaccggcctcagcctcccaaattgctgagattacaggcataagccacgatgcctggcctgggactttttttttttttttttgacactcttggaaagataggttctctttcttgtaacttcaagttaaacagcaatttggcttgaatctctccacacggagagggaggctctttgggaaaagagccaacacagaggacagcagagccaagagaaggagagccagagagcaatgcagcaaaacagcacctggatccaggactcctgcccttttctgcttaagccatcttgagttggattttttgttacttacatgcatctggaaaagtccttgctgataaattactttaggcctatacgcacagaattaaccaagacagggccacacaaacagccctatttctactagatgttaaaaaaccttctttttattttttttaccactggaaaaagaaagggaagaaggagaaggagaataagaaccagagaattctcctacccttgaaaatttagcaagggcagattataacagccaaaactgacctgtggacccaagaactggactgcatgtaataagaaacattctgaaaatttaacaagtggaaaaataacctgctgggcctctttgtgaacaagctgctcaatgtcaacaagcccaaggcaccactaaatatcacaaggtcaattccactgaaatagggtttttatatattgtcagattttttgtttagttgttttgaaaacagaatattttctattgatatcttctttttctttttttaaatccatggtctggttttaactgcaaacaggacccttggttaagcaccagcacatggagacaaggtggagacgtcagagcttctctagcaaaacgactggaggtgtttagggctgacgggtctatcagaatcaactctggctaatttgccttcttgatgaccttgacagggaagaaaacaatctagacctgtaagatgagtatcaaagcctgaaaaagaatccatctgagtgattctcccacttcttccaattatttgttttaagactatagtacagtattcacaagacactaatcatattgacattagtgttgcccaaaagacacttaatcatactggaatttctaatcccaaagttgtctcagatagagcagggtgtatttgctaaaagaaaattaactgaccatattaataaaaaaggtgtacaatacatcaggtttaaattccaagtatggaagcgctattttccacttttgtgttggtcatagctggctagtggcctagagttcttggcttgaaatagggcacagatatcatcaacattccagatgatctctgaagctcgggtgtcagcttgtcaacttgacgagctgtcaaatcggaagctcctgacggaagagcttattgagtgcactcttgaccttcttttttggttatgtatgatctgtctgtgcttaagtattaagagttgctctttagaccttcatggaaggaaatgttgaaatcatggacaagctgagcctttctgagtagtggctatgtgatgaaaatctaaattaaatctaggcattaacttacggacattaaacaaaaaatctgatgtgacacagtaataggaaaacttgtttagtttggggaaaaaaacactctcttttctttgagacagagtctccctctgtcactcaggctggagtgcagtggcaccatctcagctcactgcaacctctgcctccagggttcaagcaattctcctgtctcagctctcctgtctcagctgggactacaggcatccgccatcatgcccagctaacttttgagtctttagtagagacggggtttcgccatgttggccaggctggtctcaaactcctggcctcaagtgctccgcccgctttggcctcccaaagtgctgggattacaggcgtgagccacggtgcctggccaaaaaagccactttccaaaatgctgttcctttcttggttgtgctattttctgaaaactgattctgtaaattccagtaatgccagagcagtgggtagaatttctgggaacaacaggcctattctctcaggaaaagtatataagaggagaagttactgtcctacttctttcccagacatggcaaagtgtttgcctcatggctttctgggatatccatgctttttaagctaacagttctgtgcacaatatatttccataaagttccaaatttcacttaaagaaaaaaaagccctctcacttgatattttatctaacaatgttacaataataacgtgttattaccatatgatattttttgttacaattttgtaacctgaattggtagagaaatatggcatccattctctgctttccctggctttgacatcattctacccagatccctctgcatcgtgatatatgctccttggcagatgatgtgtttacacaattaaaataataaaagaaaaatgcaaattccattctcaatctacatgctaaatatgggtaacactggaacaaaagatggtctttatagaatgctacaaccaccggagcacttgcccttcaactctctttgtcattaattggcctacaatgagcagggacctttgaattagggactgacaggtgatgggtctgaaccgatagtcatatctgtctatatagtgctttacagtttagaatatgctttcatataaattatctgatacatacaggcctgagaagcagacattatccacattttaaagacaaaaaaattgaaattcagagtcaccacataactcggtccaggtcacacagccagaaagaaaccaaatcagaattccaaccgaagaagccactaagaaaacagcatcgactatttggagaaacaccacaagcaagaatttgtttgtagacagagttaaccccacacctacctacaaagcttttcacaaacatgggagacaggcagcgttctgacacactgtgcagggtctctgctgaaggatcaacaaataaccagtgcagttttgcatttaaggatttcatggtgttaaccacgagttgattcaatcagtttccactaaactactgtgattttctcttctgcttgctgtgcccacataaatggaatctattatggcacatgagaaattagtatttgttgaactgtttttaaaatattttatatcattttaatacagaggcaggcacagggcatcagggactatagaagaacaaggatagggttaggcaggccagggcttgagtcccagctctaccatttaccagctgtgaggccaagcactcaccctgtttggcagatgtgcacataggctcttgtgaggattaaataagatactgcatgtgcaatcccaggcatgaacctggtcacagcagtgcttctgtatggctcagcttctacttcccttcctttaataatatcaaaacaacaaaccttggaagaactaaaatgtaatatacaaaatgctttcaaatagagaagtaattgacctagttgtacttattaatactatttagattgagaaatattaagcttgcaactgaattaattttctaataatttagaaaaagtgtctttagtgcccccaggtaatactgcttttttttaaatcttaggcaagagcattcaaaacataaagattttatattacacactattctcactaatatttaagctaaagtttatgcaaagatatgcatttcttttactgttgagaagcctttgttttgtgaaaatacaagtactatttcattttctcatacgtttttctgtaaatggaagccttctataaatggcttaacttgcagcatttggaaacttttttttttcttgcatgagtttggagaatgtggccttaaccttattcattccatcactctcttattgttcattttaagggtacttcgacttctaaatatcattcaagaaaacttctgaagactgcaattaggtcctaaatactgaaaatattttcctccttctgatatattttccatttactatctcatttccacataactcagaattaaaagctgatctgccatgtgctgtacacacattaatagtgtgtaggacaccttgtttgtgctaaaatgagataacagatgtcaaagtactttgagaatttaaaatcactatgcacattaaggtataattacacatatgtgaatgcaacatttatttattaggggtgtggaaattggggagtgtttcagaacttctgggctaatgagtccagtttagaattacaggctggagaagctatgttttcaacatgataggaaacccatcattcagatgtatttatatcattacattcagttcatgctgaactcaaattttgtttcttgcatattcatttaaaataatttgatgccagagtactgcttatatcagaataatagcaaacaatactcacaatatttgcaaatcccctgtatcccaagacaggtattttaaatattgtttcaaattgaaaaaatcaattaaaccccattctagtgttttattttaaatatctgccaacaaatttaacaggtaaaatggacattaaatttatctcaatttaactttaagcattgcttttccaagttaagcaaagcacctccaaacatctggtaagcagacctcaagaaggcaaaactcctaatgaattattgcggccaccaagaacttaaggtttctggcccagggctagaattccaaatcactctaatggtagctcagctaaacttgaagtagaggggtttctaagaacataaatctgtccaggtgattttctctcaactgcattctcatttcttttagtaggtaagaaagaaagcctgaaggtggacttttgcattttagtgggaaatggactggttaggcaagcattaaccaagctacagtaagcttcttgggagaaactccttgggaaagaactggaggaatggagctccaggttggaaggaggtataactggctgcttgcttgcaaaaattttaattgctaattcaagtctttaggaagacccaactcgattgtctaaacacataacttcaggggaaaaagtatggtctagagagatatgacaggtttttaaaaaagtatataaatttcaaaaagtattacagcaaatgaccaaaaataaggtagaataagaaaaaaacaaacatcaattgagtagttgagtggtgaaaagtcacataaattgaattattcaacaacaagatgacagagtatttcatattttgacaggttaaagcagtatttttaagaggtatgcattcattgctccatgggttttggccttccatactagcgatcatgctcaaaactgcaattaacaccacccagagagttgcagttccagaatccctttttctcattgatcagattcctgtggtgtcatctcctattttctctgcagcagaagtgctgtattgaacagcaggcttttagaaagcttctaataagctcctgatggctgatggagcctgtgtgtctagcagtcactcgatcatcgttagtactccacatgaggggaatgcatgcgtgcacaggtgctctagttcactacgtcccatcagcctgcttatctcactctgttttctgcttttaggcttttttcacctggccagataaaagcccattccattttctcaaggcaagacaattctcataagggatgcatttctgattggagtgacccgttaaaagatttgtgctatttggtactactgcccctgctttcgaaaacctcaggcagcatgtaagggtgcagtcttgctaggccacctctgagtgtttatacataggtagaagggtaagtcgttttttaaaaaaaccctgcagtatatggagaaatttcataaattatgtgagcagctgagagaggtaattctgctatactgcggttgacacagtcaataatagctaatgctcattaaagaactatactcccttacccagggaagaaatgggctcagaaaagacccagttcatattaatacacaaagacaacatggctcaaagttaaaacaaaccacatctctgaaatgctgtcattagagaaatttaaccacatatgtgactcgaaaatataacaagtaacgaaataaatgaaaagtttggggggaaaaagctttcagatgccctatttaaaagagcaccagtgaaaacagtaataaaaattaaaagacaatacctagcaacagagaaagataaaattattcttatttctcctatattttccatcccctttcaataaaagagtctccataatcccaacattgccattgcctgcacaaagaacccagagaacaattcaaaattaaaggagctgaaagaagacacagtatcccaggccttctctccccaaggcatctgcaggcagaatagccatggtttccagaacattctcatcacatttgtctctcgtgagctgcagcatacaatgtttaccagaggctttaaaaataaaatctcactaaacagttgagaaaaatatttaacaaccaaggcaaagcaattacagtcaaattttcacctcgagattcccatcttaggtgtgggaggcagagagaagactcctgcacatcagtctgaacctagaatgaggatgaaaagagttgattctgccaatggttgacaacaaatccatatttttgaatctcagggtgaaatgcggagctacccgcccatctgaatgtacattaagaacagcgccactgttcggttaaggctgactcaagtttctaagcagcaatccgaggacaggctagacatgaacatccctactaaaaacatggaaaggtctgaacgtgacagatctcccttttcaattacttgtgctagaaagcatcatcattttcaactagtcaaggtgacaatatgagaaaacgcaactagtcccagtagagcatttctgtatgaatgtatagacttgggaggaaattaaccacatcacacagggttaatccttccccccaaacttctgccccattatccaaccaatttacattttgtaatctagacttttattactcattttcattatgatttgactttgacactatattattcccttcagggcaaagactttctgggtgcaatgagatcagacataatttcttcagcaggaatgcataacaaggacatgtgtacacattccattcccagacatttctgtctcggtctagttcagatgagcaaggaatgaaaggcggggcataacatggtataaattctagttaggcacggacaataagcatccataggaagctactgttcactattaaaaggcattacctgatatggttgaaaaatatcacaaaggcttataacaccttacctgagccatctgcctctccagttttgatcggggaatatcatcaaagtagttttcatttcttctcctccttgcatcgccctgcatgataatgtgaggaacgtctagggagccaccagtggtgtaagtgctttggctaagtgatggagacaactgaggaggagtgtgattaccactgggttcctgaatggaaatacatcatgaaataaataccatgttctgtggctaacctttggtttcaaaattgtgaaatactgacaagacaaactgtgggggtggggagtcgcttttgaagcaacagccaaggaatgaatgacattccaccactttattaatggcatgatctagtcaatacgtttttcccctaagtatttcaggtcaaaggtctgaaatatcaagagtcaggttctgttttcctaaagcagcatcatggatggtctcaggagggaggcacacctatgttgggcacctctgacactactgcatgtgtttacaggggaggaactgggccctcatgtgggcagagcgtcctcaccatggtagatgccatgatgagaaagctaaaatgagacccaatgggtcttgatccttcatcaaagaatggtctgacaacagggttgggaagaggacacagtacggcaacacagcatgtcacacgcacagactgcagagcagtgcatgctacgacagaggatgcttttccaaggcaaagacaactccatccaagggaaacgggtcaggaggaagatagggggcatagacagctcagctctactatttgcaagtagaatgaggattgggatcatggtgtttctccagatcccttctcctccggatattctggaccttctatgatagatttaggtcctatacttttgcatggaaatctctgtctttgatctttttttgttcccctaaatctcttccagagagccagaatgagaggttcagaaggggaaggaaaaagagcagggtaagtagcaggaaatgactcctctaaagagtcattttagggtgactacactgatggtgcttatatctttctctccttccatgtagcaaaatgaaggcaaaacaaaaatcttttttttttctaatttatttgaggctcctctttctaaggggtgaaatttctatttgtacttttatgactcccaaaactctcaagtagcctccaaatatcccagtgtaccctaatgcccccagtaattaattaaaccagtattcatgtagtccctacccatcccactccagtctctctcaggaggctaagcttgtcctcctggagccaattctcttgcatcccctgaaatccttgcgcattttcctctccaaagctgaatcaactccaaatcctaacagctcctttcctgtcctgccctctgttatcctgacagtggctatgctgtttgctgaagtttattgataagaggcagcccactgcatttcatcacgatggttacgtccgggtgccgtgcttgtgttcatctcttcagaaaagaaatcagaagcaagcaagtgcaggacaaaatagagagcagagtgggcaccccacagctttcagggagatctcagcttttcgacgaattttagaaaagttcttgtaggactcatgaacaccagtgactgccggccacttcttgccactgccatttttgcctggaaatcatctttctcacttcctctctgccctttcctccctcccttccttcacttcctctttatttctctctcctttatacaggttctctttagtttcctacctcataatttttttttttttttttttttttttgagatggagtttcactctgttgcccaggctggagtgcagtggtgcgatctcggcccactgcatcctctgcctcccgggttcaagcgattctcctgcctcagcctcccgagtagctgggattacaggcgcccaccaccatgcccggctaattttttgtatttttagtagagtcggggtttcactgtgttagccaggatggtctagatctcctgacctcatgacccgcccacctctgccttccaaagtgctgggatcacaggcatgagccactgcgcccggcccctacctcataattctaaagtgtagttgaataaaagaaatacaatttattaagtaaggttttagattctctattctgaatttttgaagtgagtaaagctggacaaattttacttcttgaaaaacagaagaccctaaggttaattttaaattgatctttacttaactgtggtccttgatcaattttctttctgtgggtttgaggagtctgacagaaaacccatttccgctctcttggcgtagatggggtgtgggatgggaggtgagggagtggttctttaaaggtagtggtttgtcaggctgaattccattatagatggatatctaaatctcaaaaatatatatttaaccaatctagaaaaacaaatcttgttgttttgattgtgtcaaacaatcaaaagacagattgttttctacacagatatggtaaacttcatagaaaagagccagcacttcctgatctattgcttcagttgtataaagtgcacgtttataaaacctataaaactacataaaataattcttttattttcttactctgttgcccaggctggagtgcagtggtgcgatctctgctcactgcaatgctccgccttctgggttcaagtgattttcatgtctcagcctccggagtagctgggactacagacaggcacaaccacacctggctaaattttttctgttttcagtagaggcagggtctcaccatgttggccaggctggtctcaaacaaatagttcttaagataagggcagagaaccagatgaatgtgcttggcacttaccctgagggtgatggaccgagggggcttctgtgggggatcgtcgtgcagcctgtctcccagagatgccaaaatacgtttcctgtggccaatcaaattgatttttaaaacctgaaacaacatatatttgggttaaatatttcactggagaacaaataatttttatatgtcctaaaacatgtggggtgaaaaaagatttgtgcaaagttactcctgcaccatgagatgtggtgtcacttcagtgtgaccgctgaagtccagaaagattgcagtagcatctggaaagcctggagtggctaagtatcaggggcacaaagagaagggaggatggttctccttccactcatgctgcctgagagcctcattcccaatgcagcagcctcaagagaaaccagctcttcttataagcagccgaaacctcacaggataaaatctgagtctggactcaggcttcagagggacaggctgccctctgtctctttccctccatccaggatatgcagtcatgccagcctcctctaggtattagaagctccacattcattctcaccttggggcctctacccctgctcaaccacctgcctggaatgccccctctcccctctgagattttcaaataaccagtgacttctcatggttctggacactgtgctgctgatgtctcctcagaaaggtcctcccccgcctccttattgaagaagccatgccctcaacccctgacatgctctccacgatgatccatcctcattttatcacactctaaaagcactttctttacaagcttagtgtttgtgttttgttccaccctctccaggtaagctccctgagagcagggcactggcatatgtagagcactattatttcccaaaagcataaaaggatgactaaaaaaaaataagggattaatgaatatgaaagaatgaatggtaatagagatgggagttgcaaaattagagtcatcttgcataaggatacagttagaatgaaggactgcctattggggtagactcagagcctccccaggatggtattttgaatctgaccatgctgcaaagggcacatggtagaagagctctcaaagggaactgagaattgcagcgcctcaatcctcagccccattcccggtgctttaccagggccacacccctttcaatcttcccaacttctctatctggaaggagttctcacttgacagatgaagaaactgtggttccgagtggttaagtcacctacccaagagccagcatgtcgtggctctgggatttgaatcagatttgcctgattccaaagcatgttttactccaaagtatacgtcacaaaatttgggcatttctccaaatgttaccagcttcttaaaaacacattgtatattcatccattcataaaaatgtgtttacctcttccctacctatgtgtagtcccaggatataataatcttgttgggtaactagtttccaaagtcgttatcccatgtgtacatttttctcttctcttttcaagttttaagatagaaggtggggagagcgtttctttggcaggcatcccatgataccttgaattttttttaaatttcaacttttaatttagatgtaggtggtatatgtgcaggtttgttacatgaatacactgagtgatgctgaggtctgggatatgaatgatcccgtcaccaggtagtatgcatagtacccaataggtagtttctcagcccttcttcccttcctccctcccctcctttgtcgtccccagtgttcactgttgccatcgttatgcccatgagtactcaacgtttagctcccacttataagtgagaacatgcaatatttggttttctgtttctgcgttaattaacttaagggtaatggccttcagctgcatccatgctgctgcaaaggacatgatttcattcttttttatgtctgtgtagtatttcatctaccttgactttttatttgcctatttgttggttaacttacgggccttttggcctaaactgatgtagattttaaactcacactacgccctattcctttgacagccaccctctgacccatgtctgttgatgatgaggagggtaaatgttagccaaggtgaatgtccccatgcaccatatccctatgattttataaaaccttcatctccccaggctgattaatcctaatctttgcaagtttgttttcataaagcagctcctcttttccataaatcatttcagttgacatcctcaggactttctcctaccctattatagctgcttaaggtttgctgaaaaaatggctcacaatattccaggtgtaagtgaaccatggctttacatttatgcaggatactgttttctgcttttaatacccgtttaaaatgtccttcctaagcacacgtgatttctagctagccttttagctgcagtaggaataaccagggacaaaagtatacactgactataaaatcccttaattttgttatagctaatagttcaaagccctttaatctaggagggatgatttgagttatttttccctaaatttcttatcttacagttgtccaggcagaagcccatctgccatccttctgcccactcacacagccctatgttagctttttgcatttatattaaccagtttggcatttcactacctggaagagcttagtgatttttgcatatctggaaatttcactatgtattcctttcagatgatttataaatatgctaactaagtgtggccctactgctgattacttgcaggcagcattgtttatacgatccatagaaatgcccttatattcttgtattgtttctgtttttaagcatcaagaccaaataattcctccatctcagaaaaaatatgataaccttttcaaaggtattttgcaagtctaaatacagcatattttctaattctcttttattctcatcctcaattcctttgccaaaggcttctattggatataaattcctcccataaaatcttcaccgcctttctcccagcaggtagctggacctcatgctgatggtactaccttgccccctccctgagtcctgctagaaatgttttttataataaagacatttgcttaattattattattattattattattattatttacaaaactgacactaaataacacataactgtggtacaattgagctgatgtaatccccactattgcttttggtttactctcccacaactcaattttgggcaggttacctgactcctctgatctcaggttttctcacatataaagtgaagaagttaatgacaatttcaaatgtggttgggaagatgaagagtaagttgtgagaataaccagcatagtgcctgacacatagaagaagcaactttcacagtgtgcttattccagtgaatgggttctgagggtgcacaggaatcctggcccagaagaacaaggacttgttcattgtcataaagtcaatcatgttaaacaaatacactggagctttggatgaagagatgtggctaaccttgggaaagccctcaatgaagtaacttatcctagtaggaacatggctgatttctagctattagtctgaggccagacccaatttaaaagaatatgctcttctgccatccacatcgcttaatcttcaataggaggtaagctgaggcactcctctgcactgaagcttcattgctgtctcctccatagagctacccagatgagggtggacggatgaatgaatggattgatggatagatgatagatgatagacagatagacaggaaacgaattaacacaggatggttagtactatcaagatcacctggataactctcctttttatcagaaatgagcccccatcactgaagatactgatggtaacttccatttactgaacattttctatactctagttctatgtcctagttgtgctagaaactaccaagtggttatacacaaatataaatatctcctgtaatccttacaatagcatacaataaaaccattctcattttagagatgcaaaatctgagattatgaaatgctaagtaacttgcccaaggtcacactgctaagaggtacatggctaggatgtgcacctgattcttaaccagcccttcactactctccttgctcttcttcttgctgttaacctctataccttttgacctttagctacactattggttatgtcatcatgaggcttcttaagatgttgcttcttactttgagttatcatgtttaaagcatttatatagggttttgagcatctgaaaacattaaaataattcactttttagtaaggcttatagcattgttaaagctacaggctacaagggcaggtacctcacagtattccctgtgaaatacacatatagaccaaggacaggaaaccctcatcacccaagattcaatccgagctggctcactgtggagtggtagagagggtgacagtgggcttcaaaacgcccaagttgacagtaagaaatccaattggcaaaacaataacagagagaatattccaaagaaagatggtcattatggaaaagtcaagtctgaaggtggctgggtttgccttgagtgagaaaggctttatagcagactgtctttgcaagcagatggggttcctgagtagtggaatcctacaaccccaggcatcatgggtgataaccagtgtgaaaactttagttttcaagaacaccaaagcaatggttactgcagtagagaagaattctgtgttttcgttactgtttgggttaaagttaactgttcagacaagaacataatgggagtaaaagacaaaataatggtaatatattggagattcagttattctaagatgttgaagcaattcagttcggctcaaaaaacaatactgaatttctgctaccaattatttggaggattcaaaggggaacgtctatgaacagagcttacaatattggagagatcaggcacaaataactacattatcacaccattaactaagaaaaattattatacacataagcataagaatgtggctccaactgctgagttccaatagataagaaataaaagttggccaggcgcagtggctcatgcctgtaatcccagcactttgggaggctgagatgggtggatcacgaggtcaggagatcgagaccatcctggctaacacagtgaaaccccgtctctattaaaaatacaaaaaaaaaaaattagccaggcatggtggcgcacgcctgtagtcccagctactcgggaggccgaggcaggagaatcacttgaacccgggaggtggaagttgcagtgagccgagattacgccactgcactccagcctgggcgatggagcaagactctgtctcagaaaaaaaaaaaaaagaaaaagaaaaggaaataaaagttatggcatgtgttcttaatggtttttattacaactattgtaagaggaatgtgggtcaaaggcaaggagtattgttgaaaccacaggagtcagccacaggtgggtatccattcatcacagcagtagccgcctccaggaattttctccagtatcacttaaacaggataattccggaaaccccactgtgaatctcagcaacaggagaataatcatgctggatgacaatcctataatatcacgtcactgctgtttatgtttctgggtttggctgtgggaattctgccagacagtatcatgatatacccttacatggaatagcttacttcagaatatatgtcatagcaaagctgaaagtcaatgtacttaaacttccttttttcttttaaaatttaatgtgatataaaattaaacatgtttaaatttatatcacattaaatttaacatgtttaatttaaacatgatgtaaatgaagcatttttatctgcttttaaaaaagtaaataacattttgattataatagctatactgctttcccattttagacactttataaaatacagaaaaacaagtaagagaaccagtaatccacaaactatatctaaatagatatatttcatttctcccccatgattatgttttgtggtggtcatatcacgagtaccattttcgccttttcttcagttctttaaagctaaagaacttttctacatatacaactctcagtagacattttaactaactccatattatcacattattgtttcagagaagtatgtcataattcactaaacatttcccctatcattgaaaattttggtttgtgctcctttctggatagcaaacattccacatgcttaaataattctatcatcctacaatttccgttctcaatgccatgtttacatagacacagcatagaaaacaccaaagaagactgcaagaatcacacaagtcacgcagaaaagtcatgtagcaacagtctgtctctatgttctgcatgaaatctcaatccgtttattgccggctggaccaactcctgggaaaatcacaaacccacataatgttcctcagtgccatattttgcattttgttatgtttttggagttcagatttagctgacagatgtgaaacagcacatgtagctggaattcttcagagagtacacatgcagcgatgctgggcacacaagcgattctagttctcaccaccaggcgactgcatcctttttatttctagattgttattgagggagggagttcatcctgcatttggaactcccttccattttagggggtagattatttcccctttcctttctagatacttggccaactaaagagaacagctcctatgcaagtctgtagagctcacctggcttcagagtagcctcttctaataaaactgcaagtgttctgagcagttctggtgttcctaaatgccaagaatggaagttgcggtggaaactgatctgctttgttctcatctgcagaactaaaattgcaaataattgtcaaagttttcccccctgcctgataacaatttctaaacactttccacctgaaagcatcaaggcaaaagtgcctgtgtaaaattccatttcgaattcctgcaatcttagaaatcctcacttgaacttgcatacagttttgaccatgacatttttctctcttatttcttgaactgcaataatccatgtccagcatgggatggtgaacagaaagacctcaggagcagaaagtcatgacatttggttcttctcttactcttcttctagctaagtaatctttaatgtctttgagttgtaatataaaggggacaataacagtcttattcaacaaatatttcttggatgcctttcacatataaccaccatgttatgcaatttgtgagccacaaagaagaaaaaatatcgagtcctccagggctctcaatccaggcagtaaaaaaatattaaaaccatgtgaacgtatgtgtgtgtatatttgtgtgtatgtatgtaggcatctatgtatgtatgtatgtatctatctttctatcatccatccatccatctaaatatatacgtctacacagccttcccagcctaaaaggggtttctgtggaatgaatgagaatgactaggaagcttatctggaaattataaagcacagaactaaggtactaactaaggtattatttctcttttaagtataacagaaacttaaaactttcttaccctatcaacaatatttagatattacctttgatatttaaatgtgccattatggatatctctgggtagattttagatccagaatcatgccttccacttctccaatcttctctcctgttatttctttgctccatgtatacacacttgtgcatattccagagtgtctctgcctggattttcattagaatctcacaaggatgaaatcgagatccacctaaagccttgcttgctcaccttggattacatagacctttctctctttgaatttctttagtatctgtggtctaccctgtgctgttgacacatgatacatcctggtgggtatagctaactctcttttttttgcgtatgtgtcttacctgatcaactagactctaggcgctgaaaagtcagatatagtgtcactgcatctcagggtccctgaatgcatctagctcacgaatacaactcaaaggtgatctctaagatctcaactcaaacccctgtcaaggtggacaacaaatgaagcaggggagatgtctctaaaagaaaaagagggaaggaaaataacacctatgtcttatttcattccgtttctactctcaagagtcttctattctttctgagctttggcaccttaattcctacacacagtcttgccacgggtgatgcaaaacttccttacatcccaccatctgtaactctttccctttacctctgccacttcatctaaaaaaaatccctctgactacagtttccaaattcccttttccttctgctattactttccaaaccaactgctactaaataatcagcaaataactgtttgacagatgccaccgaaatacaactgtactaacctatggaaaggaaaagaggttccaagttatacagctccagagagagcaaaggatagtgagaaagagcgagggaggaggaatgcgtgttttctgaatgtagtctgtctcattaaataggaaatactaattatgaggaaatgagatcatctttgcatggaaagagagaccttaatggtataattgcctctgaacatttaagggctctggaggtacaaagccttcttttgtaatcaatgagaatcttaggtttatttgtaaagctctctgaattacctcttgatgaaggtactaattttctgattttcatgtaaacattgcttcagaagattaaaaacacacacaaaacaaaacaataaatcagttcccaactaatttccctgaaagttacttttaagtaaagcttgctgccagttaagtttttataggagaaatttggtttacattgctcaataacccaatcattggggttattgaaggaaaaatttgttacaaaagaaaatgggaagtatgtgcaacatcccagatctgaagttattcttggagatgtgaagatgtgctaatagcatctgaaaagtgcaaatctccctgcagtactatgaatacataaaaatgctctgcatcttaagaagtagagagactgctgttttgctatattttgctaaccatgcaggatatttactgctaacgagggtattttctaactttatttcctttcaatttttgagatcataaaatttatgatcaattatattgtgtgactgatgctctcagtattgtaaaggaaattatggttaccgaaattcattaacatatatccatataaaataaacagaaacacgcaacatacatgaacacacccatatttgtaaaagaagctctaagacaaattgagtctcaagagacaatcctaggtaagtgagggcctggttactccgtttttggattataagtggtcttttctgctctgttgctgctctgcccctcttcttgaggtttagctactttaatggcatataacaccctccatcagcagacagaatagtgaaagaggcagtgaattcaatccagccaattctgtttctgtcagcagctctgataaaagggttttatgtgggaggaggtaaaaaatctacctaaaactagctaaactaaagttttaaaaatgcatccacagattttacttagcctagccagctactactgcactttagaattggacatttaccatatttcagctacgtatggaggcaaaaaggatgttaaggttaaaagaaagtattataaggaaagcagaggttgagtcccaaggatgagttcaaaaagaggaaaaaaaaaggggtaacaacagtgagagagatttcttatcgtcccttttctccctttgtccccacccccaccactatccccttccttatcttctggagagtcacatcacagagtagagctaggaatcaccctaaacccataagaatggctaatgttagaaaagaatgaccctacctcggatgataaggatgtggaggaactggaactctcatcttgctggtaggattgtaaatggcacagtcacttttgaggaaactgccagtttctcaaattttgacccagttttctaacatataacccagcaagttgactctagctagcaactcctagctaaaaatgaatacatatgcccacataaagatgtgtacatgaatgtttaagcaacattattcataatagctaaaaattagcaataatccaaatgtccgatcaactggtgaatggataagtaaaatacagtatattcatgcaacaaaatactgcctaatgatacaaaggaatgggctacatgatacaggctatagcatcaacagacctcaaaaacattatgctaagtgaaagaagctgcacacacaagatgatagaatattgtaggattccatttacatgagtttctagacagcataaaactatatgtacagaaaacatatcagtggttatctggagtaggaataggagcagggattgactgcaatgagcataaaggaactttttagggttatggaaatgttctaaaatgggattgtgttgatggttggatagctgtataggtttactgaaatttacccaactgtatacataaaatgggcgattttcatgatgtgtaattaaattgcaatgaagttgtttttgaaaaaagaataatgctgggagaatgcattcagtatgcagtatcgtataaataaggccattcctgaaggctgtaatccaggctgctcgagaagacctctgttgtcttggaatataccacttatcagctggatggaagggtgagcaacatatacactgcaggatgtcttaaggaaaatgtgacctgcagggtagctttgttctaggagcctagtactatttaactataggctaatagatcagtagcatattctttattataagtgcacaatacagtaaattagtacgactttcctatgtatgtatatttttgagggtcttaatcctccaagtcataacacttcagtaaaaatgtttatgctttctaagtacttacaacaaatggcttatggatgtttgcggagtgatcactaggagccaacatgggttctctctggatgggtaacaggtggtgatcatgagatgacactcaagaaccagagaataaggttgcattctaagcaccaaattaatcacatcaacagtgctatgatttgagttttctctgacaaaaactcagctttaaattggatctccaatgtggcagtgttggcagatggggcctaatgggagatatctgggtcatgaggtggcgaatcctccttgaaataacttatgccattctctcaggagtgagtgagttcttgccctggcaagactggattagttgtcacagggatgaattagttcctgcaagagtgggttgttaagaagccaggacatcctgtgggttttgcctcttcacacgtcagcttcccctttaacctttcaccatgttgtgatacaacaccagaaattctcaccagaagctgagcaggtgctggcaccatgcttcttgaacttcctagcctgcagaaccatgaactaaataaaccttttcttctttataaatcacccagtctcagatgttctgttatagcaacacaaaacagactaggacaaacaaagcgactggagtcagaatgactttctagcccatgaagagtcaatgaaatagactggcagtgtgactacagtttaatcggtgatactgaaacccagctaaataaagaaggtgtgccagggtggggtggagaagcaagggtagagggcatattgaagcagtgaaactatctagctttggcagcagcatggggagacactgaatcttaacataagtaagctccctgattactcaaggggttattttatcaggttttgtactgatctaaatgaaacatccctcaaaattccctttccttcaataccacatgtaccaggaagcagtaattgctgaatcagttttctgagtgcccagatatgagaagaggaaatgttgaagacgggggatcagggaggggagcatttggtcagagaatccttcccatcatgtattaacagaatggacatcttgatacattgatctctccttaattaaattaaatccacaccaccgaggcacagaacctgctcaggagggcatagtgattaagagcagggcttggtgtcaggatgacctgagtgtgagtgttggtactggcatttactctatatgccttttggtcaattacttaacgtctctcagtatcacctaacttgtgtaaaatgatggagctaagaaacagtattcgcctcttagtgtaattgttaggattaaatgagacatatgcaatgcatttagcacagtgcctggtataaaatgagcttcataaaattctaacttcattcagtgttttgattaagcccagtttctgaaatggaagggctgagccctcccctggaaccccaccagaaggagctcagcagccagccatgcaccttttccctggcaacaatccctgcatcatcagccactcttcaaactttggtggcctcattgaaaatcagtttttgccaaactttattgactttctttttttgacaggtattagtatgaggttgacagaccaggagaatgtcatagatatagtgtctttgattccaataaagcacttgatgaagtctttcattatctgcaagatggtgggctctatgagggaaaaattaagtggattcacagctggttgtacatctatagccaagaggcttgatgaatggctctgtcataacctgttgggggaccactgattgaatgccacaggctctgcccctggattctgctctattcaatatttttattaatggcatcaaaatagacataagaagaatacttatcagatttttcaatgacataaaactgtgaaaaatatttaatataataataggctaatgtaaaattcaacattctctcaacgggctgaaaaggccaagctgacaccaaaaagatgcaatttaacagggataaatataatgtcttacattaaggatccaaaagaaatcaattgttcaagttcaagatgggaaagatatggctgtgccacagttcaaagaaatagctgaatttttagttaaacgtaggaaggggtttagcagaaagaatgcaaaagtatgggtctaatggggagggaatgaacccatttagaataattttaccaaataaataatctcatttaccttgctattacaacctaacaaggctggtaattaccttaactttagaaatgaattaactgaggttcaggaatttaaggaacttgtcaaagtgatgacaaaatcaggatttgaatccagttccgacttccaaaatttgtgcactttggattcattctatcttgctgccacttctctcccagagatgctgtgtggctcaagtgagacaattttaatggacgtacctagcacagtgcctggctcctaccttctgctcaaaagtggctgattatttttctcccagagactcattaaatgtaaggctgggtgcttatatgaacaaccagtactttattattataatatgaactctgcagtctattctaagtcttttcaagtttatccattaatatacctagtgcagaaatgattctgttgatttttattctctcattcaccattatttccaaatccttaatgccagaagaggaagtccagcctggaaaaggcactggaaaatttgagggcaatctaaaaatctctgtcagtcagtaatgattcccagataattaaaacttttttttttttttaattaaggtaactttcaagggctgcattagtggttcaatgctgcgtattaacatgacaaaaacctctattacctttagataatgaggtggtgtgttaagtaaccttagtacaatgatatgcatacagaatgtacaaaattttcaattaattcaattatttaattagtttagcttatggttaaaaagatacttttttttctgttgttggaggtcttattagaattcttcatatatatatatatacacacacacacacacacacacacacatatatgtacacatacacacatatatatatatgtatattttgttctttcctgcctaagggtggtttattgacagtctttaattcttccctagatatctggaatactgcattgcatctgagtcatgctctgtgtagactatttgtcactgggccacagtgctgctgcaaaaggtggctgaggaatgcacactggctccagcagtatcctgtaagatttagctcttttaaataaaggaattcttaggagcagttagttttcattgcctcttgcactaaaagcaaggcctgacaacattagctatccaaaagttccagttaatgaaggtttcattgtaaaaaagaatccatttgggggaaggtgcaaactctttgtaattttctctccctctttctcttggcctaggccagccatggttcacaaagctggagaatggagaatcattagctgctgatggtgctggtcatcccaccctggcaaggaaaggaacaggtatgttgagtgaccaggttgacctgtgcagtggatgagccgaaaacctcttttgtaagctgttttgtaaagatatggagacaactgatgattctggaggtggaggatgctttgagggccagaacacacactctgcaataaagcaggtcacttccttcaggttttaagctaaaatgtgaacacatcagtggactttcacataagctgtgctttctttctggaatgtctccttttcctcttctccatctagtgaacctctactcatcttctactctttcgagttaaatactacttttgaacaaataatagcaaaagaacaattaacggcaacagaactttggaatgacagttatcaaactagtcctgatccataaacaaaagtctacttagcacattgtgtgaaaaaatgaagtctctttgtttttattttcttaaaccactttattccagtatgactgacatgtaaaaggttgtacgtatttaatgcatacaacttgatcaatttagggataagtacatacacatcaaaccatcaccaccatcaagactataagcatacccatcagctcccaaattttcctccagctcctttcattattattatcatcatttttgtgtgtgtggtaagaatacttaacataagatctcctcttctggcaaattttaaatacacaatacactattgttagttactggaactatgctacagtagatctctagagcttatttctcttgcataagtaaaattttctatttaaccatcacctttccatttctgcccccagcccctggtaaccaccattctactgcctgcttttacgggtttagctatattagattccacattgaagtgagatcatatagtatttgctttctgtgcctggcttatttcacttagcataatgtccttcaggttcatccatattgttgcaaatggcaggatttccttctttttcatggccaaataatattccatggtatgtatacactacattttctttattcatctaatgatggaaatacagattgattccttgtcttaggacattgtgactaatgctgcaatgaacacgggagtgcaggtatctcctcaagatcttaattttttttcttcttttgagatggagtcttgctctgtcacccaggctggagtgcagtggagagatcttggctcactgcaacttctgcctcccgggttcaaacgattctcctgcttcagccttctgagcagctgggattacaggcatgcgccaccatgcctggctaattttcgtatttttagtagagagggggttttgtcatgttggtcaggctggtctcaaactcctgaccttaggtgatttgcccgcctcagcctctcaaactgctgggattacaggcttgagccactgcgcctggccaagatcctaatttaaatttgtttggataaatatccagaaacagaactgaagaatcatatggtgggtcaatttttaatacatgtttattttgtatcaggttgcaaatttgttgatcaaaattatgagttcaagatgaaaaagtgaaaagtagagcaatgctttctaagaaatagatactgaatcatcaaatggaaaagtaatatccccacttgctaatttaattcatcataatttacaagtctctaatgaaaaccaagcaacaaacaatgacttagtatttgttagaaaacagtttaatctccagttgtcactgaactcattagcaacatatgtcattcacacacagtgaggaattattaatttttcatttcaagaaaattgtcaaattaagctggatagaataacaacatacaataaaaaaattggtaatttattcttatattgccctagaatgatgatagtgtgtggcatgtcattaattaataaacataatattattcacatagtgggcccttgatatccatgaaatgtgtaattaatgatgaaaatgctatagtgttactatcacacttactgatcacatcgaagttttttccacccacacttaaattaaatctccctgaaatccctggttcaaatttcatgagattcaagtaatttgtgatttttttttttttttttgatgcggagtctcgctctgtcgcccaggctggagtacagtggcatgatctcagctcactgcaacctcctcctcccaggttcaagcaattctcctacctcagtctccagagtagctggaattataggtgcatgccaccatacctggattaatttctgtgtatgtgtggtttttttttttttgagacggagtctcgctctgttgcccaggctggagtgcaatggcgtgatcttggctcactgtgacctccgcctcccagatttaaacgattctcctgcctcagcctcccaagtagctgggattataggcgcctgccaccacccctggctaatttttgtatttttagtagagatggggtttcaccatgttggccaggctggtctcaaactcctgacctcaagtgatctgctcacctcggcctccccaaatgctgggattacaggcatgagccactgcgcctggcctgatttgcgatttttcatgaagaattttttaaaggccaaagttcatcctcaagataagaaaaatgattgtttgccatagaattcttctaatctcaacttttaaaagaatttattaacatttcaggtcaaatgcctcaaatgttgaaatctcatattttaattctttgagatgaagtgttttccccagcatttcttttttttttttatttagatttagtcttaactcgcatcaaggtttataaaaaatgatatttctatttcatgagcatggacagaatgtgttgaagcctccctgcaggaaaattatgagcagaggtaaaaatccttgcagcattcttagctccttagctgtagtgtctcttagagaaatgttgcatataaggaatgctaattaaggaggctgggagaaaagagatgccacctttccaaacacaacatttcaaaaacaagtattactaacatggtggttttatgaagcacttgaatcttacataagtatggcttgttttttgtttcctaaaaaaagactgcatttgagcaaaccaaaacccgagtaatttaaatcatgaatttcagagaaaaaagttttgcatctagctaggaacttaataaaatataagttttcaaatactttttttttctattttaaaatcaggtacactgctatttgcaaaatctctagtcaagtagaagcagaaaaagaccgtcttaattttaaaagagtaaccctgctcccatttatgaggatttttgcagggagaaagattttataagatattcacttcaatacaaaagggcttaaattcaagagtatttaaactttgaatttcaacttatcccttggaatggcctcatggctaatttcttgtctatatacaaggtcaaatagatgtatgtctttggttaatttggactgactgccaagcaatttattaggaagctggaggatctaaattgatcatgaagacaacagaataaatgggctttgtctgattacttccgtttacctgatgattaaatcctgcctgcagaaaatttatgtgacttccaaataacacagagacagacagacaaccccatgacacactatttaaaactcttatcttcattaaatgaaaaaaaatcaatttcaaaagtaccttttgttctttatgtctttgttaaattacgtctgaggaagtaaaagagcttcttgttgccgtacttcctggtctattgtcatatatcccacaattggagactttttgcaagatgggtaatttggatatcaaatatgagaaattataagtgcctttagcagatactgcttttccaagagttcagtgtgatcttggataaaaatttgggcagatggcttcctttggaggcttatacattgttttccacaaaatgtagttgatggagaccagagaagcattgcattttttttttttttttttttttttttgagacggagtctcactctgtcgcccaggccagagtgcagtggcgtgatctcggctcactgcaacctctgcctcctgggttcacgccattctcctgcctcagccttctgagtagctgggactactggcacacgccgccacgctcagctaattttttgtatttttagtagaggcagggtttcactgtgttagccaggatggtctcgatctcctgacctcgtgatccgcccgcctcagcctcccgaagtgctgggattacaggcgtgagccaccgcacccggcccagagaggcaatttttaagatggaaaaaaaaaaaaagattctctccaactctctttgcccagcctgccaatgctcccattttcacagcacccaggccagccaagacctaaccttatgcagaaaaaggaacaatgctttaactaggcacagagttctattacttttgctacctaatatgcaaaacactaaaggaagagggcttattaaagaaccgcagcatgttttgtaaaagttggtcactgagtctttgacagaactgctacagtactacagttctaagttcctactggcagcttctattttgagagtcatgccttgatgggagctacaaacaatgcagcccacagtagtacacattcatccatccattcattccttcagcaaatacacattgagggtggaatgtgatggctgatgttaagttggttaggagcacacaaaaatgcacaggacatacttattgctttgagaagctctgggcctagtggggaagatgaagtgacagatgctcttagggagtaggttcagagtggtgtgaaaagtagggagtggcaatctctacctggggagctggggatggcctcacggaatagaagacaggcttcagggctgagaaggagatttccaagtaaagagctataggaaggcgattctacacagaggagacaccgtgtgcagtctcagacgtgtgcaaggacacaacaggacatgtctgtttatggtttcaaaattttacttagttccctattaattttgctaagggggaaccatatgtgtgagtagcaggactgggggatatgaaggtgggtcagagccagattgttaagagccttcaaaaggaatttggtcttcaacttaaacaaattagaaaatacgtgtaaagtgcttggaaagatgtccagcatatagtgtatactcggtaaatacaagctgtttctgttatgttgaagtagacaggaaaccaaccaaggttttaaagaagggaaaggatgctcatgactataatcccagcactttgggaggctgaggtgggtggatcacgaggtcaagagatcgagagcatcctggccaacccagtgaaaccccatctctactaaaaatacaaaaattagctgggcatggtggtgcacgcctgtagtcccacctacccaggaggctgaagcagcagaattgcttgaacccaggaggtggaggttgcagtgagccaagattgtgccattgcactccagcctggtgacagagcgagactccatctcaaaaaaaaaaaaaaaaaaaaaaaaaaaaggagggaaaggatgatgatggcagagttggtttataacaataattctgatgccaatattgagaatgggctgcagtggggaggcactgtccacaggccaggaaagggaaataattcaaatagtgaggataaggctcagcaattagaacttgttcattactaaattcccagggtccaacatagtggctacttgcagtgggtgctcaatgaatagttgctgaatgaataaatgaatggcaatgggaggagggagcagatctgagaaatctctaggcggcagaaacagcagggttggtgagtaccagatgtaggcgttaaaggagagggaggtttttttaaggatgactctggaaattaggcttgggaagatggtgttgccaaattctgcaatcaagtagaaaggaggaagaacagggttggcagggaacatgaggctctgggagtactactttctatgcatctgctgggtttagcctcttggagtgttgagaaaaagtgggcaagggaggacaaagaaccctcacatgggcactgagctgggtgttttcctttttactgtgtttaatccccacggactatgagtttgatattgttatccctgtttacaggtggggaaactggggctcaagatgacacattagcgaggtggcagagcccacattaaaaacacgtatctttctgccacaaagcctgagctttttccccccctccatccatcaaattgcctcctccattaaaatgaacatttggaatatgatatattccatatttagaaggctcgggggtgcagggtgagtactttgcaaaggaaccaaagcctaacttctgttaactttctgcttcatcgatactccaaatctgtcttcctcattcacagagtccctatgaggatccaaaaagatgtgagaaatcttttgaaaaatataaagcgttctataaaaacaaggtgatatcaaaaatgagaagaaaaatatgttcagattcttgttaaggaattctagaacactgtaaaagatgacagaagctggatactgtcttaggaccatttgactggcaacagcctctttccaactatggttcagggagcaggttgaggtttttctgtctttaggggtcagtcttcctaaaatatgaaaacccgggtttgaggtatggggaaagaatgaattttgccttccaaaggcagagtttacaacttgacggctttcactcctctttcaaaaataaacctaaattcctatcagttgtctgcagagttccatcagggacttggtagagtggcccctaactggggagcaggaattatatgtgcttcctccttgttctgcaaagcctctgaacaccaccgagggcccatggagagcgtgatgatgtgtctcttggcccatcacaacgtaagcatgctgagcagaggctctatcccacatcctcactgtagccacagtgtccagcaggaaggggctcactgtatgtaactacaagaactttcggtgtttgcattcttccctttgctctttaaatggctggcttcttcttcccactcagttttcagcttaggtgccacgctgggagaggcctcctgtgactgccctagttaaatagatcccccctgctactctctatcactgcactctgtcatttttcatgtggttcctttcagaatttataatcacacatttgcttgtttggttatctgtgcctccctctcaaaccagactgtaggcttgagggcacaaagcatgtcaactctattcagcccagcatctagcatggggctggcatgtggtaggcattcagggtctaactgttgttttaatgaacaaacagacctaaacctgagatggtgggacaaccgacaggaaagcagaaggccccctcagcactcgggggctgttgttccataatcaggcttcattatgatctgggaccagggatggagccgtggattggctcacatgtggactgggcccacccctctggactcatcagcaagacatgcaaaccacatgagtcaatggtccacacacagccccaaaggagaagaacacaagtatcactattcctcaactttggagtaggttccttggtctcctagttaaatatgcatggcacataaaaataattgtgcagacagaaggactcacagttgcttaatgtagaccaggaaagtgtttgaaccattcagtgggtggtgcgactcctaggggaaaccagccacgggtgggaatagaaactactccaggaaatggtactgtatggaacaatttacatattttggggcatgggaagttttggaaatgcatttgttctcctccatatctaccactgaaataaatccttgagatttaaaatgagtagatgatatttagtaatatgactgaaaaatcacataggactcatttatgagccaggctttatgcgcaatttacaacctgtatggaaagcaacaccatcccctgttttacaaagaaggaaacaagttcagggaggttatgcaagtctgttagattttaacacttgcactcccttcaccatggagccaaagcctagacttaattgtttagaatatcattctaaattgctttttgcaatgtcatttcttatgcatttcttacacaccttttaggtgccaggaacgtatttctaaaggcaggatagcattgcagaaatgctagcctccaagagatggggtgtattttccattgagaagcagaattaggggaagggtagttttacctcctcagtgtcaactgaaatggcagtcattcaacatttcactcatttcccatcagacaattttaatctgaataaagtttttaaaaatctcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcctagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaatctcttaagaaaccatctccttacaaattcccttcttgcaaaatacttatttttcagtaaatatcttcgttgacaattctaacaaaggtactcaaattctatatcctggctatgcctgtcaagagagttgaaggaggcagtggccatatttagagggccaaaacctgttcttctggtggtatattttgctgatctgctgatcttgaaggactccagtgccttaaatttacccacatgtcatttattgctgcctaatgtgcttattcattattttttgaaaatagaagcatattcggaaacatatttaattttacgatgttaaaaatgatcacttctggttcttcaccagaactatatggagtacctggaatacagtaggtactcagtaagtacactattaataaatgaagaaaatatacgcaggataaaataaactgtttttcataattctatccatatatgatttttaggattgtactggcttaaaagctgggactatacaaatacatcatcaatgtgaaaagctgggaaaatgggaatgcgaaaatcaaactggctcttggccagtgattttttttaaaaaaacaaggtcttcaaatgtttgtaaactgcaaaatgtccttgttgtccttctccctttttttttactactggcattgtcatacaaactttgtgtctcttccaaattagtctgttgtttgggatccttaactacggagagtgtcaactgtgcgtctccaagacaaacaggttgatgcgctgtctttctcagacctatgctttaaagcccaggctagggtcatgctctgagactagagcattctgactttctctggtctgctcttttctggtccttgattttcttatctgaatcatggggtgtccattgtttagacggaaggttgcaaatataaattaaataattcctcagcaaacaatatctttctgtgaggtgcatatatcagtggctaggaaaatatctgaggcctgctacatcatggtttagtgaataatttgcattttatgatgtatatacagtgtagctatgaataatctgccagaaattatagctatacatatataagccatacactcactaatggtaacccattctccttatttttgaacccattctcggtaccagtaatagagagctcactggctttgatttgaggcagacctaggtttgaatcctagctctaatatgtacaggttgaatctcagggaaagaattcatctttctcagctttagtttcttcatctgtgaaatggagataataccaacttcataggcctattgaaggcatttaatgtgttgattatatgcatgaagactgatttgttaacaaacagatgatttcatgtgtgtgtgcatgagttgggtgcagccttaataagtgttccccttctcttctgttttgctatttaatgtgatggtgaggagagtggtcagtgtttgtctgtctcttccttctagaagttagggtggcataagatgaggatatgggggacagcagcctcagggagatactgaataacctctgggagcctaggaggacagatgcttgacactagctggggacaaaaaaggaagagcccaaacagtttttaaagcagaatcttctgtgtctagaagaatcaataggaaggtgcatcatcaaaagaactagagaacacaaatgacagggtatgacatgagtgttcactttcattaagtaaacactgctggggtttacttaatacctggtgagagggaaaaaaagcagtattactccacaaacatttgttaaaatatcaactatgtgagcaagccatacaatggagaggcaatgattcctaagacataacccctgcacacaatgattcctgacataacccctgcacacagtgagttcttagtcacaggggaagcacacacagacacaagagggctgtgattaatcctatatgaaaggacaacatgccatggagcacagaggaggaagtagttacttctaagaagaccaaagacattttcaaagaggtgaggatattttaagcgaggtcttagaggacgctgttcacagggaagaggagatgtaaaagcattctaggccaatgcacctgcatgagaggagtgggatacggtgtgagcaatgcttggagaattgcagctatttggatactgctgggacataatgacctcggcagccaggaattgtggttacattgcagggggccttgaggctagagagagagaactgattgagcttgaggagggagagtgggaagggacccagagcacagatggagttattggctttggagataaaaagggacacatgtttctctgagtaggtgagtctgggtgttacttggataagtctagagaagaagagacagtacgttctaacagaacatgccttgttaccttcatgctctcggtgtagtgggaggcaatgtcactggttgaataaatatgaataaatgaatgaatgaataaatgaatgaaggtggctagggtagaggattaagaagcattaaaatgaatatttcaagaactatttatgggggtcagtaaatataatatttctaaactcaaaacttctaaactcaaggtatttataagctagttgaagatgtaaagacatcatacatcttttcaaagcacaggaagttaaatgaatggttcctaaaatatgaatgttcagagggaaaagtacgtttattaactgcttgacaaagaagtatgtagctatattttgtgtaacacactatggtgtagtcttatctttttgggtatgtttttctttcttaatgttaaaatatttcatagctggtccatgtaactatagttatacttttagttttactcaggttcccgataatgtttgtcgcacagacaggtttgtgtactggttttaataattccattgtactttctacctcctcctccgcccccatccccagggtcttcaggtcacagttgggacctactctatgtactctggtgctctccataagcaaatgggatgatttctctgaaaagacagctctagattatagtcctgaaaaagagagctcttgagtcaatgaaaaaatcatagtttagagtagaagagaaaggtaagtatgttcagaggaaaagctggtcagatgaatgtaagagaggcttcttttatttgttcatttaattttgagacagtgtcttgctctgtcagccaggcttcagcgaagtgctgagatcatggctcactgttgccttgacctcctgggctcagccattctcccacctctgcctcccgagtagctaggaccacaggcccatgctaccatgcctggctgtttgtattttttgtagagatggggtttcgtcatgttgcccaggctggtcttgaattcctgggctcaagtgatccgctcgcctcagcttcccaaagtgttgggactacaggagtgagccaccatgcccagtctcaagaggaaattcttttagcagagctttgagagataggtatggaagaacaggctggggttagagtatatgttgctaaggaatctgaccctcactccatgggcaataaggagccatggagcagggatagaacacttctctggcactactggaagctgtgatgtccaatgtatgctctctggaagatctaactaaacacaaccttagcacttctctcaattttctttgaaaaggcaaatcttgtgagtcatttgttctctgtaaaatgagagaggaacatacattatcaccttatattatcgatttacattaagaagacttccggattctcttagggttgttgtgtctttctaagatttcaggcaggtgggtaaatccttattttcatggattttctattggctaaaggaacgctgtgtgtagtttgttggaatatactttgtagaagacattcttgcccttgtgaaccagtttgattcccgaatcacacaagtgctgggttccagaagagattttggatataacgccaggatttctgaccctacagctaagaataggcagcaataggaactcaagttacaaaaaatgacttcaatagagcattcacatatgtgatggtatcagagcccaagtcttcaaagagaaatattttgaaacttctccctggtttctggcaagagcagcaaatcttgatttttcaggcctttataaaaataagaaaagactaacaattttaaacctgggcattaatcaaccatttaatgatgccaacaaatgagttttactgtaattcagtgcggggagattaaaggaaacctaagagccacaaataagccattatgaacagtttacagtgattgagtacataagctgtgattaataatgatcagaagtaaatctatgaataacaacaaacagaaaggacttgttagattgagaattttatcagaaaggtataatttggatgttgactcagtggtaacaacaggaaaaataaattacctttatgcattttagtttatgaaaatcaaatagataatatatgaaacaacatttaaatcgatacagcccaggagatataaaagtataggtttgtgtggtcttctaattaactgacatttacacatttttcttaagatcactgtaagcaaaatgggaaagctctctaaatttttggccttttgggagggaggcttttcagtcttgctcatatttgagtcaatacactgatgtcttgacttgcgaaaaaattttcacatccctgttttgggctctcatattttctttattacacaggaaaaaaactttattgcacagacaaacagaagttaaattgaattgattttataagctgcaataagtacagctcccagaaacaaatgcaaatggaatgaacagttcttaccatatgtttcacataggctactcacgttttctctcgttccgagatgatttcaaaaaacctgttctgttaatgtatgtatgaaattctgcaatcttaaagatttaaaaacctatatgttttcaaagacctgaatatcctgatacacatcctttcacacctggatgccaaacacatacactgaaatatattctatgaacaaaggaatttgaaagggaccacaaatttcgcattgcatgctgaagctgtcctgtgtcagctcttcaaactggggcctctgaattttaggaaaaagtgctattattctggttcagtaagtttgaccctttgttgtctatctctgctccttagagacacaagcaggccttgtgcttactaagtgaatattaatatcttcattaaaccttgatagacaagcacactacagccctcatccaaaatatgcacaaaattagaaggcaaaaataaaaaaagagccagacattataagcccgtcaatggaagcagagagccacaccattaatggtggattgaaaaagactctgtgttgttcacctcccacgtataaatgagaacacacggtgtttggttttctgttactgtgttagtttgctgaggatactggtttccagctccatccatggacacagggaggggaacaacacacactggggcctgtcaggggtcagggggagggagagcatcaggataaacagctaatgcatgttgggcttaataactaggtgacaggttgacaggtgcagcaaaccaacatggcacacgtttacctatgtaacaaatctgcaagtccggtacgggtatcctggaacttaaactaaaattaaaaaaaagaaaaagacttcctcagttttttctctaatggcctgaagcaaaaattactctcatttcctcttcattgatataatttgtttttgagaggtgaggggacaatgggaagagagtggttttaagtcactataaaaagattattgacagatgcgtggtaaaatgaaagactcaaaaattcctgaccctttctcccctccagagttaggtaggcgggaaggaccccaaacttccatacaagagtctcttaaggtaaaattaagacagcttccccttcggagtttatgctagtatttcataattttccagccaagagctggaaattatgaaatagttgcataaactctgttaatatagatggatcaggctccaatcttgattttgccatttctcatatcatttttctagggctgagggggcgcacttcttggagtccagtttctgatataaagagaaaagccatttagtgtcttggaaaaaaacaaaagaaggaaggaagggtgttgttgatttaatagatcacccttattgttctaatggctccagatggctctcctactgtgtggatgagatttgacagtgccttcttggggagaaacagaagacttcactagcttcgctcagcaaatgaccactgattgcctggaatggaggagttaatgtgatcaattaacaatgtttgaagaaaaatgatgtttgccagctgttgatttcatcagcaagaaaaagcccacaataatcatcttagaaaagaacttaattagttttgatcctaagatagcatgcaaaagttctggactaatttctagtctgaagatattcataacatattagagctggcatgaactctggtgattactagaaaaaaagatttttaagtttgtgaaaacagagatgtgctcaaggtcacccacagttaacagaaaaactggggctgaatcctggggcttctgagctctgatatgctgctttttcccaccacaaatcacagtttttgagattcacactttgaaaagaatgatccaaagtaacactgccattttggggtgagtgttctcttatgacagatgagtttttttttaccttcctgtttccatatgtttaaaatgctattagtatttcaaacctcattttctttctttttaaaaattcagccatgattttagagtgacagatttgccatatcaatttctaaaggtaagtgtttgggtcagtttgctttttctctaaattgtgtttgtcatccctcagtgtagtaagattttggtgtggttatgctgacattaaagtttccttttcttaaaataaaactaatgacttgaccttgatattgtataagagtacaggccctagggtcagtcatcctgggttcagaacccagcctaccacttctcagccatgtattgcgggagagttatttatggttccctacatttcagttctctcatctataaaatgggaacagtaataatcccattctcaaagggttgtttgtgtgagaattaaatgagctgatctatgcaaagtacttacacagtgactggaacatagtgaacactcaatgtagctaacagttattattattattactagaaaaaaattgaaaaataattttatgtaattgttacttacatgagtagcggggtctcagcttcccaacacaccatgagaatatgaaatttcatcaataaattcaaatagacactttatgtaaaaccctttgctcaaataatgtaacttagcaatgactgacttttagatactggggaaatgcattcatatgaaccagtgcgacattctgaaaactggttcattgaatcccaataatataggttcttactctcaagtaggaatcaataatgcacatcccctctgtacccacatgccccataaaaaagctgttcaggacaatcttgctttatatattatacacattcagggcacatttagagttctgaaatttgaggtgcaaagtaagcattttgatagggatatttttccaaagaatgtttttggccccagcataaaatgaaaaatctctaccacagacagttgcatttcatggtccaatatagtctctgcatgaaaaccaacagatcattctacatgtctcctgacacatttacaacaggcactctgtgtaaaacccattcgcatcactgggggttctcaccaattcttaggcccttgacttatttgtgactgggatacctttatcacaaagacatgctttacagatattttcacggacacaagctattccagtcttgtcctgcataattaagtttttacattcagtaagtagagttcacctcttcctcctaatggtaagtgtttattaaccataatgactaataaagaggttctggcctccgtcacctgagaagaacaaaacagtggggtttttctgcagctcggctggatcccagcttctatgacctctgctgctaacaggctctccacaggcaatgaatgggagacgccagctatgcaaattagagtactgatgttccttgtcagctgcaaagcccaaatggccctgaaggtgacccaagtgaggcttctgtgctgtgtgcctggttaggtggagaccctgattagtctgattatggcaacaaattttttaattgctttatggggtgcatgaaaattatatgtttatctccttttattgaataaagtgtgttggttgtatatgttcaatgttggtagggaggaaggtattcttatatataaagagaaaatctgttactctttatgtcagatcagttgatagatattaaacaaatcatgttgttttctcatattgagtatagatcactaatgaccagctggaacagaagtaaacttgtacattagccagtaatgaacaaaatgctaaagatataactagagaaattctagaggtaaggaaatagtccacatatattaatacattttttcccacagtcatcttggtagaaagttgaccgtgatgtcgatgatataactgggtcagacaaataccttttaatagtctgtattacttacacacgcatacgtggcaacagatttaccttagacataaacacgagtttatattcctggaggtgtcctagaagcatgctgactgttgtgtcctcagtattattcacttcaataaccgtaagagctggcgttctctccaagactctgttccttgaaggaaggaactatctactgttcccctagtaagacctggcctacaataggtgtctgtgatgctttttttttttttcatttttaaatgtccattttgtttattgatacataatatttgtgcatacttatggtacgtgtgatattttgatacatgtatagaatttgtaacaatcaagtttagaatatccatcacctcaaacatttatcatttctctgtgttgagaacatttcaagtcttctcctctagctattttgaaatatacaatatactgttgttaactacacagtagtcaccctactgggctaagggatggttaatgtgtctactcagctagatcacagtgcccagatatgtgatcaaacattattccagatgtttctgtgaggatgtttttggatgagactgctgttcacactggtagattttgagtgaagtagattactcttcctaatgtgggtgggcctcatccaatcaggtgaaggcctgagtagaacaaaggactgacctcccgcaagcaggagggaactctgccagcaggcagcctttgggatcaaactgcagattctggacttgccagcctccataactgcatgggccaattccttaaaacatacctttctatgtatgtatacttacatcctagtggttctgtttctctggagaaccctaatactgtgtccagtaaaaatctgttgtctgatgaaggaaagataattgcctgcctctttccatcccttcaacactcaccctgactctcagaacacacgctgtttggcctcatcctaatctccattccctcagtttctctgttacatccctgccatttatcccatttatgatatccctccttccttaggcaggataaacttgaagatactgttttcatcttcagcatactacctcctttgtctttcctctgctcgccttgtaaatcttcaacatctaatcaaatcatgtgccttctctaacctcactgttgttttctgctggagagaagccctgccaccagccagtacatattcataatggttgactgtatgtggctgggccctcagaccgctcagaacaccttttcatggtccttagtcagcccctactctctaccaccccaaatctttcttgctattcctctggtctcccatttctatcttcagactctcgatcttattgcctgacaaatgtttcaagcagaactcatcaccttccccacttcttgttcctcttgcttagtccctgttgtgataaattatgtccctcccctccccattcatctgcccaagctggaagaaaatttggcatcatccatgcctcttctttcatcttcaattccatcacccatccagttatttaacaagcgttagctgagtggctattatgttcctggcattattctagagcttgggatataagagtggacaaagtaaaacaaaaacactcctgccctcatggagcttatattctagcaggggagaaggatcatgaacataagaataattaaatttacagagtatattagaaagtgaataaacgagacagggaaaaatagagcatgaaaagggtgataagaatcgacgtgtgtgttggtggggaggtggagtgtgcagtgttaaacatggtggtcaggatatgcttcaatgagaagatggcactggagccaagacttgaggtgagggagggactcacacagatatctggggacaaatcactttgggtcaaggcaatagctggtatagagggcctgtcttaatccatttgggctgctataacaaaatgccattggctgggtagcttcaaaacaacaaaaatttatttctcacagttctggaggctgggaagtccaagatcaagatgctggcagattcggtatctggtgagggcatgcttcctaatagatggccgtcttctcactgtaacctcacgtgcaagtgttagaaaagttgggggagcctgagggtgtctctaggttgttgttgttcttgttaaggtactaagcccctcccaaaggccccacctcctaataccatcactttaggagttaggatttcaatatataaattctggggagacacaaacgttcatatctaaagcaaggccctaaagagggcctttttgagcgaagtaggccctaaagcaagagtgtccctggcatgttgctcgagcagtcacagcacttctgcgaatcttcagttacagcactcctgtgaatctccaactgtccatctcactgctactacctcaatctaggctctgggccttctcacctaaattaatatactgatttcctaagtggttttcttatatctggtcttgctgcatgcccacctacttcccacaccgagctagaatgacctttcaaaaacacagatgtcacctcatcagaattcttccatggctccccactgcccacaggctgacatgtgcacattgggagggcttagccctctcccacctggctccagcccactgctgcaatatcacaatatcacctcgcccatccttgacgcttatccagaggtctgtacataagattctctaaatgcaccaagttccctctggacccttcacctttgggacactgcttcctcctcataaaacacctatctcttttgctacccattgcaaccctcctcgtgctagaaagcatggcctggtcagctcagtctcatttccctttccctatacaacattgcttcctgcagaaagttcctcctgcccttcctctctctggcttaggtaccctccactatgcttccacaagagtgtggctatctctactgcagcaatttcatactgtatcttcacagtctctttattttttgggctcccctagtaggttttgaatatgggcaaggatcatgctttttaaatatcccagcacttggagccttacttgatacataaggagatactacataagttttggtcaaatgaataaacaaatacacaaataagccccatgtggaaaggtgaggattatatagatgcataaatagggaaaaactatatgcagaaactgtacatagcttcctctaaaaaggaatttcttatggaagcagaatctgtaaccatgaggcagccacccagaggagtagagtaatgatttgtgctgctccagtgactatgggttaggatgagtttccaggtcaactggattactctgatccctctttagagccattgcaagaaatcacatctcaaggaaagactcttctggcacctaatctcttttgtactttagtccagacagtgcgaggccatcttcaaataaaacaatctctttggcttcacagacaagaaaaatgtaatctatttcctacacgtgacaacaagagaaaatctaaaatggcacaaaaatgtaatggtaatatcctacagagaggaaagagctgaatcaaaatgaaatatgaccaaatgcaatcagcagctaacagcaggaaaaaggcagctgtcatcttcatttctttcataaacttcttagaacaaattatgtcttttagaatgtaagtcagtttgtcgggcgcagtggctcacgcctgtagtcccagcactttgggaggctgaggcgggcagatcacgagatcaggagatcaagaccatcctggcttcatcctggtgaaaccccgtctctactaaaaatacagaaaattagtggggtgtggtggcgggcacctgtagtcccagctacttgggaggctgaggcaggagaatggtgtggacccgggaggaggagcttgcagtgagccgagatcgcaccactacgctccagcctggcaacagagcaagactccatctcaaaaaaaaaaaaaaagaatataagtcagttttctttctggatactacttcgtaaagcttctgccgtttatgggaggtaaagcattctctgcatcacccaacttcgaagctggcctgcatttgcttagacatttcattcatgaaagcctgccctctcttagcagaggagcgatctaaacaccacagtcccaaacacctccatctgactgtctcctctgtttgtctatcaaaccactgattaaaacacattctgcattgattgattaataaacaggtttcagcagctctggacactcagagtctagaaggagaaaagtctagactcaaatagataaaaacccgtaattcaaggcagaacacaccctgggcccgagggggctggaggagaggtgccaagtgtgggctgcgcatggaacgggaacactggtgttaggtgtgggctgcttggaacgtcccaggagtagcttgcctcatgttgcagactaggaatccagctgtctggaggtggaagaatccatggatggtgcatattgcagagacacggtttcaaaatcttttgcaggatgcacatgttagaaaagagatcttaaaaaataaaaaatcctctaatggctttaaatgagcatgaagcattcagatgttaatgtttagctgtgtagacaaggtgtttcccaagttatctcaaaggttgatgacatgacgaattgccccctttaaagaaaataccaaatacacgaacaacaaacttccccgaatgtgttgactatcttttggaatgaagagaaaatctgggtcgagttgaaatcaccaaaagtcaatccacaaagtggaatgacattgctaacacacttagcatgagacctgaccccatctgattattgctcagcaaatgggggctgtcctgattgattactatttgtccagtctctcaccagctgagctctttcctctgttcctaaaataaagggtagggtgggggactttgtgccagataactaatctttactcagtaccttttctgtttcaggcattctgttagcagcttgatgtactgttctcatctatctcctcaagagtcctttgagagatatattttataactgttttgtagaaaaaaaccacgaaggatctggagatgttaggtgtatccaagggcacaagatgattgggaaggagtgaagatatggatgccagagcctgaaaacactccatgtgtcccatggtagcttgttctttggccaagtagcccttgcacacccccgccttgtcttgagacatgtcaccaaagacactcaaaccataagctccatgaggaaggaattttttattttcaccattaattataccccagttccttccacagtgcttgatgcatgcttggtattcaatacatatttattaagaagtgaatagacccaaggcctgggatgaagtttctgtctccaccaccactttccacccattcaagagtgagctgctcccctacgaggactgggcacgagtcaaaacactcctgggaaggatgaagtcttttggggagttcaagaactcctgagtccggacaagacttgtgccaacctgggtgacaaaggaactgtgagaccctggatggagttacaacccgaagatatgcctgaggcctgtcattcagcacttaattcctttttctggtgaaaattaaagtaactaaaatcctggaaccctagaggcttccagaattgtaacaactgtcttcagtagccatcaatctaattacatttttgcaatattctcattttgagctacaaaggtacaaattacacaaaattgtgtgtggaatgcatacatatgtatgtgtgtgtatgtgtgtatatatatgtatatatataaacgttaacatttagatgttaatgtttagccatgtagacaaggtatttcccaaattatctcaaaggttaatgacataattgtcccctttaaaaaaatactgaaaacatgaaaaacaaacttccctgaatgtgagcctcactttgttctgtacaatggagataataaaaccttctgtttcacatgaagagtacatgatggaatatggcaaaatgtcctgaaaaccagaaagtagtcttgtcaatagccaagatctgcctgactttttcacttggggtgcagtagttaagagggaatgtgctggagcccagctctggcatggccactagcaggtttgggagagcctgtgcttcagttgctttacctgtaacagggagatggaaatgtacccagctcctggaattgtttgaaagattcaatgtgaattcaatgatataacacatctaaagcacttagaagagcccagcacatgaacaatgcttaaacaaatgtttgctgtgattattactgtgctttcgggatcactgtgcaaatgacgattctggtcagctatgcattcccagagcagtggaagggttcactagcagctatcttcagtaatacactgcagtgaggggtagtcagatccaggcccacaatccaataaaggtggttggtcccagaagttattttgccagataggcagaaatcaaattgaagagaagagctttggggagcatgtgttctttacttccttttcctccctccctcacccttttcttttctttgctatttaaataaaccaccactttcaggcctgcctgggagaagatattagggcagcagggagtccagctgggagatgatgaggaaagcagctgagcccctgctattccacctcatccactccatcctccccaattaactggtaacgaggtggtgacgccctaaccacatttcacttcctgctaacaaagcttgtacaacaaatgcaaacacttggctgtcagcttctgtccagcacacagcctcgttatccatctcacccttctgcatctatgtcagcatccaggaggcaggcccaggacgacaaaccttctttgtgctacactcaatgccgtaccaggctctgatggtgcttacaaaatgcctttgcccgacagtaacaagaaaggtcccttatagatgattttgtaagaggagacatattctgtgcaggcttgtgtcattcctctgattattcagactgggagtaggggcagggaaggtgccaccatttcatttcttcctttctcatctgataaaaatttcttcccacctctttgaattgaggtcaggtctttttcccttttctaaatttgcctcaaagaagtctttttcatttttccttaagaatgactttaatggtctacattttaacctcttcctcatgtaatgtaagtgatctgcaaactttcttatatcttattccttttgaatttcaaattcctttttttctaaatcaatcccattatggcaagacattattactttctgctcacataaatactatcatccataattttctctcttccctcataaagcatgatttatgttgatatttaaaagtaaattctgatatttagtctaagtactgtcttacatattaattcaataacataatttctacgatagaaaagtacataagagtacaaaatatgaaataagcttgatatagacatagttatctgcatttgaccagtgaggaaacaaaagctcagaaaaattagataccttgcacaaatcacaaagaaatcagtggttcagctgaaaattagaaccaacatcttctgatgattacacaacttttctggttgactaccaaagaagatactagaaaaattactaatgagtgaaaataaaaagacatttcaaagtctttcatatttaacacaaaattatttttccatagaagatattcaagaagcagttacacatttgaggagctgtttttttttaattaaaaaaaccatattctttatctacatctagataatgtagattgatgatccatctaaatcaagaatttatcttctacagtgggaacaaattactggaatttaagcaacgtgaaatctcatcactttagcaatgacaatgaatgtgatgtagctttcaatgcagtactgaaaaagcttgtacactgtcacatgtcccaggcccttaggaacaaagtttagtatgcaatgagtgacgagctctataatattttcattcgaaacagagctacacaggaaatctaggatgtttataataatatttggaatatttggtataaatgtaaaacattgtaatagttttctgggcagataagagctcatcatatatccttttagttaagtcaagtgactctggagtccagttataccattagttcaaacactaccaaagactaaatacaagctcttacaggctgaattgcatctccccaaattcatatgttgaagccctaattcccaatacctatgaatgagactgtagttgaagacagggctttaaaagagctaattaatggctgggcatggtagctcacgcttgtaagcccagcactttgggaggccgaggagggcagattgcttgaggtcaggagtttgagaccagcctgggcaatacagtgaaaccctgtctctactaaaaatacaaaaattagctgggcatggtggcgtgtgcctgtaatctcagctactcgggacgctaaggcaggagaatcacttgagtccacgagttggaggttgcagtgagctgagattgtgccgctgcactccagtctgggtaacagagctagaacctatctcaaaaaaataaaaaagagagctaattaagttaacatgggggcattagggtaagccctaatcccataaaactggtgtcctattgagattaaaacacagacattacagagggttgaccttgtgagggtaaagtgaaaagggggccatcgccaagctaaggagagaggtctcagaagagacaaccgtgctgataccttgatcagctgacaccttgctgataccttgatcagggttctggaggcaggacttccagcctccagaactgtgagacaataaattacttctgttttagtcactgtggtactttgttatggaagccctagcaaaactaatgcacttaacaaacttaacacctactttcttcctccagcctctgtgcctgtgtttcatgccaacttttagtttctccttgatctgccagtaatacaaagatgagaaggtctggaaggaggatttaggataagctgagaggatccatcttgtaagactatactttcctatgaaatgctgtttcctccttgttgcctggaaaactcatcctcaatcttctagacctacagttgggttattcttcttcagaaccttaatctcttcaaggtggtgcctctgctacaccctataaacccacctctggcacagcacatatcacaccatgttagaattgcttccattggcaactccttcctgatcttgtgaatgatttgtgctgctccagtcactattaggatgagtttccaggtcaacctcctgttttgaaaggagggacttacctttgtggtcatgtatttgacacctaagacttactcgttaagtgtttgttgaatgaatgaatgaaataaaatgatctccattcctattcaaataagcctgtaaataacagtttaagcatggtcatatttgtttgttgagaaagagaagtattaagtgatataaggtttaaaaaagcaataaaatctgcaaaaagaaaagtgtctattgatgaatttattaacaggaaagaaagtaatcgaggataagaagatggaaaaggtggaagaagagaccttgacaacctgaaaaggttatacccttgtgcagatgtggtggacaaatcctcacctgagaggaggaatcaaaggggcaactgctctgaaaccggccctagagcatccaacctaaaaacaatgccttcatcatgaagttccagaaccaatgattcaaaggataccccactgaaaaaagacagtcgtcgtcctagaggtaaaaatcactttacttgccaataaacagaaacatgagcaaatgggaaataagcaaaaatgaaatgatgtgtgtgctctcttccaaagggcagcaaaagcagctgagttaatgctaatggctcacatatggtgggtggggggaaaggatgttataagtcacaaaaccctggaatggagcagaggcctgtcggcaagttaggtggtgatgatggagtcaggatgacttggaaacactgtgaaaagatggcttcagataatgggccattatctgtctgcctcttttcactttgactactgtcctctataaataatgtagctggctaatctaaaacatacagaatcaataggaagccaaatatttaggtaccacaaaatgaggcaaaaaaagagcccagattttcaaacaatgcaagtgaccctgaaaattgtaacttggcaagtctgcaatattgtgagagcaataacaatctgttaacatctagagggaataaacccaaaagaaataagaagccgagctttatgaagggaaaaaaaaaatggcacgccaaatttgattgcttttctgatggaattacaggattactagtttaagggagtggagcagatgtgatatatttgaattttattagggcatttgggagaacgtctcacacaatttccttcacaaaactaagtgactttagcttgaacatgaactgaggagataataaatgaagggtaataatacgttacagtcaatctcatcgggaggaaggtgtttaagaggtgacactaaggctcctgttgtttggggtggatagaacattgattttaatgatctgtaaaaaaggaagaataagagtgacagagaggaaacatggagatttattggacaaaaagactaggaacctggttaaaaatacctgaatatagggaaaatgcaagctaacaaatatatctgtatgtttagaaaagtaaatatatttggaaaaatatttgcagaaatgcacacatgaaaggagaaaaatgagaaattaataacactgaaaagtacacaggagaagctccttgtaataaacttgaactgcaatacagatataaaataagagatcttaataacttatactgtcataacaatgacacacatagcttgccccaaagtaaattttaggttcaaaaagctaattttactcctctttgaattgtatcattataaattttaaccttcaagtttagcaataaaatgacttaaacagtttaaacaaaagtgtaacttcctataatgacagcagcatccatcgaaatactgtaccatctgtggactagaaactacccttcttcatcctagactttgccctcttattcatctccactgaatcacaaatcttagacaattctgcctccttgcctctctttgggacctatccttgctccttgttccatagatgctaatttggttccagccctcattctttcttaccagcattattaccagagcccagtattgcagtatcacatctgctctctgtgctgtcagaacaatctttctggaaagctgaccatgtaaattctccctgtttaaaaacctccagtggctccccatgccctataagacaggcctaggcatagtgttcaagcccttgaggatctggtcccttctgatctctttagctccttctctttccaactctctcctccctttccacactctggcctgaagcccttccagttctcggcagctctgttgtctgtttgcctgtctacccctccttgcttcctccttcaggatgccatgcagatgccatattttgaaggaagccttcctggtttctttctttccactcttgtttctttagtttgtttatcatgcaattttttctactctatctataaatggtgggaggcaggggctgttttaatcctctatgttgctagcctgggacacacagtaggcccgtatgtacatgctgaataaatggacccaaaccaccaatataatcagggactgtgtctactggtaaggcaggcctgggtttgtgataaaaagtgcattggttttgtgggcagcatagtggaggcagaaataacctctaaaaggactacagtgatgacacaactgacacactgctgtaacaagccagggggtaactggggtgtgcacctgttggccggtggctcttgaattcagtcttcctcattcatctggcctacaaaataccatagtttagatcagaccctgcaggaaccataacaaaaactgaaggacaggctggtctttaagtacaacttagcagagcatgacaaatgcagattgaaccaaagtgacccttcccacctacaaatatagtcatactacacctctgcttaaagtcccttcaatggcttcccattgctaggaggctgatgtctaacagcctcatgtctctcctcttcctcacactcactcatattacattaccactggttgccacaggcaccacatgtgggatgctcccatgccttcatccgtgctgtttcctgtaactgctggaagtgccctttaccctcaaccctttctcaggtttcctggtgaattcctgatcatccttgaagtcatctcaagtatgaccttctctgagaagtctcccacaacctttctaggtagagctgagcatgcctactcagtgtcgccaatgcaccttgtaatctatcaattaatgtaattgaacagattacaaagtgcattggtgtctgttacatgcttgctcctgtcccacgttatgggccttacacgtctttgtattctgggattctagcaccatacctggcccagatcaaggactcaaattatgtgttgaattgaatttgttgaattcacatgaaagacaatacttatccaaagcctgaatggctaaagtggttatctttgggtttcttttgacaataggaagcatcatcagaatggactaaaatgatcaagaatgtgcagaaggacctccataatcagtaactatagagataccaaactttttagttacataaattgaagacaagagcaattacagaagattatatttaatggccttcaggtacaggtagaaatcacatgatattttagactgctttctttaaaaatgcatcaaagcactgtgaaaagccaaaaacatccttttggaagcagcattttataccaggtatttaaatctattttcactgtgagtttattcagagtaattgtataataaagaaaagcacttggcttcaggtcactatgcatatatagctaaattatgcaattagatgacatgtaattaaccagagtagcaacacagccaatctaatggggccagttggggtctgagtgactcataaaaacattatgtagttaagcgataggcacctacaagaacaatgaattttggtctacctgcagcctaatgagtccctcctgtgactaaagaggtaatgcaaagagaggtctcagagacagggcagtgtcaatggaaattctgtctaagaaggagccaaggtatcatcttgattcttattttccaaaacttctaatgagataagaaatctctccaaacgtactgctgccaacattaccagcttgactcttccattaccacaaataataaacaaaaaacattagttaaagcttattttgaatgaacttgaagaaatacttcctgacccattactcaggtagtatatacaacagattgactattcagtaagtgaaaactaacggcggaagaaatccaaattagctttcttccttttccttcaaggatgtatacatggcaagcatgcatgaattaacacagttatgaacaagaaatattatctcttgtgtaaagatcaaggtttactgtctcattgtgtttggttttgggaacgtagttttgattttgtttgcttaagagatggaagaattccagttctgaaagaattcaagctatgaacaggaaagtatacttcaataattgtcccagtgacccttatttttattaagaagaatctagcaactgtcatacttgctaatgtggcaataattcttctaatcttaaatttttaagtaaggaaaaaatgaatatgtagccatttaatcacaaactcatcctctatttcccaacaccacttattccatatatatatttactgaatataaatatactaggcctcagtggaaacacgaaggatgtgcaagactcagtacctgcctttaaatagcttacaatctactagaggaatgaaatctgtcgcccactcttttattttcttcttcgaaatggtttgagtatatacagtatactctaaaggtttaattaaaatggaatatataaaaatctgaaaggatacatactaaaatgtaatctgaaagaggggtagcaaattattctttttgctctctacattttctaattttttttttccctaatgaggacgtactacttgtgtaaaaaggagaagaaagttattttatgaaagatgaaaaaaaaaaaaacacctcactctggttagcctgatattttgtccttttgaacacttaaaaggccccattaccaggcagaggttgcaatgagctgagatggttccactgcactccagcctgggtgacagaatgagaccctgtctcaaaacaaacaaacaaacaaacaaacaaacaaaatgccccattgcctaaactctgaaaaagtcaatacggggttgttgacaaaatctattattactgcccatctggtgatctgctgctcccctaccagtgaggaagcttcttgaggtcggggactctgtcttgtttgctattttgtttgttcaattcctaacagggatcagaggacaccatagataggtaataaacgtgtggggaagatgggaggacaggagagcaggaagagagcagggaaagctgaaggtacacacacttctgaggcttttgttaaaattaagtatttaatgcgatcactttggggaaaccacattgattaaactgacgggaggcatgaaaatgacataattgatacaaccgataattttattcttcaacaaaatctactattggccagagtgcccctttgagagataatggttcatatcagggagcaatttgctttcaccccttgcatacaaagcgggtttcaaaacctatgtagtttcggaacaaaagaaaaactgtaatgtcttaatttttaagcttttttcaatgcagagactctaacaaagcagatctaatgaacagggcatcatattgcatactgtctgtgtgattggcgccttctggagttgtgcagaagacaacctgtgaggccatatttagccactctgggcttgcttcaggctttaagttcttgttgttaaacttaatttttcagatccatgtggtttggaagcattgtgcttatgcctaactttggtgatgtattgacctttgtggaccaaggatgaaagctggcatgaaataagtacaggaaacttcataaaataacagccagcattaattgagcacctacaaactgtcagagggctatccatctatgtgtctatctaatatttagtcttcagaataactgtgcaaggtagatatcatcaccattttacagatgagcaaaataagtcttagaaaggtttagtttagtaattttcccaaaagcacacacagctaataagtcatagagtgaggatgtaattttaggtctgatcagcaacctcaatatgtcattcatcctcgcctttcctctgaagaaaagcagcagcttgtcttatgtattttaataacactggcatgttataaaaagttaacctttttgttttgcagttcctcatttttctttatgtatttctcttgcttcttgttttttttcccctctcctccaatatcaattcctattcctcttacgtttttgtggcatttgagaaaccttcgttgaaaattctttgacagtgtctgcaagtcttctgagacaaagtgccacaaagataatgtttaaataaaataccacatagtacagataattatatttaggctttcagtcaccctgaatattggacaaataaattctcttggaatcttcatattgatgtacataggacacacacacatgcacacatatgattagaataattttttccaaccagaaatgacatttgcttttgaaatgattaaatattaccctcaccatcagccaagatttccatgacacttgaataaacaaaaaaggagttgattactgagattctttgtttttcctcttcctttgcacagtaggaaaagtaatgattaaaaaaagtataaaacacatattaatgatacaaaacagaactatctccaatgctttgaagaatgtattcttcatatccactagggtgctaaccttcggaaagctacaaaatcaatcctgaaagttttatctcccatggcgacagagcccttttttaagtcagtaaatactaaaagtgatacaataacagctcatatttaggattaccaagtttctctacaggagacaggctcaggtatcaagaggaaaacaaatattcattaaaataatttagcaacaacaaaagacacgtgatgatgaaagtctgttcaaataacaagtgactaaaataagagtgctgataaaaaggaaggtagcactgatatggaactgggttttggtaacaatatgccaatcaggaataaaaatataaatcaaacttaactggaatgcataagtatacccagctttacaagatgggtaggtttctggccgggcacggtggctcatgcctgtaatcccagcactttgggaggccgaggcgggtggatcacaaggtcaggagatcgagaccatcctggctaacatggtgaaaccccatctctactaaaaatacaaaaaaagttagctgggcgtggtggcgggcgcctgtagtcccagctactcaggagactgaggcaggagaatggcgtgaacccggaaggcggagcttgcagtgagccgagatcgcgccactgcactccagcctgggcgacacagcgagactccgtctcaaaaaaataaaaataaataaaaataaaaaataaaacaacaacaacaacaacaacaagatgggtaggttcctaaaaagctttgtataaatacagttgctccccaacccccataattactggaaggagagagagaaagaccctaatgaaatcttgcagtaaattctaaattacaaaccgaaaaaaaattttgaatggcaaacagacactgctttaattccctgcttggaaagttttttttaaaaaaaattttttaatgaatgatgatttgaatagcagtatattttttaaaaattaggcaaacacgtatatcactgcaaataatatggaaaatagtatggaaagtggagaaaacccccaaagagctaatttccattttatatttggtatttaaatgccacattgataactgaacactgtagtataaataaattattgttaaactgtcttataaattgctcagtccttcagtccatagtcaataaaatataggccttgcctgtggtttactcaagactatagaaattcagagtaatcaatcattccaggtggcttttatagctttccaggtagcaagagctatattttattgaatgaggcatttaattagtgggtattattaaagtgcaattttccatattaaactgttttctatataaattggcttcctggtatgctgacttgtaatgacaggattatcttgcattcactcttgtagagacaggtaataactcatctttgtgcctgttttttgattccacagaatgttattctttctgctgtcatcaaaaaatagtttctgaacaaatattatccaagatttttcttatgctattgtcctataaactcaatattttaagactaacctgaatgctaatattatatattgtgatatttcttatgttataaaggaaattgtaccataatttctaattgtagactaatcgcagccattctaccacaaaaatgccatattcaacactttttcctattacagtataaaacaccatttgaccttttattttaaaaagactgtgacaaataaatactaatttaatgcataaagtctaataatgatctagatttaccagtgtaagtgacaggaggtaaattaatatggaataagtatatacttcacatgtttcttggcatatatgaagaagcactgaagcaaatgaatctatctcatgtaaggcaaatattatggaaaaactccagaatcagtagaaagagatatttttgccttttcttactatggaaattcactgttataatacttaaagctgcagatcttttctttaataataacttctgtttaaaaatctgtaacaagagataccattgctgattacataacattggtgacatactactgtgattttttcagttctgtaccaaaagacaagaaaaaaacaaaaaacaaacaaaacgataaattctgccaatgtttttaaacaagaatgtcttctacaccaagtgctactttcagatacagggctacagtgcttgaacaatcaccgtattagaaacaataagtgatacaaagagtaaaaacaattttcaaaaaaatcaaacttttataacatttacatagacaccaaagaggacaaaatatccatttccagaagatgtgcagtataattagtcagaaaggtatcgcaatgcttttgattatgatcagccagttgcaaagattatcaaataaacaatctagctattgctgctttgctagaaaaatgatcatcttagtggcaaagattaataactgctttttaaaaagacaaaaactagctttgtgatttactgtgtactttctcaagaatgcacagtaagtaaatcaacagtttgtttaatcactatcaatgtggcatgctttaatatattggatataaataattgtcactaaaaaatcatctgctgcatgttcagataaagctgtagagatctctgccttgttacctagcaactgggcaagtaactgccatactgcaaaaaaaaaaaaaaattccttattatttaggtaaagagaatgatcataaaactccacattaagatgttaatgaagccaaaatgtatattaagatacaacagctaacgattttagatgcatttatggccttggttttgaaataccatgcagtaatgaaaactgtaaagatttaaatctattatttcagcttgtcacaaacaacaacgttctttagagtgtatttttaaaagaccactgttattattaattttttatttgtactctttcacagacaaaggaatttcaaccagatcttctgtactgagtctatttattgaaagggtgatgcttacttgtttaaatacaataaaactgttctgagtaattagttcactgcaagggatcccaaattatttcttatatttcatataacagcttaatgtattaattttataacatctggaggaatctggcttaagttctgtttcaattttgctaaaaatctggattccaagattgtgcataaaatctctcttaaaaagcaataggggattagggcaattataaaatttcacttctgaggtccaaaattcagcatatggccagtcttcaggcctcaatctgaaagtaattctttctggtgtgtgatgaaggctgactggtcagagcccatatgacgatggtcacatgagagtaaggaaaccactcatcattgcaacaaacagagactgttttgtgaacagacagagctgtgcttgatgaaggcttcacaggaatccaaaccccatagcttacatggcattcctctgttgatttaatgtacgatgcttttattcatagtcacttacaatgcagggacacaattcaagaaagctcttcaaattattgcatggaattaagtttcttgataaaactttacaatttaagataaattatgctgaaaagttaaagggaaggttggctttacaaattaggagccgaaagcccagagagattgagtagttggaagttgtgcaacgatataacttcttataaaagtaaatatatataaagtgcatagaacagtgcttgccacaccagaaggattatatgtgtttgatattgttattttttattagtgtaattattattagaagtattggatctagaatctgttttttcgtttccagaacaatgttcttttcactaagcacattacctcaaaataaagcactgttttaagatgcaccatgtacatcttctatgagccaaagctgtattttaatgataaaggtgtgtattaaatgaagatgtatacgtagattcacattaaaagcagaaaaaattgagtcttcataactagtaatttatagttatttgtttaaaatcaaatctgtatcaccttcaaatatatatcatttacaggctaatagctaaacgcaagtcaaaatggtatcccaaaggaaacactttactagtgttagtgtatagaccaagatgtataaactttcccatctttaaatattttctctgagttacattttcactaattcatatcaaccattaacctgttatttttatttttataacattaactttacatacatataacctgatacgtttgtactgaaagatttcagacatttgttggattaagaaaagtttactctgagcctaaagagttcatacatatgtacttcttgatcttgattagtatatattcatcatatgcttctctgtatttacattctctctccctagctggtctcatctaggcacgtggctttagaaactatctatttgggggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaaagaaactatctatttggggagtctctcagatgtgtatctagcatcctgatctttcccctgagttccagactagtagacccaatgatctgcttgacaattccatgtggatgtcaagtttctcaaacttaaaataccacaaaaaaactcttgcttccttctttcactagtagcctaatctgttcatcatccactcagttgcacaggccccaaatttagaagtcattcataactcctccctttttctcatctttcacattaattcattagcaagatctctaggttccatctctaaaatatacattccagaatctgatttaagatggaaaatttaaactgcttcacagaacttcccttcctcaatatctaaccaaaggagaaaaaaagagtaaacattagtaaaatgaaaaaaagaagttccaacagtaaccactcaaggaaaggaacattaacaactataataaacttcaaaactggcagccaaggaaagagaagattctggaacaggctaaagagacacagtgttccttggttcttaaccctgtgttcaaccctagagaggtaaacaaaattctgagactttttgctaataattctaaatttagagaaaaacacattcagtgaacatccttatgtttccttttactactaaggagtaataggaacatgtgcaatgaaagaagaagatcaaagggctgattcaacagaagtgaacactccagggctgcccactattttggggaaacccatcaagccccagattatctcgaggatagctactagctcttatggaaccctttagttaattataaaaaggctatccttggtatctctccctccaccaccccccttgcccgccccgtcaatttggtgaaataaaggctgataatggagacatttaacacaagttaaggaagcacggcccaggaaatctaacaaagattgcatacagcttgagttgagctgagctgtctacctccctctgcaatttctttaggttgcagaaaagtggatagatccaagcaataaaacatagctcaaagaggaagcaaactggtctccaagaaggtgggaagaaatttaagaagttactcacactatgtctggggaaagctgcccaggcaccagcaagatgaaaagaaatagcacggcagatatgcaagcattctaagggagggaggcaggaggagggaaaagagaggaaggaaagagggagggagggagagagagagagcaacaaagtgaagaaaaaatataaaatgaaagtatcacagcatataggaactaaatctagaattttattcaaataaacagaaagaaatcctcacacaaacttcctactgtagaataacgagttcaatgaaaattgaagtttaaagacagaataatgaagaaatctgaatgagatgaaaaaggatattgtggacctaaggaagcaaattaaggactaaagatcataattttagaatcaataaacaaatcagaacatcagaagcagagtagacacttctgatagttgaattactgacacagaagaaaggacccaggtaccatgaatggagacacttctgatagttgaattactgacacagaagaaaggactcatgtaccatgaatggagatgaaaatgacaacagattttcatcaaatgataaactaatagatatggaagagatgaaagatgatccaaaataaggataagtgatgttcctgaagtaggtaacaatgtaagtagaataaaaggtgttttcaaagatatgatacagtatctgatctaaataacacatcatattgtggaaaattcttaagcagaccatccaacacctccacatatcttagctatgttattaagctatgtggataaagaaagaattccttgggataaaggcagaaaaaaaatcacctacaaagggtggcctcagactatacagagatattcaatgctattaaacaatgaagtaatagctgcaaaattataatggaaagaatacatgacataagaatacaacgttcggccatgatatattgttcgactacaaaagcaataggaagacgttctccaaaaaacaaaacaaaataaaacaaaacaaaaaactcacaaatgcagaatccatgggtctttctcgaaaaaaagaaacaaaaagcagttggcaatgaaatctaggcaattcagtgatgaatcaaagaactcagtcagaatgaagaagatatactaaagggctgggaggcaatggatccatttgaacataggaatttatactaaataaccatagtaattatgattacagaatagaaagtaaatattataaacacaggcaatataaattagttaaaattgttagctgaggagaggatgggcaaaagcattacctttcaaagcaaggaaccaatctgatgtgtttaaaactggaatatgcagcttaaaaatgtgattccaactctgaggtggatttactgttaacgctaaggaagcttaagttccaaggttttttatctacacaggtgatttgcgttttcccatgccctggaaggggtcacagcagtgcattcatattgtcatatttttgtaaaatttgtaaaaatactccattttcttaaagagggcccccaaattatataaccttcccacagaaatcttgatccactcctgatcaaacctcttaacatttttcatcgtattttttcttaaccataagggaaaataataactcccataataaggagacacttattggaagttcaacaattatttagtttttctttattttttttctgctgttaaatacaataaaaccattttttttttgagacagtctcactctgtctcccaggctggagtgtagtggtgcgatcttggctcactgcaacctctgtctcctgggttcatgagattctcatgcctcagcctcctgagtagttgggattacaggtgtgtgccaccacactcagctaatttttaaaaaatatttttagtagagacaggatttggccgtgttggccagactggtcttgaacttctggcctcaagctctccaccggcctcagcctcccaaagtgctaggattacgggcatgatccaccaataaaataaattttaataatttttatttaaaaatagcatcagcattatgactccacagttataaagtctttctttctatccgcacagtcatgtatcaatccctttgcacatatttatagaaagatgccttaaatgatataagtctactgctaaaggtggttatttctgggcagtggtatttggggtaattaaaaaatttaatctttgtattacatgcattgtctgaattatttattgtgatcatataacaaatatttcaaaaataatacaatgacttttttccttcaaatgccaagatagtaacagatattattttggatggtgagaactatagggaactgttattttgtactttgtattttcctgtgtttttaaaatttcaaaaatgttttccaaaatttgatattctgaatcattccacatctctccctttttcttcttccagccaagtcactattatttctcacctggactactctcatagtcttctgtgtggtcccacctgtgtccatcctagccctggtattacccagtctttacacagcagccagggtgtgctcctcaaatgtaaaaggatcacacctctgctttacattccccagctgcttcatattgtctttagaataaaacccaaactctttgccacgaccagcaaggctgacctgagctgaccgggattcagtcacgctggactgctctctgtcccccacacactgcacttgttccccctgacagatattccatgagctgttcccctagcctggggtgttctttctccagcatctccgtatagctggttccttctattcaggtctctgttggagggccaccttctcagggatacccccaaattttctaatttctccctccatctccctctccagtgcttcaccctgctggatggccttcatggcctttatcaccatctgaaatgatcttctccatttatttatttacttcctttgtatcaatcctctcccactaaatatctgctctagaaaactaggaccttgtctatcttgttcatcattatatctcctgctcaaagaatgtgcccagaagatagcagacacttaataaatatttctccactcaatggatacacacagagattgtttctcagcttaaaaaggcttgtgtttgcaaagctgtcttttaagtcagttgtttagaattcagaatgcatgttctttaaaatgagtcacagtacaaattcaatatcaagcctagctcacaaagtctactggacccataatgagttaaacttctgtatatctgcaacaaaaatgctagaaaatcaacatgatgaattatcactgggaaaataggaaattaaaaagaaacatttcaactgatctaaatatgaacaaactatgactattatttctctctcatattggtgaagacttttgtgaatattctgaagggaacgtcagaaccttttttattttttttttttttgagacagtgtttcactcctgttgcccaggctggagtacaatggcactatctcggctcactgcaacctccacctcccgggctcaagcgattctcctgcctcagcctcctgagtagctgagattacaggcacccgccaccacatccggttaatctttgtattttttgtacagactggtttcaccatgttgccaagactggtttcaaactccggggctcaagtgatccacctgcctcagcatctaaagtgctgggattataggcgtgagccaccacacttggcttcagggcatttttaagagctgcagaagtttctggttttttattgtgtataacttcatccaaaaatgtgtagcttttggctcctttgataacagaccattaaattagaataatgtttgtaactatgagttttattatctgtttttggttttagttaaagcttgggaatgacttgcacgtagttgtaactgcaacaggtggtatgttttgtgaatgcttacctgtcattacttgagtcactgtttgtgtcaaaaatgtaaaagaggaacgagtttctgggaggtattaggaagagaggggctcagaaggaaaggaattaaagaggacgtgtgattggaaagatatctgagataagagcagcgaacgagaggaaagaagaaattagtgatgaatgatcagaagaagacagggaagacgacttcctcctgctagctactaggaaatgttatcttccaagacagcttggttcctgtctagagtagctctgggtgggtaaatggagggagggccagtttgtaaataacgctgaaatttaagagactatatattatctaatttgaggctttgtcccaaatttggtttggagtgagtttttatgactaatctaccagtagggtgaaataaatagcatcattcatatcaggagtaccaaccaaccccataagagatattgaagagacaatgccaaccttccattctggagtaaagctatagtgcaagaaaacaatttgaaccaattattttcatactaagttgacagttaagacagaaaaaaatatatatattaagagccaagagatactgcatatggtctgcaagtcttttctggagaaatgaatcatgaagataaagagaactggcttatttttacagttacattttatatttctagaaaaataactacaacatggtcttgatgtctaaacatagggaaatgagacttttatgaacgttacacaacacaaaacataccacttgttgcagttacaactacgtgcaagtcattctcaagccttaactaaaaccaaaaacagataataaaacatatagttacaaacattattctaattgaactatactttgaaaatgactgaatgctcaaatattcttaaaatacaatgttctcttgccaagaaaagagtgttggtcttaaaatggccacaaaacctagccccgtcccatgttactagagctacagaatcaagcaccctccaaatatatggccaagcagccttggaggcacctaatgagtccaacgcagtcttcccatgtgtctcagaggctgctgtctgtagtgacagaggtgatagaatatggtaaagttgcgtatctaggaaaatctcaatgtagtccctgatttcccagagaatgttcttgtggcttatcctctgaggttagtagtttcagtttagtacattaattccaaacactaaagagatgaatccattcaagtcatttacagaaaaattgttttgagatttacccaaaaaacaaacacactataaagaatttagtaacagagaagattagaacttgcacttttgcttctgctggttcaagttttgttctgatattctctgcatttcctatttccatatgagaaaaccaccagtacatctttgctgtgtgaataccaacactgagaaatattggccaaacataaagatttttagagaattaatttttgatattcatctaaacaagccaatatattctcacaattttttaaagaaaaaaaaaagaactcagcttaatcatatatttgacttctaaaaaatcatctcatgattccatgaagatagagaaaaaatcagatgaacaggaatggttttcatttcacactggaattataagaaaggttaatttttgcataaaaattacatctacataaaaataatttctggaacaatgcattattgacagttatgtgggaagataaatgcattcacgtaaatgttctttctcaagcaaattactaaatatattgacagcactgcactttgaaaacaaccattttaaggcaaccaaatacatatacaagagtaaaaacattacatataatagccaatgtaatgtttcactcaatgcatattcactcaaatatgcatactttttttcagtttattgatatatactgctattaaattaaatagcaaacacttatgctttgttgttggctattgcccacagaaggaaaaaaatgggtagtcaactggagcctattcacacttctgttaattactggtggtccatggaagatgttatagtttgattactagcacttgtaaatattaaccaagtctaagttactgctataaaatccaaaatgtgtaaaaaccaaacacacctatacaaatacaaatgttttactcatgatcgttaatgactttaatcaagcagatcttctaattaattttgctaattgttcattcctctcaggacatttattggtttgatggatattactatgacatatgttgatgccagcatctggtcagaaatgagggcatcaataaactctccttggtgtttctacagaatgtgccaatgctataaacactgtcaatgccacagcatttatttcaatataagattttgagaacatgtctgcctttcatttagagaaaggataaacctacttcgaaacacacggtgctcaaatatgcttattcaatgaatggtgcaatgagaatggcttgataacaaactggaaaacatctgccaacatttaaaatagaataataacatcataaacgattattaggaatggcttcccccacaatgtactctgtcaatttataccctatttcgaatatgtagactaactttaaacaaatatagtaccgctatcttaaaggaagtgatcccctaaacatttctgaccaaaggtaatcatatgcagtaaattaatagacaagaaatgcatcagaattcgattcatgtatagaaatttggctaaacttgcaaacttttatgttgttagtaactattcagagattatcactttaaactgctgacaaataagtgcacttatgcagttttatttttaaaaactagttatcccaaaatatcatattaaataatacaccatgctgtatctatatttcaaaattattttaatggagatttgatctccaggtagaggcaaaacactgttttctccttctggcccccattagggaaactgtaacagtatggttgtctcccgtttctacacatgaatctattgtcactctactgtcatggcttaagaaaaaaatattgcttctactcaaggtgccaaactgcaccaagcaaagtaactccaatgcagtaacattaagtttggcaactgcaggacaaggtttccatccttgaacaaggagcactgatacttcactattttgccccccaacatcatatttccccctgcattctgaaggtttttttaaaaaatatttgtaacaatgtttttgtatgacactggcatcaagtctcccaggcagcatgcatctgttttaatttcatttgtattcgttactcctttcttctctatctgagtccaagagaatcactgctaacacacccagcactactcaggatagacaacgacagaatgaaacacttctgaggaagcctttccggtggcataatgccagcactactcattatagcctattttatcacagagccgtcaacattacggactcgaataacccagataccagcggcatccccttgcacgagctcatctgcggagtacaaggaatacagatttggaagaaacctctgagaggttttctaatctttcctctcttccttctgacttctaactttaacgtgagcccaccccaaagaagagaactagactctcttagtaacttgtgcaaaccttcagaaaagtcttaggttgtacctaaattcctcatgttgccattccaacactatttcctgtagttttccctttccagatgcaggagtccacagagcaagtatccttataagtgtctaagaatcatcaagcaattccaaagttcccgtgtctctaatctactgatccaacgtgcccggcgcacataagcagcaccgcgactgaatttcaagtcttctcaaactcacacctcagttgctcagagaggagaaatgcagcgaggactcgccttcctggccagtctctgaaaacgcgaaaccttcctgagctgtccatttgttttaggggctgtttataaacggctggttttcttggaggaaaaataaacaaataaatacggggcgatggcagcatcctgataaacacaggaccttgtttggcttttggcaagttgtaacctggagtaaaatcacatccaagttacaagcacgcaaattggaatttcgctggaaacactgacccgaccttcaccgaagcagcaaatcgcagtctctgctgctctgctcctgctctccaaggcttaacattggaaagtccatgcccacgtccccctctaattaatcaatgtagaaagaaatacgagggaagagagagggagcacactccacaccaaccttgccagcttctattcttcctgctattccttaaaggcgatgcacagcgcacctggaaattacgtggacttggcatggctttttaatattaaagacaaacgacctttggaaaatatacactgttaaagtcaaaccatttggagagacacccagcaatttacctcctcaaactcctcggaaccccaagaatgaggaaaggaaatggaaaatgcgcttaacccgggggtggtgggggaatcgataaccagaacaggtttgaaaaaaaaagcccccctcccgccccctccgtagagaccgctagctgaggctgcaacacctgccccggcaaagcgtctccgcagccttcccggcttgcccgactcggcttcctccgcctctgccccggctgcggcaccacttcttggagccacgtctcggcgagcgggggccgcggagcgagggggccgctgtgccgctactcacccgagccgctcgggctggccgcgagccgggatccgcgagggctggcgggctctggcccccgaggacgcagacatgtggcttgaacctccgctcccctagccgttgcctctgtgcatctttctgggcgcccccagcgaatgcgagcggcgaggcgagggcgagcgcgccgaggaagggcgggagaggcgcggagcttggccgcgccgcgctgcgccgagcgccgggctctccccgcgagctccccgggcccgcgcgcgcgccccccactgcccccgccccccgcgcggcgcgtgccccccaccccccgccgcgcgccctcgcacccgcccggctccacgcggcgcgcgcctgccctggcggcagcggcggcggcggcggcgcgtcctcccccgaacgccgtctccagggctgctggctgcgctctccattgttccgcggctgctgcccggggtgggcggcgaggcgggggggaggtgtcggcttggccgccggggagggcttaccgctcgggcggaccctcactgcgagagcgatgcgggcccaggcgcggcgcgcgggggctgcagggcgcctagcactgggggttgccggcgcgcgggggcctcctcctggctcccaggcactcgctgctgctgggcgcccctcgcatcctcggttactatggatatctcgctcctccgccgccccctccgcgcactccgggaggccgccggggcggtagcagcggcgcggctccgcgggtgcccaggtgaccggctcggcagcggcagagcagtggcagcagccgccactgccgctgttactgcggtcgccgccgctggagagaggaggacgaggagggcaaggggcagaagcaggtcctgctctgtctgccccagaggccacctcgggtttcttctcactaaccaagcgacttcgtgtttacctcgcaggagacgcctcggcagtcctcaacttgtgtgcgccggtggccctctcctgtgggacttgcgttccagctgttctcagagcgggtatgatcggcctccagtagacttggagggtcacgggtgagattttgataaggttcaaatactcctcactcctgcctccggtttccaccaaagttaccattgtactactaccaacagttgtggaaatttactttggcaaaggttttgtgtttttgtttgtttgtttttccccccaaaaattatgccaattaaatccgaccttaaatgacaaggcttttctctcatgtttaaaatcccatttttttccccttgccataaataaataaaaataacttgtggcttacaggctgcttaataccacaacattttaatgagcatgtcaggtaacccacaggcttcagttctttgttgcttacaagttccatccgtaagtgtgagttgctcacttagtctggggtaacaaccgcagattcccacagagaagaatcagtgtcttaaaacaaggtaataccaacccaatggtctatgaataggttggaatggcggtactttaagtaaaagtataaagaaatggttaacattatgaggaacttccagcagtactaataatcaaccctgttgttcaggagacattcacttgctaaactttaaggctaggcatttactgccttgaaagcaaagcaaatgaagattttgaccaactgcaacattcaggctctaaaatagaaatatgaatgaattattaaataataggtaacatttactgagcacttacgattttccaggcatctgtgcattatctcatttaattcttacaactctatgaaggtttcattatattatcctcactttacagattaaaaaaaaggcttagatctgcaactggtagttttggaagaacattcttttccttaaacaggaaactctaaatgccctctgttttgtccacctttgtgccactgtctgcttctgtgagggtcaggataatagtatacctgaaaccgcccttttagcaagcggcagggccaggacataagctcagactagatgtctaattcacttgctatacatgtaacatgtaaaataaaaaagacctgcatcttgactggtgtactctttgataaatgggacctgattacttgatggaggcatgtttgactatctttgtttatgacattagcaaactttcaatgggtttggaagtgaggctatttagttctgtgtcttactctgcaatccagacacctgtgacttgaggtaaagtaagtgttttcttggtttcccaatcatgagagtgaccgaagaatgacattttccaggtcatcattctcttgtggatattgttctctgataacaatattgggcaatctcaaagagctgtcatttcttggcagtgaactacaggctatttggaaaggaggtgtaaatcactttttcatcatgtccagtcctctgcactctagagtcatttgggatgttttgtgtctgcactacctctagagaatgatggaaatctaattctctgtcagcttttctacctggctagtgaaaatgcttcttgggagagctgggaggggaagtcgctgtccatggtggtcgttactgaagccccattcagcaaaatcggttcatactctaaatactggaatcctgcttaattaaactaaggagcttctgcacagcaaaataataaacagagtaaacagacaaccttcagaatgggagaaaatatttgctagctatgcatctgaaaaaggactaatatccataatcgataaggaactccaatcaacaagaaaaaaaaaagcattaaaaaccgggcaaaggacatgagcagacatttctcaaacgaagacatacaagtggccaacaaacacatgaaaaatgctcaccattgctaatcatcagagaaatggaaattaacagcacaatgagatagtctcacaccagtcagaatgactattattaaaaagtcaaaaaataacagatgttggtgaggttgccgagaaaagggaatgcttatacacaattggtgggaatgtaaattagcacaacccctgtggaaaatagtatagggatttctcaaagagctataaacagaactaccattcgacccagcaatcccaatactgggtatctactcaaaggaaaataaattgttatatcaagaagacacctgcacttgtatgtttattgcagcactattcacagtagaaaagatatggaatcaacctgtgtctatcagtgaatgcttgggtaaagaaaatgtaaatatacaccatgggatactatgcagccataaaaaagaatgaaatcatgtcttttgcagcaacacggatggagcttgaagccattatcctaagtgaaataaaaccagaaaatcagtaccacatgttctcatttacaagtgggaactaaacaataggtacaaatggacatacagagggaaacagtagacactgggaactccaaaagcagggaggatgggaggggactgaaactgaaaaattacctattaggtataatgtccactctttgggggatgagtacactagaaacccaacctcaccgttatacaacatatccatgtaacaaacctgcatctataaaaataaaaataaaaaataaacagctgttaattttgcaaaataagtaaatattacagtctggaaattaacttcatcatggcactaatgaaatttggtgatattctccagtactgtatattaaaacataaagatcttatcagtataatctactggttggagtaaaaacattaaataattcacaggagaatgactttttactctatggcactaaaatagcccctattcattgtcaaattttagatatttttaggtaccagaacagcataaaggggataaatcatttcctgaaaccctctcaccttacagcaaagaaaatagctacctatagaggttaaccaccataattagaagcaggcgtaaaaccatgaattcttgccacagaatcacttatcatgattctgtgatgcaccaggatattgaatgtcagaatcattctttcttcagtaatttcatttttttgcttaaaaacaatttccaatttatgtcatttgaaaaacagataatatatagtctgatgtaatatgtagctcatgttcatttatgtggagtgtatctaaatcttataatattctagctgtattaagtaatattgtttcctgcaaagtgagacagtagaaaaaactcttatggtaccaatttctgaccactgtaacccagtgaaaagcaaagcattaatttcattacaggtcatcaagaatgcaaccgtcaacataaactgcttatttaagagcagccattttctatcagaaaggactaatattaaaattccccactttcctatattctccctttgtattaaaaaattatccaggggaccatgttgaatattccagtctcaaaaatccaaagatggtggtaatttttctaagagatatgtaaggccctttgtaagatttagaggaataggattttaagagtttattcatttgtttagtagtagtataatgcaatagttaatctcctgactttggaataagacctgtggattcaagtcatgggtatttaacttaattgttttgtgatcttgagtaagttacttttttgagccatgctgttctaatttgtgatatgaatgtgataataatgtaagctacttcacaagagttgtggttggaaataaattagattaccaatatgtagtacttttcactaagtaccacactacttttcactaagtaccacacattggtaatatcatttggccaggttaaagtttccatttactcaatcaaagactaatctaggtgtttctgtgaaggtattttgtagatgcaattaaagtctatagtcagttgactttaactaaaggagattatcttagataatgtcattcaactagttgaaagtccttaagagcggcttccctgaagaagaaattccacctgtggacggcagtttcggctcatccacaagagttttcacctgcccttcctaatggcttgccttagctcagtcttgtccagccagtctccacaatcatgtaagccaattccttgcaataaatctttttgtatatgtctcctactggttctgcttctctgactgaaccccaactaacacaccatgtaaagcattaactatagtatctgtgacataataaacactccaaaatattagttaattttttaaattaacccttattgaacatctctcacatttatagcactgaggtatacactctgataaaaatgtctgagagctctgaaatagaatagggatagatagatacttattgtctccaatgatagtaacctcaaccaggaagggatttaatgttttagtaaaatttccaggaaaacaagggaaaagtgccaatgggttgattattccatctggagctatgtaggggaattatgcaaattcagtatgaggccagtttcctgggttaggaagacaatgaacaaaaaggcagttactgttttctcaacagatccatatagatgtagcacctgaaactagacacaccagtttccatggatcaaccatggaattccattctgtaagaaaaatttatttacgacttggtcttaagccaattggaattatatacttgataactgccttgagattcttggaggaagaaatacgctcatatttaagagtattaaagtaaaagatctttcttatttcaatgttagcttatcttagtattctacattgttagatctttgaatttgttttgtgcatttttaagcaaggaaaaaatacttatatcactaaaaagcaggcatagcacaaacctacttaaatagaatctgcctccgtccttcagaattataatgccaaacttacaaaacttaaggctggaaatatctcagatgagtaaacaaacctcagggaggtagtctcagatataaataggattaaaaggtgatgagaaagtaagagagagtgagagcatgccttttggttttatattaaagctctgataatttagagtgaatcttagaaatagaaatgttttaaattgtgtgtttgcaggtgtgtatgtgtgtattcactaaagacagctgtcccatgatcctttatgccataatagtaattttctcaaaggcagtgctattgctgtaaaaatacttttactcattatgcaaagatttattgaatacctgtgatgtcatatgtcgagctggttgctaagggataggaaagtaaattagagatggactctaatcttgtggaactctctctgggcaactctaatttatccttatggatttcaactaacacgtgactttctctaggaaatttttgtacttcccttgctctgcactggcctaggcagttctcttttgctctcacagtaactttgcttccactaatattgcatttatcattttttttagtaattagtcaattgcttataaatctccctataagactgcatgaggtcaaggaccttgtttatgtgaacctctatttttgctcggctcttgtcctcaaataggcattaggtaaatatttacagaacgagtgaaagaaagcttgggacatgttgaattttaattgctttccaaatagaaatatgcaggaagcagaaaatatataaacctggagctgaggacagagatgggtgcaagggatacaaatttgtattagctgattcctggtagttggaaggcctgggtggattatcttcaatgaggctcacatgtagaattatgaacgagaaagtctgaggtcaggactctggacagcgtccacactctccattttatctgtgggatgaaacatggcccacatggctaggatggaaatgttttgggaaacccaaagcccaaataaatcttttcaaccatgtgagtaagtttctaatagatatttcagaactaagttactgtagagacaggagcactataaatatggatttataatcatgacattgtggaactttacctcccaatatgtagagagcagggttttcaatttcgcaaaataaataaatgaataaatgttagcatatgttaatagagggcacaaaatagaagtcagagagagaaagagtgtctgtggggactcaacagactctgtgggaatcagactctctgattttctctctcaatggaatcaaggagtcccacgagttaggcattgggaaaggctctctgggtggtgaacagacatgtgtggctattggtggtgaatgtccaccacagaagcagcgtggctcttccttatactcaaggcttttttttgccattaatgagaagtaagacacagactgactcccagcacttaccaattttattattcttattgcctcctcatactttgccatgggaaaatccctgtttggatcacaaatttaaaacaatagactgcctgttaaccatgggcatatttacagatctgactatgagctaatacaacccagagtgagcagaagggacttatactttttcctgaaggcaagcaggcttggaatccaaggggaatgaatataaacactgagacccatctgccccagtcttctgaattaaaacctagggacttcttttgttaactctgttcaaggcccaaaccacatacagctccattgagccacagctaagatttttgcttgcagcctttgcttagaactggcccctgagagtcagtttcatctgtacagcacagttggtaagtacctcatccttcccacacctttaagcaacagaacagccacagtcaacacttacagcaactttcaaggttagcaatgaaagaagaaggctgcagtaacctcatctggatgcctgttttactaagtaattatacatcccaaatttcacaggacaaccttctttaaatgaatcagatcataaaatctgatttttcacttaggaaaatatggttaaatcatattagagactcatacttggagtcttcaaggaggtagcataatatacagaaaaaaagtccatggactccgaccgtggttcaagttcagctctatcatatttactggttgtagaccctgagcaacttgcttaacctgactgcacctcagtttctgcatctgtaaaatgaggataagtgttctttaaagatgttgtttaaggattaaatataagtacactcatataaaaatctagcacaatgcctggaccacaataattattcaaccagagaatcaagttcaccctagtacaaattcataagcattcagaatcaagaagttattccagcttatcaacagaactaaataataaagctcattcccacagcaccttctagtgtgcttatcagctgtgtaagtgaggaggagcccatgaacttgggaggggacagtaactttttatattgtagactcataaaaatgattttatttttttctctacaggatttttagaggacaaaatagtctctcatttgatggtgattatgtacattattatgataattctctaggaatgcacattaaggattttgaaatatattagaaggacaaaggaagaaagaatgacataataaatattaaaacataatttggggttgggataattgaatcttaggataaaatatggctgatggccattgttttttcctgctcaacacccggtgctctatttctgttaccaatagtctgatttgttactggggacccaactctcccacacttagctatgaaatcctagataatcaaccttaaaagagctggccatggagtggacccatgagccactggccaagcagaagattccatcatgcagccacagtggtttgttcagagacggtcagaaccaagactgttggaactactgggaaaaaggggaactcttctcactggggcttctgatgatgagcttggtattaccagggtgccaggtgtaatgcctggagctgccaagggccatcttgtggagagggtctacccaagagtgaagccagcgcagagaaaagcagagcagagatatggattggagtccagtgatagtttttgaggctctggatccagtcatgcctgaaacctttggactttatctcttatatgagccaataaatttttcattttacttcagccacttggagttggatttttggcagttgtaactgtaaagtgtcctgatttcttcagcagggaacttaagtataatttatctcaacctcccctctgatgtttgaatcttctctacaacttctaatgaaagagtcactcaatcaaggcttggactcctccagtgatagggagctcattaccaactgaagaagcccatccatctttgagacttatattactgcaaaattttttcttatatcaagtgaaggtttctgaaacctttgtaattaccacttattttgtacccagtagaggccagagaccctgtgctatgttatacttaaaaatatacattgtgatttaattctcaaattaaaaatttgaaaattttatttttgaaataatttaataaattaaattaataaaaattaatatctaatgatattaaaattattttagaagctgctgcacaaatccaagtgagaaatgatgagaggctgaagcaagggctatgggggtggggataaagaagatgaggagggatccagtgatgtacagatgtagcatacaggtgactgagtggagggtgagggcaagagtgaaacaggagacttggagggcctccagaaaatagacaggtgttgaaaagcagggagaaacaacctggatgggaaagatgaaggttctgctgtttatcccaagagttaccataagtcgaaggggtcactacttccaaggacacatgatagctctacaaatttctttaaaattttaactgaatctggtttagtgttaagaaataatcatgaacagaattggatgtgcatcaaaagcaaagttttagaaagacctgcaatttttgcacagacctttaatcacatgagtgcaagtcagaataacacttttatgttcagcccttaagactggtttctcccttctctcctcctgccagtgccccagaaggcagaggagaggatccagagaactcagcacgaagatgcagcagagtttgcctgagccacaggggatgggagtctgaccgtgaggtccaggaaccaaagagaagtgcattccagtggaatatgtttctaggaatgggaaagagggagaaagggaagaaacattttatgtatacctactatgtgccaggtcctttttatgtaggattattattattatttcagtatcactttttttttttcccaaatgtaaaaactgtggaggtctgcaaagttaagtaattttccaagatcaagcagcattagaattaagtccaggatgtatgtatgcctctgagatctgtaatttcttcattatgctatgctgtctccttaaataattagcagttataagacgcaagttataaggtgacaaaatacattgacatggtatctggattaacaacaacccagaaggctagtatttctaatattgtttctattttatagatgaggaaactgagtccctaagaggttcattgactagctcaaggccacacagctagtaagtagaaccatagctggaactaaaaattcccatctccaagatctgtgtattttcccatgacactgcagctactacgctgggcaagctactatgaagctggactttgtcagaacagtgacagataacagctttgctctgaaacgttctttccttcaaaggaacgcacccaacctaatgcttgtggtggcgcctgctttcacccacattggctcacaagagaaagactccaaggaaaaaaggaatgagggtccctagagtttctgatgagggtagggcggaggtgctttcaaggatggttaaccctctctcagggctgggcgcaaaggctcctgcctgtgatcccagcactttgcggggccgaggtgggaggactgcttgagttcaggagtttgagaccatcctggacaacatagcgagaccccatatctacaaaaaatttttaaaaattagcctggcatggtggtgcacacctgtagtcccagctgtccgggagggtgaggcaagaggatcacttgcgcccaggaagttgaggctgtagtgagccaagatcgtaccattgcactccagcctgggtgacaaagcaagaacctgtctcaaaaaaagagaagaaaaagaaaaaagacatgagacgtaggagccaggcatttttcagccacaaataccaagtggataaaaaaaaataatgaaaagaatagaagaatggttagcccactctctttctagtgaaccctgggataaggtctatggtgcagtgctgtgaaaattcactcaatccacgagatctatacactttgttgggacctgggatagaatgaaccagtgttcccttagaatggaaatgactgagtagaaataatgtgggaagccacattaactctttcaggccattaggctatcatttagtaaattactacattgttctaaatgggtccctagtgggtatggagggtgagaatgttctaatttgcttttctctcctttctctcagctgctttctcctactatgatgtagaacaagaagtggtttaataactgctctattccaaatcactgaatgctcttataactactgcataaaagtgcccctgcaggtctgctatattgaaatgtgtggaatcaaatctatgcatatgatatgaggggtgggggctgcaatctggtacccacaggatctagaagtaactcgaggaaccaggatatccctgattttaaattctaggttaatggagggcgtgtgaccgagagccccatgttcctggggagggaacagatgccactggaagctgcagggcaggagtttctccacctaaaagggaggatccacaactctgatctgaggaggagtccgtgtctctgccttggcatgtatattacaagagaaaatcataggaagggcaaggatgttccctgacgactggcttccctctgtcactcaggatgcatggccactgttggttgaaggaactatcatttttctccctgattgaaaaacaaaagaatcaaagctctcccttgtgcttacaaatctggggatattaattaaatacctagtagagatgctggggcctaatattattgcataatggtgattacagcaacaatgcattatatagcattaaatgtttttgaagcactttcatattcatttgttttttaaataatttttgtttttatttttttccagtttcattgaggtagaattaacaagcaaaacatgtacacctgtatgtattcaaggtgtatgatatgttgttttgacatacatacacactgtgaaatgatttccacaatcaagctaatgaacatatcatcccctcacatagttactctgtgtgtgtgtgtgtgtgtgtgtgtgtgtgtgtgtgtgtgtgtatgtatggtgagaatacttaagatctgctctcttagtgaatttcaagtatacaatacattattattaactatagttaccatgctatattattaggtctcctgaacttattcataactgcaagtttgtaccctttgtccaacatctcccctttgcatattcgttgttggtcagggctatcttgatggacatatgaagatgggctccatgcttggtttaattctctgcagtcacagtcttgtaattccaaataactttaacttggaattagtattttgtaagcaaggtctgatgggactgtggagcatgtgctgggcttggaacctcagcttgatgccgtcctgccttcctgggatgggtttttggctgccagctccctgtctcatgctggtcctgctcagggccctgcccactccacccccttaccccacaaccactgctgcaatcaggtggcactggcagggggaggaaagagaccagcttggattcagtccttgaccactctcttcccccaatggtggtggtgggggagtctcgacatggacggtcatccacctcatggctttttggggtaggcaaggcagcagccatccttgtccctaattgcaacatcatggcttgtttggtgggtgatatagtttggctatgtccccacccaaatctcatcttgaattgtagctcccataattcccacgtgctgtgggagggacccagtgggagataattgaaccaaactgtttaccccatactgttcttatgctagtgaatcagtctcacaagatctgatgattttataaggggtttccacttttgcttggctctcattctttctcttgcctgctgccatgtaagatgtgcctttgcttctcctttgccttctgccaggattgtgaggcctccccagccacatggaactgtgagtccattaaacctctttttctttataaattacccggtctcaggtatgtctttattagcagtgtgagaacagactgatacagggggcaatacagttggtgactctgcatgagtctttcacccatctctgactcaagtaccaagcacatcctggcctagggattgtaatctgttgggtagtcacctgtctgctgtgggttgggagtggtgggcctgtaggaaagggagattgacttccctgtccctggccaggcctcacagtttcattttataccaggccttgcaaaatatatagccagacctgtagttgacatttattgtaatatccatgcaagctggataggacaagaatgttgctactgttatgtctgcttccattatttctactgctggggaggctaccattaccttctctgtgacttgcacttgggcaagcacttaacaatatatcatcccatttaatcttcacaaccaatatacaaggtagggtttatacactggggtggttccctaacttctctgagttttagtttcctcatctggaaaactggtatcataatgcctacttggtaaggatattgtgagaattaaataagatgacatgtatattaagagatggaggtaattttatctacctgcattcctctaattctatatttgttaggaagaaatcttttggtaagctgcttgaggagaagagtcaccatggacagactaaaataacccaataagcttgcttaacttttgcacttatgacaaggagtagtgtttgttccttgccattgttcccaagaggaaggtggcaaagaaagagttggtgagggcgaagcatttgcaggggaagagaacaggagtgacagtatgtcctttagaaagtggaaatattgaatggggttctaaacaaattgtttggttgggtttatgctataaacagcccaacctacccaccgtcatgaaatcttcagtaaaggctgtgtagctgactaacgcttttgtgtgtgattagataaatgcgggagaggggctcagtgtctgttctcaaagaggcattgaaattcacatccacgttggcacaagtgaaaacagacagcttgtgccagaagatgagtgcagagctggtgtgtggttctaatactattcttggaatgcttcctctgagtgacctccctctctgttcaggccacgcatttctggagggtataacagcagtatattgttatattgtatatatatgtatattctgtttggtttctattcttccacaggccccaccatcaggttccgcacagagtgaacactcaaatgttgagggctgataaatgtgagtagcaactactaaatgaaggagatgaatatgcttttgtatagtaacttcaacgatgctttgatatagaaattagtttacctagtgtactgatgaggtacatgaggctcagagaggctaagaaacttgcctggcgtcacacagctagtaagcagcaaaaacagacattcatgttccatacacaatgccttcctggtcagtgacactttagcagactatctagagttctggcatcgtataaaccaggcattatccacatatgtatattttaaaacctcactgaaagcagaaggataagatgaattgactttaagcattcctggggaacaaaaagtcaaaatggaaaaggagaacaggagcataagaaaaaaatatatagcataactcgttatcccttagataactgtagggtcatgctgatattagtcattgtactgtgatgacaccaaaaagggaaagtgtaccagctagccaggtagatgcaattcattgtgcaagaaaaggctgcctcaaatgtgtctaaaagcgtggttcttcattcagccaagtcaagaccaaaggagcacatgaataattggctacagctcccctttcagcaagtaccagctttctctgctgaggctgatacagctccatacctcagggggccgggaatcagctgccagcagccaatgggcttctgagcattcataagcagaccaggtgctgatccatcaggctaattagcagcctgtgggccacagttagctgggaaggtggagggttttaactcttttcctgacagactccaagcctatctgggctttttgagcaatgttctatcagtcaaaccacaaagaaaagtattagaattcaaaaggagggaagctaaaaggaaatatagttttgctttaaataagacaagggagactaacaacacaaaggaagtgaactttgactctcaaatatacatatatatagatgtatatatgtgtctgtacgcatctcagtctacgtatcttcatgttactgactgtaatgtcatcaccacagcagacattcaatacatgtttgcttttgttgaggatgatatagtgatatttaaaacagaaataataaacaagggaagaaaataggacaggattgcaagggagggggatatttagcttgttggcacctgaaatgtatttaattatcaggctcccaaaagagcagaggaaacagaattagcttcaatgaaaaatacagagaacatgctgaaagttcagaaaaaatgcaaaacttactttaattaggagatggagatggaatacatcagaaatagtgtcactgcaaattaccagacttataaaccaatatgtaaatcagcagaggaaacaatcccatgaattttagtaaatttgtagaaacttgttgtaaatagtgcatttaaaattagttttaatgtgaaatagaatcaacaatcaatgaagccaacaccatccaaatgtcttcattgacataaaaggagcattctatagtcaattggttctatatttttgactttagtgtggttttgttgatcatggatccaataatctccagtgaagcagtgccaatatatgatctagcgataggaaataacaaacaagcatcctaatccttaaagtagccaaatctgacaatcatagaaaatggcaaggcaggatactggcaaaagtcttaaaacacagaggtaacatttatggagatgtctgcacgggctctctgtcaacatatggagaattgaggaagagctacgggatttcaatgacaagcccatcaccaccatctggagataaaaattctgtggtagattttttttttaaactgtgatattttactgataaattttatattagtgacaagatcctaaccaaagtttccttggactgcttactataaaactgtgtactattgactctggggttaaaaaaatggatttatgcctcactgagaaacagctgtcattgcatttgtagaatcatagtgtcaagatgatgaaactgagctaattccagagtcttcagggacctaaagaaagcattatacagccctgaggaggtttgggtgtactggcagtaatgtcaactgtatggccctgagaaactaatctccatgttgagattatgaacacaaatctttccccaaatatttactgagtaaaaacatagtgagtggtccattagggagagcaggagcatgagttggattgtttttgttctaagaaatgaatgcactaccttggactataatcaatttggggattgtggtcttttaaacagaccatagcagatgattcagtgtcagtgggccactggattcatgccaagtgataattctccataacgcttcctacagtctggtgtgtgcaaaacaggcaaggtcacaagtctgttctacagccaccgggtgtgctggtccttttattgtcctggcaaagtaacaaccctgtgtatgcacccctacaaactatctccccatggtttggtcagagctgacccccaagctcaccctgcctaagtcatttattactagcagaggaagaaataagcatataatcatgaccttatctacttctctagcctcaaatctagtctctcctcaatcaaaccctttcctatccctcagggacaccttgactgggtgcctttgcctgtgggactctctgcccttagcatctttcaattagttctctgcctggaaggctgttcttctttcatgtgttacctcctcctgaaatggtttcttgataataacagcaaacacataggatttgcttcataccaggcgcacttctaaatgctttattaaatgtacttacttctcaccagaaccctttgaaataggtactgttatagtctctactttagatataaagaaacttaaaggcagagttgttaagaaatttactcagggtcactggtaaatggtagagctgaggttatgaaccatggcagcctggctccagagtgtctgttcttcatcacgactctgagcataatgatccctagactttgctgttagtatcctgagcactcgctaccagagaagtagctgcactgcactctagtcatgtttgtaagcttcctctctttccatgctaactccagttaatccaacaacactcagccaaagcatcaactttttcccccttaagtcttcctgatcctgctcccctaacctgtgggaggtgaatcctccactgcccacaccatgcttctctctgctagactccttatcacaccacgtgtcttgtttacctgtctgcctccctcattaatctgtgaactctgaagttttgaaggcacgaatggtctcagtaacacagtatctggcatatagaactgttgcttaataaatatttgtctgtttgatggatggagactggtgctaacaagtcttcattttgcaactctggtttctagcttttaccggcagattaagaacaaaagggattccatcacaaatcctgggagaatcatgacaaatgcttagcttcagttcagaaagaagcaagactatttatagctcagggactcaacattaaatgacccggacttaatttttccttgtgacctagatttgcacaactttagatggaaagtgcccttggagatcattttacccaggtattgcaaactggtggcctagagttgtttttatttgacatatattatttgtttctatttttattagaatacctttagacaggacatgtgctttttatttctccacattttacatcatatcctatcatacaccactttactcatttgtattatccacctgaccattcaaagcatttgaatatgaaatgtctgaattagtctaactcattttttttggtctttgtttacagtaaagctcccaagtctgtacttagggtctccaattttctcattaattcattccagtcagatgttctcccaccctctactgatgtgtagactgatttccatgtaacaatgtaccaatcatgtaccagtgatttccacctagctaaatccagttcctagcttggacctcaacccctcctccttgacattcaggaccatactctcctggttttcctcctacttctctggcctccccttctctgtcttcttgctgattcctcctcatactctcgacctctaaatgttggatcctccaaggtgcagctcgtggcctgcttctcttctggatctactctcatccccttggggatcttgtacaggctcatgagtttaaacactgcccacatgttgacacttcctcagtgtacatctccagctcacttggttgtctagtgggcctgtcaaacttaatatgtctaaaaacaaactgccaatttcttcatattttttttgttgttgttgagatggagtcttgctctgttgcccaggctggagtgcagtggtgcaatctcagctcactacaacttccacctcctgggttaaagtgattctcctgcctcagcctcccgagtagctacgatgacagacgcgtgccactaccacacccatctaatttttgtatttttagtagagacaaggttttgccatgttggccaggctggtcttgaactcttgacctcaggtgatttgcccgccttggcctcccacaaactgtcaatttctaccccaaacctgctcttcttagcagttttctttatgtcagttaggggtatatccgggccaccagttgctcaggccaaaatccatgggcttatctctcattgcttcctttctatgtgatatggtttggatatttttcctcttcaaatatcacgctgaattgtaatccccggtgttggaggtggaatctggtgggaggtgtttggatcatggcggcggatcccttatagacggcttagctctatcctcttggtgatgagtgagccatgagatctggttgattaaaagtatggtacctccccactctctcttgatcctattactatgtgacatgctggctccttgtcaccttttcagccatgattgtaagcttcctgaggcctcaggagaagcacatgccagcaccattcttcctataaagcctgctgaaccatgagccagacaaacctcttttctttataaattacccagcctcaggcatttctttatagcaacacaagaacagtctaacacactttcatatgccatatacaagtcctcagcagtcatgtctactccaatcttccagtgcctcccttgttctttaagagtaaaagccaaagaaagtccttagagtggtctctaggagccttgatattctaccttccttccttattcctatccctacctttatttctcagacccccattcccaccactatcccccttattgacctgcctccagctcactggcctcccttcactgttgagtgaacactccaggcatttttctacatcggggtgtttgcatttgctgttccttctgcctggaatacccccacccttcccttccccatccccaggtatctgcatgtatctgcatgggttgcttcctcatttccttcatgactactcaaatgaacctcctcactgaagctttccttgaccactctatttgaaatagacttccctaagccaggatgatttttcatccctcctttctgcttttctctagagcactttattaccctctaatatcctatatattttacttacctattttgtttctcttcctactagaatgtaagctaaatgagggcaggcttgtttgtcttctttgtttactgctacatcctcagcatcagaataaggctgagaacttgttatgggttgaattatgttccccccaccacccccagtaagtcccagtgaccttatttgggaacgaggtcattacagatgtaattagttaagatgaggtcacactggagcaggctggacccctaatccaatatgactagcgtccttctagaaagaatggcatgtgaagagaaggagatatccatagagggaagatgatgtgaagatgtacagggagaagatggccatctacaagccaaggagagagatctggagcagatctttcagacttgatttcagacttctaagacttctagcctccagaactgtgagacagaatttttttttagacagagtctcactctgttgcccaggcaggagtacagtggtgtgatctcagcttactgcaacctccgcctcccaggttcaagcgatcctcctgcctcagtgccctgagtagctgggactacaggcatgtatcatcacacccagctaattttttgcatatttagtagggacgggctttcaccatgctggccaggctgatctcgaactcctgatctcaagtgatccacctgccttggcctctcatagtgctgggattacaggcatgagccatcgtgcctggccaagacaatacatttctattgtttggaccaacctgggtgtgttactttatcactacagccctagcaaactaatactcaaaaaaattctcaagaaaaatgtatgggtgaataaacaagtgaattaatcctttcaatgaagaaactgaaggccagtgaagttgattaacttgccagaaacacaccatggtgaacgggcagaaccaagactcaaatccagctttcctgccgccccatctagctctcagccaccacatctggatgccacgtcagtctgtctcatgagcactaacaatggtgggctgaggttgagggggatctccggagccccttcaccatctcctaggtcttgcctatcctgccttcctgcttaacgctcccaccaccatcacataacctggatatgttgtggccagacaattattgacgtatgtttgttaagtgttctgatctcctctcagaggaaaaccctgtgtttgactcttctattattcaggaagtaataaaagttatagtcataatatataagaaaaaagaatgattcactgctgagctactgagctacagggagcaatccaaggtttagaacagacaattggctaagatcagtcacgatgatgtcacagcggaatatacaaatacctcagtgggctgatccaagagaacatcacaattaaatcagcttactgctgagcactcttccacatctgtgaagagctgctctccattctgacagccacgtttaaggaggtggtggaggcggcagtctatccaacaccctccacacaggaagaaaggattgcaaagtgctactgagtaaatgaacatcattcacatggaaatgcactggacgagatcatacatgttaagacagttaacagacaggttaggaacaatgttttcttttcagaatggaattacagtatgacattgggcatgggaaactgatgagagccatcagagatgatattcaaaatgtttaacaaaatatcgacagcataagccatcaatggccaatgcagccttatcaatgcagagtggttgaacatggtgctggtgaaactcacttggctagaatagcagagatgccattaacctctctgacccttagtttagtttcttcattgcagagtgaggcaccaccacttatttcctagtgttgttacaaaggttaagaaaaaaatctgtgccacaattcctggtacatatcagatccccaataataagagcaaacatttatgtgtctttattatatataaggtattagcaaatgctaatttacttaacccttatagcagccctagtattcaactattttttttttttttttgagacaggatctcactctgtcaccctggctggagtgcagtggcacaatcacagctcactgcagcctccacctcccgggctcaagtggtcctcctgtctcagcttcctaagtagctggtgctacagatgtataccaccatgcccagttaatttttaaatttttcgtagagacagggtctcactatgccacccaggctggtcaagaactcctgggctcaagcaattattattagcattttcccgttggagaaattgatatagagagcggttaagcaactttctcaatgtcacactgctggtgaatggcaagacagggtcttaggacccaggtagaatgaatcccaggggctccttccccaccctatgctaccctcaggaaatgtcggggcccatccctcccactttatgctccagagagccagtgtccctgcaaacctaacatctcattgcctcaaagtcccagctaaagcctagtggagaggacatcactctttggtccttcagtgccctagcccttctttctaggtttactcaatttccatttgcatgaagacagacaagaaaaacagtccaattaatacgaagcgtaagaccacaagatgagaaggcttttgctttgctttttattttgtatcagctgaagtgctgtgagtattcgggatgaaaaattatttatcccagttaatgaatctcatgataataaaaatgcctgacagctctgagattagtgagtagcccttatctggggaccacttagtgaagcaaatcctgcgtgaacaaaggacaaatgggatttgggagaatgaggaggaagggaggctaagaacgaacatgtgttttgcagctatctcatgccaggcatcacacaaggtactcaaccctcattctttcttttaattcttttgagaactcagtctttatacaaacacttatggcagtgccaggtaccataataagtgttggggttacaaaattaaataaatcatggcccctgtccttttaagtagaatggatacagaaaataagtagagaggctatttatgttcactgcaatattagtttgatatgagtatacacaggcagtggaactatgctatacaggccaagatgatacctaccatgtcaatagttcctgcataaggactatttcctgcatacgcagctgtgttctgggctgggtgatatacccctgcacctccccatggcccctcaggcccttcacggaggttagttggctagaggagtgagattctcttaggagtttacacttggaagcagaaagagaatcaggcaattggttgtgggaacagaaactgagaagatgatctaaaaggagtgatgaagtacagtagaatggggctgggtgggaccatgtgtaagcggaagctatgaatacacagaagatacaaggcacagaaaacgctgagcagaatgtgaggaagctaggtcgtagcaggaaatgaatagaagcagaggatactctaaccaacgtatgccccacaatttaatcctttccctaatgttagatcattctcattttttcctgtattacaaggaatcctatgatgaatatcattgcacatcagtatttgtagcatttctgatgagtttctctaatatattcttggattaaatggtatgcacattttaatgctcttgagacaagtatgcatctttatttccaggaagatagcactaatttcccacgcccttcagtattatatgagtgagtctactttaacacattgtctcacactgagtccttgtcacttaaacagggaacggtagtaactacctttttaattgtttaattatttaatttttaattgtttgcatatttttcatatgttatgggacatttgtatttcctcttttgtgactccagcttgtttatgtctttttgtccatttgcctataaggccatttataatgctcttattgatgtatgagaaatcaataaaatttatataacaagaccaatactcactgacatatttagcaaacacttacccataattagttgttttccttttcatttttatttgaggcacggaagttttatatttttcaatatattgatattttcctttgtaatttgtttcaaagggtttctttttgcggaaaaaaatctttttctgttttctagatcaggaaaatacttggctctgtttcttttcctacttttggaaaatgtttttgcttttatatttaacttttctgttcacttacaatttattttggtgtatttgaacctttatgaaggaagattttgtactaaattaaaaaagaggatggtgtgatcctgtttcagaaaaatctaatctgtgttaatgtttgttccccagcagaatcaaccatggattacttccaatgaccagtgcaatgacttgagcacacacagacccatttaaatacataatgagggagaacatatgatcaagggcggagatgccatcatttgtgctctgtatacaacctacttttattaaatggaaattatggtcactgaataactcaatctacctaaactcttacaaggaatcagaagccctcagttcttaagctgggtctgtactgatttacaatgggacacaaacacactgtacctccttaaccctaacacccactttccaattgcctgtctttcaaaactatctaattagatttctttaaaaagaacatttttgtcatttgtgaggaatttttcttttcttttttagtttgctcttactgaaaaaccaaggcaacttcaactttatcttttcatagggtccctttccaagtgttatgactgaatggaagctgtgtggttggtgaagtacttcggctatatttccaaaaatatgcaattgttaggggctgcaatgcaacagccagttccagagactagcaaaaggcagggggatactctcaagagtgactacactcgagactttccatttcagcaacttcaggaattggggaaaactcactaattcaacactgagttctctgaaagtgatggtgtattagtttgctaggtctaccataacaaagtacagcaaattgggtggcttaaacaacagacatttgttttctcagaactctggaggccagatattcaagatggcagcactggggagaaaatctagcttctggtggtttgcaggcaatctttgacatttctttgcttgcagaaacatgaccacaatatctgtcttactcttcacatggcattctctgtaaagccacactatttgcttagattgtttgaagaaggcactttcagatgtgttccagaggctgggcaccttgatctggatcaaacgctgccaattgttggttgaaggtgagtgtagaaatgtatctacttccaaagccaaaatattactgtattagtccgttttcatgctgctgataaagacatacctgagactgggtaatttatacaggaaaaagggtttaacggacttacagttccacgtggctgggaggcctcacaatcatggtggaaggaaaggaggagcaagtcacatcttatgtggatagcagcaggcaaagagagagcttgtgcaggaaaactccaccttataaagccatcagatcttgtgacatttattcactatcacgagaacagcacgggaaggacctgcacccatgattcagttacctcccacctggtccctcccacaacatgtgggaattcaagatgagatttgggtggggacacagccaaaccatatcaattactaagtacacagaaaaatttataagtcttggtccatgtacctcatcaacttcttctagcaagaagcagctggctgacttgcaatgaaatctccttagagttttatctttaaatcattgatctcaatggatatcttatacctgaaaatttgctgttttactaagggtgaagtaaattaaattccacaagagttagaaaataatttaatcagctggcaaaagctaaggatgaaagcaagttaatacaaatttcaattttcaaacaagattcaatacatgtatataatttatttggctagattcaatacatgtatataatttatttggctattacagggagagaaaacataattactaggtcttattaaaagtatgtctttcttcttttccctgtcatcctttcttccctttcttctttcatttttaaattcccttcccctcttcctcattccttcctcctttcttttcttcttccctcccttgatgttttccatttactcagaaaacatttagggagcaattaccacaagttagagtatacaccatatgccaaggatgcacccaaaatgtacaggtgataaagcagcagttcctgccctcagcaagttcatagcctaatagaatctgagttatgtaagggtgaaggccctacagtacattctctataatattgtagtaagaggaataatctcagatctcatgcatgcattccatgatttttctctttacttttgccactgtttttctacctgatattaatcttaatactataatcttatactactccttcaagcagctccgtgtgttttctataggcccaccaattattgccatgttctaataaggttttaaagaaaatatgtgaccctttagaacatcaccccacttccatgcctgtcttccatcctctgtataaagagcagagggtgtgaagaatggactagaagggttcctgggtggctcattgttgtgatctgtttgcctgctttggcatgctttgattataataaatatcttctctgaggggagcattttgaggaaagtgattgtaaaagaagatggaaatccatctataaagatggtaaccacaggaactaatttgaagaggtttttcatatttattaatagcatagaattgtccttccagaaagcataaagttctaaatttgaacaaagtccacagtctgaaccaaaattctgtacctttcagaatggatcataaaagaaaaaaagtctacagcacaaaaatagtttcctcctataacctcaaacaaatgtgagggcgatctgcccttgcaattttcattacttcaagataacaacaaggaaactatgattcagttagttctttcctttcacacattcagagttactctgcaattgctgagtgctagtgtatctatcctcaagtggcatttctgtttgagaactgtatttttcattatttagagttttctgtaatttttactggtaatattaatatttaacaatatcatacccccagaggtatctttgtgcaactttagaatatacgtactttgtttctttttatgactctaaccttttattctttcattcctctagtactctgaatataagagagtctacacgctttttagtgaggattttttgatccctgcttcataagtgtcactcattgtaggctttcctttgacaacaaaaattcctgctctctttacgttgactctaattacttcaccagaaaaggtaaacctgtcattgtgtaagaaaaggaattaagttaatgtaactgtttcttaaggtcttattattattttatttttatttttttgagacagagtcttgctgtgtggcccaggctggagtgcagtggcacaatctcggctcactgcaacctctgcctcctgggttcaagcgattctcctgcctcagcctcccgagtagctggaattataggcatgcaccaccacgcctggctaatttttctatttttagtagagatggggtttcaccatgttggccaggctggtcttgaactcccgacctcaggcgatccacccacctcagcctcccaaagtgctgggatgacaggcatgagccactgtgcctggctcttaagggcttaatgtgaatgttgcatacacatgtaatttctgattcatttgtggacctttgcgtaaaaataaaattttcttagaaattcatagaaaaacatggcagttcttaccatgcatcacagtcaatttcctgagggttctgttctttggagtctggggaggggaggtgctgtggtttggatgtgtttttttcccaccaaagcccatggtgaaattcaatcctcagtgtggcagtgtggggagatagggcctagtgagaggtgtctgggtcatagaggtatatccctcatgaatagattaatgccttcctgctagggtgagtgagttctagctctcaggggaatgggttagttcccttgaaagtgagaatgggttgttaaaaggagtctggcttccttggttttgctcttttgcttcctttctcagcctgtgatctctgcacactttggctctctgtcactttccaccatcagtagaagcagcatgaggccctcaccagacacagctgcctaagcttggggtttccaggatcatgagccaaataaacctcttttctttataaactacccgtctcaggtagtctgttctagcaacataaaacagactaagacagaggtcttcaataccaaaagatagtctacttgatgtgtgaagggaggctttggtttgcctgctataaaataattttagttgatgaacccgaagttccctgaaggtttagtttctggtgactttcattctgcaattcttgcacaaatggaaaaaaatccatcctagttgaatggagtacctacactacaaatgtagagtgaatctgtagaaaccactttttagataactgataaaccagctagttgctaatcacttcattgctgcttcccaccaccagtcaatgtttaaaaaaaataaagaattctccacctaactttgacaactggggaaaggtaggactttgtttcagcatcaaaaggaagtagagccacgtagaattatcatttagttccctcagtcatagccatttctcatttttcatcttccctacttttctcagggccatttattgtcctctaatgcctcccttctcttcattcttttttgctcttaatatctctggagggacaccaaagaagtgatttctttctgcattcattaaaaataggtttatgttttgccttcctgttcaattcccacttgggctgtaagcaagtaactaaagcaagggaagggttgggcatgtgggcgccagacttagatgcctctatttatgcctagattcttcctatttctcccattcttccctcaggataggagaaaaaggaggtggcagaggtctgattaaagcagggatgagcaactgagccaccactgcagtgctgagattgggtgaagcccccagcttcacagaaaggcctgcaacatcattgcaagattaaatgtgccaatattcttgctaagttactactttttgcacattaccagagaatagacttcccgggcctaaaggaatggcaatgttttcattgtcatttatttctctgttcagtaaggtagatagtacaggttttaagagtcttcttttttttcctcatgagactctatttcttttcccctctattttcttctatgctaaatggctgtatctactcttgaaaatacattctaactctaagtgtcctttgtggatttgactttaggaaaccaaagtagcttcccccaagccaccctctgtctctcttttttgtttttttgcccattggtcgattttaccttctttttgtataccatcaacccaaagacacagcatactagggacgtaagtgtggaactgataccgttagttttatttcggggtgatgcaatccctctgctaattcttagatggtcttatggtgtcagaagaaaatttccttctgtcagaaagccttaagtacgtttggaaaataattcagaatcaaggctgtcttcttctgttttttaatcaattcactaaatagtcttcatcatacagagaaattattccttctactccactccaaactaagacattattttgaaatagattatcaaataatagtgcagactaatttccatagctcaatgagtagaaggcaaagtacattatttgctaatgcaaatgctgagccttctccaaaaaatttaatattcaaagtccagacgggataaggagacaaaaaaagattgcttaacaattttccaaaccaaagtgacctataacacacaaaatatggttctattatgtgcaactgatattttctttgttgagaataatgagctacagcagaatggcataatgtagaactccacagctgataagctttctgcataagaacaggaagaggacatttcttaaagagttctgtgttcattgcttaccttgaggaggcagtgaatggaattactgttaatagtaacaatatgaagctaattggtttaaaatgaagcagcaggaaatgctgatgatgagactggggtatatgaaggaagaatgaaaaatctatactccggctacacaaaaatgatgcttaaaatgtaacttaatcttgatattttattcataaatgacaaatctgctcactacactgattccctaggtgactcatcaaatcccatctctaggtttatgaatctcaaaattttgtagctagttctgactgttttcactggcaaaatttgtcaaaatcaacttcttaagaatttggaaattaacccaaagtttgcaataatacaaaaagcatttacttttttaaaaaatggctgaatcccagtaaaaacagtgagctttgtggcattttaacttgcacttataaccatctgcctctccacagcttcacagtatccttgaaaatcaacagctttgcagccatgatagctatgaaaactagcagcctagcagccactggaggggacaggtcaggtatgaagctcccccaaaattcccattcccagagaatggtcactatttaacctgtctgaaagttccttaagaaagctccattcttatagtttgtctttatttgccttgacttaaagctcatttggtgggaatagccctgaccccagctaattttttgaaataatcagcaaaaaagctttcagaatagtgacactaattgaaactaaaaaaagaatgaccaaaaatttcacaggaaagactggataatgagatgtgtttaggggggtttgaaaagctctgatagatttctggtaatctagaaggccatgcacatatacagggctgtgcacgttcccagaaaagacctgagaagcccctattctctcatctctagttgactttgaggttctgtgcaagctggatgtgaaggctaaggcagagttgtaaactgcctggtagagcattgaagacacaccttaatacacacacatagtcctttggcagtggctgggagacttactggctcaaggcatttaaggaaatctgttcaatcattaggtaattggtaagctaactgagcacagacttctgtggatgcagtgagagataacacagaatttacagaattagtccaggaaagtcactaaacaaacagcagctgcaataataaagggcatcaacaacagaccttagagaggagggaggaatatgaattccagaattgccacactatattccttaaaatgtatagcattcaacaagaagttaggagacatgtaaataaaaagcaaagtatggcccatacacaggaaaaaaggaagtcaatagaaactgtccatggatgttggacttcctagacgaagactttaaaccatctatcataaatatgttcaagttactataggagacatgtctaaagaattaagggaaagtatgaaaataacgttttggcaaatagagaatgttaacaaaggatataaatgatttaaacgtacaaaatcggaattgtggagctgagcagtgtaatagctgtgataaaaatatagtggggctcaacagaagaaagaataagcaaacttgaataaaggccaattgagatgaataaatagaagaacagaggaaaaaagaatgaagaaaaacagtatcaaagacctgtgcagtgccatcaaatgtaacaacacatgcatagtgagagtcccagacagataagagaaaaaaaggggatgaagaatatttgaagaaataacagctgggaactctccaaacttgatgaaaactattaatccacacatgcaagaagcccagtgaactccaagtagggcaaactcaaagagatccttactttactacattacagccaaactttctacagctaaagacaaaaagagaatcttgagaatgccaagagaaaagtgactcattgagttcaagggatcctaaataacattaacagccagcttctcaacaaaaaccatgaaatccagaagaaaaaggaatgacctattcaaagtgccaagaattttacatccagcaaaaccaccagttaaaaacaaaggagaaattaagacatcctcagataaactgagggaatcttatcactagcagatcttgctccacagcagatagtaaggggaaaccttccgggggaaatgaaaggatgctggacagtaactcaaatccacatgaaaaaataaagagtaccagtacaagtaactgcatttgtaaatataaaagacaatataaacacatttttgcttgtaactctttctaatttaaaagacgaatgcaaagcaatgatgacaagctgtttgataggcttataatttataaatatatacttttttaattgaaatttttttcttttatcatccagcccaaaatgtcataaagatataatttctatgacaataataacacaaaggaggagaaagggaatgaagctatattgaagcagttttacatataattgacggtaaattggtattaatccaaactagattattttaagttaagatgttaattgtaatctctaaggcaaccactaagaaaataaagatatagtaagagaaacaagaaaattaaaatagtatactagaaaatttatatgttaaaaagaagaaaacctcaagtcaataactaaaacacacctcaaggcactggaaaaagaagagcaaattaaacctaaagcaagaagaagaaaggaaataataaaaataagagtagaaataaataatttagagaacagtaaaacaatagaggaaatcaacaaaaccaaaagtgtattctttgaaaagatcaagaaagttaaattaacaaatctttacctagactgaccaagaaaaaaaaaagactcgaatttcaaattattaaaattaggactgtaagaggggatattggctgtgcagaaataaaacaaaagattataagggaatgccatgaacaactgtatgccaacaaattaaataatcttggtgaactgaacaaatacctaaaaaaccacaaactgttgaaaccaactcaagaaaaattcaaaaatcttaatataacaaggatagagattggattcgtaattaaaaaaaaaaaacttcccacaaagagaagtctaggccaaaatggccttattaatgaattctaccaaatacttaaagaattaacaccaatttcataagttctaccaaaaaatagaaagggaaggaatacttctgaactgattctatgaggccagtatacactgacaccataatgagacaatgacatcacaagaaaataaaattaaagatcaatatatcttatgcatattgatgcaacaattctctagaaaatatcagcaatctgaatccagaaacatattaaaagaattataaccatgatcaagtgggatgcatcctgggaatgcaagatgtatttaacatacaaacataaatcataaatcaatgcaatactttaaattaatatataaaatgacaaaaattacgttatgagcacaatagatgcaggaatctcctttaacacagcccaatactcttttatgataaaaatcattcaacaaaccaggaaaaaaacacagaacttcctcaatctgataaagcccagccatatatagaacccatacggctaaaataatacttaatggcgaaagaccagatgtttttccctttcccaagacaaagctagctactctggtcacttctattcaatatagtattgggggtgctagccaggctaattaggcaagaaaaagaaatcaatgcatctagcttgaaaaggaagaagtgaaactatctctatttgcagattacgtgatcgttatatagaaaaccctaatacacacacacacacacacacacacacacacaagttcagcgaggtttcctgatacaagatcaatacacaagcattagttgtatttctgtgtattgacaatgaacaatttggaagtgaaattaagacaaaaattccttatagaatagtatcaaaaagaaaatgcctagtaatagatttaaaaaagaaatgcaatactttcacactgaaaactaaaatatcattgcaagaagttaaagaaaaactaaataaatggaaagaaaactcatgttcatgtatcagaagactgaatacgtgaagatggtaatactcccccaaattgatctacagattcaatccaatacctattagtatctcagctgccttatttgtagaaattaatgagctgatcctaaaattcacatggaaatgcaaaggacccaagatagccacaaaaatcttgagtaagaagaacaaagatgaagaactcatacttcctgatttcaaaacctgatacaaagctacagttatcaagacagtataaagcataagaacagtattggtataaggagagacatataaatcaatgaaaataatttatattttcagtagttcagtagcaggcttttacagggttaactgattttcagtaagagtgccaaggtaatccaatggaggggaaacaggctcttcaacaaaagttctggacaactgaatatccacattcaaaggaatgaagttgtaccagctcacatgattcacaaaaattaactcaaaatgaatcataggcctaaatgaaaatgctaacactataaaactcagaagaaaacatagaagaaaatcttcagaatcttggatcaggcatgacttcttagcaatgacactgaaagcacaagtgacacaagaaaaaatatataatggacatcatcaaaattaaaaactttttgtgattcaaatgatattatgaagaaagtaaaaatacaatccacaaaaatggagaaaatatttgtaaatcaaatatctgataagggttttctattccaggtatataattaattgttatagctcaacaataaaagataagtgacccaattttaaaatgggcaaaagatttgaatagacatttctccaaaaaatatatgcaaataaccaataaacacatgaaaagttacacagcctcactagtcatcagggaaatgcaaataaaaaccacaatgaaataccacttcattcctactaagatggctaaaataaaaaagaccataacaaatgctgacaaaggtgtggagaaattgtaactctcatatgttactggtgggattataaaatggtgaagccactttggaaaacagttcagcagttcctcagaaagttaaatttagagttaccatatgatccagcaattccactcctaggtatacacccaagagaattgaaaacatatgtggatacaaaatttgtacataaatgtttctagcagcattattaaaaatagccccaaagtctaaacaattcaaatgtccatgaaatgatgaatggatacataactgtggtgtatctatatgatgggataaaaatttgtcaataaaatgaagtacttatacatactataatctggtgaaccttgaaaacactctaattgaaaaaaactaatgaaaaaaagaccacatattgtacgattctgtttatatgaaatgtccagtgtaggggctggggaaagtgggggcggggtagtgactgctcatggttatggggtgtcttttggggatggtgagaatgttctaaagttaagacagttgtgatggtcacacaactctgtgagtacacgaaaaccactgaattgtacatattaaaggagcaaatttaatggtgtgtgaattatatctcaataaaaaataatgtggtgtaaatctggccactcatggttttcacctcccttttttttttctcccctattgggacaattcataagttaccatgctgctggcagctctggcagaaaatgatggtgacagaaaatgacatttcaggaatggcttttaaggcacgaggagcaatagcctgaggataatcagagttgttaggctactctcctgtcctggaaagtgaaatcaacctgattctgtccatcatggacactggtgacttgagttgttgacgaatgttctgtaaagtttaatatcccctgctacactttaaatacagagcccaatccaccatatctttcaaactcaggctatttcaaacataactgaagtagaacttcaaattagagaaacttgaggccttctgatcactggccagaggggaaaaattgttttttatgacctgaaaatgtatttagtatgaaaagaaaatgacttcttaagatgagaataagaaaggggggaaataaccaaatttgaagttctaggtaaatacaataaggcaactgaatagacactcctttctcctgttttctattaggattataattggggattctatctccatccaatagtgtttctgtacacttcaaaggtaggctaactatttaaaccagagacagaacactctgtattactctttttatattgatgtcctgttacaaccatgttttgtttcgttttgtactagagaaaaaagaggactcaaacttatgttgtcaaatatttcctagacacttttgtgtgtgacaggaaggaaacttgttaatactgctgtctcaggtaatactgcttttttagttaatactgcccttcatccctgtgtttaccccctcgagcttatcctccctgttatctgattggtttgtcaacattctgaaccaaaactctattttttaatggaaagcctaaggaggcactttttcctgaaagagattggtgtccctgattatacttactcagagccttctctggattactgggaaggaacacacctgtgcatttgatcttaacaagctctaaatctatattgtgttgctcaggggttgcctgacagagctcagtcccatggtggaagaaacctaccaacctcggtcttctcagctttcaaaggcgacacctgcctctggcctctctctgcattctccccattatgatgtggttctccagaccagggaagagaccagggggaaacacaaactaacacaacaagctccttctggttctgtgtgtagctctttgcaatttccctgctctggtaggcagcactttccaatcagccctgcagctccacctctgagaattcttcatgaggaacaagctttctttagtcatagtcacttgtataagaagagatgttttccttcatgagttgtttgaaatgcagtacagtcattccttgtgttctgaaaagctcccactaaatgacatcatttaattccaggatgctcagaatacttaataatacctttggttttgtctttgcaaaacaagttttgtgtttgtggaagggaacaaatctgaggagtggcaagcggcgaagaccaaaagcttatctgtgtggaattgctgctgtagacaagaacaatataatcctccctgttctgtacctactaaatcttacaaagggttagaaaaatagtatttcatctgtctttgggtttttgataataccaaataacatcaaatggaagcagtctcatggtttcttcattgctaaactaattgttattacatacttgttcctgtgtgatgttaatatatattcctggaaccagaaaggtctacatggtcaaataaatttgaaacttgcattaaataagaataaattgatttttttctccttcagggtttcacagaatctttaataccaatgtgcttttttgaacctcttaatgcagctctggtaggctgactttctgtgtgtgtgtgattattttatttactgccaatctccttaaagttagtttttatttaaaaattatttgtataaacacctgaactatttgactttttaaaaattccattctattgtgttaatagcacttaacatgcgatctacctctgtaaaccatttttaagtgtacattattgttgactgtaaggacaatgtggcacagtagacctctagagcatatttatcttggttgactgaaactttatggctgttgattagtaactccccatttagtaactccccaattagtaactctccctagccctggaaaccacaattgcactctttgattctatgagtttgacaatttcagatgccttacacaagtagcattatgtagtatttgaatttctgcgactaacttacttcacttagcataatgtcctcaaggttcatctgtgttgtcacatattgcagagtttccttctttttaaagactgaatagtattccattgtatgcaactgtgtatgcatacaccacattttctttatccatttgttgatggatatttaggttgtttctatgtcttggctgtagtgaatagtgctgctgtgaatataagagtgctaatacctctttagatcctgatttcaattttggtgggggatacatacccagaagtagattgctggatcatgtggtagacatatgtttgttttttttaagaaacatctatactgcttttcatagcagctataccattttacgttcccaccaacagtgtggagcggtctcaatttctccacattcttgacatttggtgtctttttaaaaaaataatactcatccagacaggtgtgaggtgagctctcatagtgcttttgacttgcatttccctgatgattagtgatgttaagtattttctcatatacctgttgtcatttgcatgtcctctttggagaaatgtctattcaagtccttagcccattaaaaaaaatcatgttactaggtttttttttcttttttactattgagtagtaggaattccttgtataggttggagaataacctcgtatctgatatatggtttgcaaatattttgtcccattcagtaagttgccttttcactcagttgactgtttcttttgttgtgcatgaactttttattttgatgtagtcctacttatttttgtttttgttccctgtgccttttgtgtcatacccatgaaatcatggccaagacgactgtcaagtggtttttcatgtatgttttcttctagcaggtttacagtttcagatctttaaatgtaaaataataatattgaattgatattttgtgtatgccataaggtccagtttcattgctttgtatgtcacgtccagtcttctcaatatcattagttgaagagactatcctttcccattgtgtattcttggcaccgtttgtgatgaccagttgaccatgtatgcatggatttatttctgggctctttattctactccattagcctatatgtctgtttttatgccagtatcatactattttgattactgtggctttgtgatatatattgaaataggacgtgtgaggcctccagcttttttcttctttctcaagattgacttggctaagaattttagcattttgtctatttatgtaaaaaaatgccattggaactttgataggaattgcatttaatctgtagattgctttgagaagtatgaacatttcaataatattagatcttccaatccatgaacatttgatatcttttcatttgtttgtttcttgttttatttctttttactatattttgtagttttcagtctgctttcaacttcttagttgagtttatttctagatattttatttttttggtgctattgtaaatagaatttttttcctaatttcttttttcagatagttcattgttagtgtatagaaatgcaagtaatttttatatattgatttggtatatatcaatatataccaactttactgaattcattttttagttctaacagttttttttttaaatggagtctttagaattttcaaatatataagatcatgtcatctgcaaacaatgtggacaatttcacttcttccctttcaatttgggcaccttttttccttgcctgactgctctggctaggactcccagtattatgttgaatagaagtggcaagagtaggcattcttgccttgactctaatcttagagaaaaagctttcagtttttcatcattgagtatgaggttggctgtgggctaaccacatatcaccttaattataatatgttgaagtaatttctttctgtttctagtttgttgagagtttttatcatcaaaggatgttgaattttgtcaattgatttttcagcatctattgagatgatcatatgatttttatcttttattctgttaatgtggtgctaattggttttcatatgttgagccatccttgaattctacagataaatcccacttggttatggtgtatgatccttttaatgtgcttttagattcagctttctagtattttgttgaagatttctgcatctatgcatatcagggatattggctgcagttttctcttcttttgtactgtctttatctggctttggtatcagcataatgctggtctcataaaataaatttggaagtattcttccctcttcaagtttttggaagagtttgagaaagatcgacattaattcttctttaaatgtttggtagaactcaccagtgaagtaatttggtcctgggattttctttgttaggaggtttttatgatagacagtcttgcctcttgaatgaatatttatatctcaagaagctagtgttctgtgaaagtttgtgaatgaagttttagattcataccctttaacctaatgtaataattaagagaggagactttggacaaaaagtactggattctatttgtgggtctctaccaattaacttcatttacagaattagcatagtaatacttgctacaaatcgagttgtgaaaatttagtgaaatatatgtatactaacaaacaaaaccccaggcacttaggtggccttaaataaatggtagctattattgtgtataaaaaagttagtttagtcaacaccttttccagcaagaagcaagaatttctttcgtttataataataatttaataaaatttcctaaaatgccttctgcatgatgcaagaatgatgaaattatatgcaatgttcagttcgattttagtggttagcacaatttatggtattttattgtttaggaaagggagagtaaagaacatctattgagagtttatttagtactcataccagtcttagggagtaaaaattatctaaccccacttcactgatgagtatgcttcagtaaattgctaaagttcatggaaagcatattctgtggcaatgttagaattcaaacccaggtcccctgactccaaagccaatgctgtctccatactgccataccaccttctttaaaaatgaacaatttggctgggcatggtggctcatgcctgtaatcccagcactttgggaggctgaggtgggcggatcatgaggtcaagaggttgagaccatcctggccaacatgttgaaacctcgtctctactaaaaatacaaaaattagccgggcgtggtggcagttgcctgtaatcccagctactcaggaggctgaggcaggagaatcacttgaacccaggaggtggaggttgcagtgagccgagatcgcaccactgcactccagcctggtgacagagtgagactctgttaaaaaaaaaaagaacaattaattcttgtgtgtacataatagctctctgttaactaaggctattctattcttcacttgtttcaaataaatatctcccctactagatctcaatacagtggtcttaagtcaatttaatcccagtaatgttttatagtcattttctcagaatttctctcatgttcaggtaaggattacataattgaacacaaaattttatcttgtctaagtacttctgacttcacagggaattgtgataaggagtataactcagtggagatgatgtgggatggtaggtggaatgctggccgtggccttagtagtgatcttagtccttcccctgctttaagtccctgtgtgacccagtgagttactctgtatctttaggtcttagttttcttactatttgctctatctacctcatgggagttctgtgaagagtagattaactcacttttccaactctccctatctgtagttgtctcaaagtggagaatgcatactccagggatgagcaggatggttcattcgggtagaggaggatgacatcaaggaacacttataggtgctttaaaatttgttcttttaaaatttacgtttttagcatatgttttataatgtatggacatagcattacatttatgaaaaccataaacacacaaacatatattggagatatgtgctttttttttaattaataggggtaggtgataaaaatgtcgagggcctggtggcctccaggataaagtccaaattctttagtatggcatttatgtcctctggggaccctccagcttcatttcctcccccattgcttctccttctacttaatgaactgaacatactagtatgttttgtagcttcactgtctttgcttatactactctttttgccagagactcctgaaacctctctcagcctcccaccttccacttgaaagactaatttctcaagactcagcaaaggagttatctcctgaataagccctttcctgaacctctcaggtatgccagatcactccttccttgggcttccactgtactgtacacatgccacctataagctgtgtggaagtgtgcttgtttgatttcatttactagtctgtagatctctgtattactctacactgctataaagatactatctgaaactgggcaatttatgaagaaaagaggtttaattgactcaaagttccaaatggctggggaggcctcaggaaatgtacaatcacagtggaaggtgaagcagaagcaaggcacatcttacatggcagcaggagagagagagagagagagtgcaggggaaactggcaattttaaaccatcagatcttgtgagaactccctcacgatcactagagcagcatgggggaaactgcccccatgatccaatcacctcttaccaggttcttcccttgacatgtggggattacaattcgagatgatatttgggtggggacacagagccaaaccatattaagggcaactgccatggcttcttaaatcttttttgttttagaacctaaaatggtccctggtatgtatttcataaatattgattagctatgcaaatagcaaataagctctgagagtactatagcatgttaaaatctccaggcaaatgttaatagttattattattaacctacgttaaattctcataggtttcagtggaatatctttattaaaaatcttaatcaagtgacgtgagcaaaacaatcctaattgacacctgtagacactggttttcaaccccgggagctttcaaaaatatcagtgcccaggctctgctcataggggttttgattcaattggtatgggatatgggtcaggcatctgtggtttttaaaagctccccagatgattttcatgtgcaggcagggctgagaaccattgtttcaaatgtcatggataggaaaagaaaggtgcttgggaaaacctaaggcagagtgctcttcctgaaaatgcaactgcagttgtgaaagcttctgtctttgtaaggttaagatgtgtccttgggggaagacacacacacacaaattgcagttatttattgagaccagactactaagtcacttcgatgaaaacttgagagcttaagactcgccagcatgggctaagaatagatcacattgcagaaaccagaacagtttcttggaaggaatggctgaagacattgacaaaggctgagcagaggatgaaattgggaagtcacccatcaactatgggggttgggcaacgtgaaaatgtgcttaccatttgcaatgaaatggaaaaggccttggtgagaaggcagtggagattaatgataataagtcatgttgagttttaacaagataacatacaggataacaaaaaggcaaaagtttattaagtcagatcctgattttgcaactaacaccttttttcctccctctctttttcaccttgagactgttacagatagctgagtaaggtgccaaattagactcgaactgcatctcagggtgaaaactgtgagtgagcatcagctaatgttatcctaaagtgtatggaattacaagtttctatgaagatgtttttgagaaaccttattaggattagtgcgtatgttgtcaacattggattttctagagaatcagagtgaatatagctggtacataagcattgttaatttgcatcatggatatcaaagccttcttgatagaaattacctatttgcactgcatactaatttgggcattgctgctctggaattgataaaagtttagcctataaattggctgaagttccttttgtgctaagaaagaatttgctaagcagatgcataatgtgccattggccattgcggttaatttttttaagagaataaatatttccaagcacttaagtgccatgtgttacaaatcacaccactcagggactagttgaggcttcttttttccttgaagtcgggcaggcaggacctctagtggcaatggctagttagcagttagatttagtgctaatgttttagaaagtacaaactgcacttcttttaaattctggttgatagacttcaggttgatattccccccaataatttaagctttgcacattctaattccctggtgttcaaattgtcacaagttcttgctgtgtacatatttcttggaggaacacttttaaagaaaatggcttcaaagattcccaggcaaagtggacacctggacctgtaaaaggaacgctgcccctaagatgtggaaagaggccaacaaatgttttaattggttcttgacttcagtactactgactttttctcacatggcacactgatgcccctaaatacccatttgtcctctgaatttggtctttcaaacaagggtgagagatgattttgagagtgagaagagagctgttctactggggaaaagggcacagggagggagttttgacaggtatttgtggtggccacagccagtgataaagcaaacactgcagctgagttcaggccccactgtgaacgggcctgcagttacatctcactcctctcttctgtcagttgggtcccatggggtccactggcaggacccactccaggcaggtgtccctgagcctctcctaaccacctctttctcctccatgtctttgctctctatgtggcgggggcaagaggggagcaaagggcagtagtggcttgtgtgcaggcagccagatgggagcctgaccttgggtcacaggcacacgaaaggcacagcctactgatgcactatttggcctgtgctgtgaggaggggggtgcagagggagagaggaagagagaagaaaactcctttcttctatctctaacctaggcatctagtgcatttcagtcctgaattctttcagggctcagctgaaactgttacttcagaacccttccctgatcaaggtcaggccttccacgggctttttgtagcttcctgtgcttgtctctaccagcacttattattattaccatgaattacttgtgtaaatatttattatctgtgtcagtggatgataagcttcatgagagcagagattggtgtctgtactatttatttttgtattcttatgcaggaggcctgagacaaagtgctaaataaatatttgttgaatgagtgagtgaggcaacaaatgaatcaatgagatacacaagaacatatgtataagaatgttctttggaaataacctagagtctagcaagagggaaacaaatcatggagatccatttgtttgaatatgtcattgaaaggcatatctcaaaaaatatttactaacattgaaaaattctcagaatgtaaggttaagagaaaaaagtagggacacaaaaattgacatatggtatgattcctttttctttttttgacataaagaaaatacagagaattcttactattcatggtagttatattctataaggtcactacaaacactgaattgcaaatactgaatgattgcacctaggggaaatacagagttaggctcctgcaagcctctggtcacaatatttttgtcaactgatcaatttataaccttgttttatatgtgtttctgtttaaagacaccttcttttaatatatattattgattacttaacattgaaatcatgaccaacagcactgtcacttatgcctgaaagaagcttatctaataacacacgtattttctcaagacacatcacagtcttgctatgctttggacaccagacagtgcttcagctccatgctgcaggcgattttaaaccacaagaccactaacaaaaagcatataaatatgaaaaatatagcactaagtagatcttagaaaagatacttgtttacagtatgagagctgaaacaagaaggagaggcatcaccttgtttgacttcgcctgggcatgtatgcatcagccaactcaacctttttgctgctctgagcatgtgcatgcccacaaataactgaaatgcactgtgagtattgatttgcggttacaattcaattttagcaagtaggggaatttgcaaatacaaaatctgtgactaatgaagattgactgtatgtccttaaaacaaaaaaaatctcagggcaaatctgcccctcgtggtagcgggactatggtgacataaacatttaaagatgtatccttttctttaattcctcaaatttctaaaattaacttgtattattgtataagtaggaaaataaatattatttttcttttattaggaaatggcaaaatgtgatgggcagaatatatatagagaaagggtagcaaaaatttctttggccagctgtggcacagtaagtttaaacgtaaacagccaaaactgtcagtagagtagtttcaaaaacatattgagccataactttgaaatatattttgagccgggcacagtggctcacgcctgtaatcccagaactttgggaggctgaggcgggtagattgcaaggtcaagagtttgagactagcctggccaacatggtgaaacctcacctctatcaaaaatacaaaaattagccgggcatggtggtatgtgcctgtaatcccagctactcggaaggctgagacaggagaatcacttgaacccaggaggcagaggttgcagtgagctgagatcgcgccactgtactccagcctgggtgacagagtgagaccctgtcttggtgggaggtgggggagcggggggagggggaagaaaaaaagaaagatattttgaattctctcttatatgacttttgtgaatggccaaagtatcattctgtagtcaggaacaggctgactttttgagccagggcttcaagctgaacaggagaaagagacataagcatgaacaagacctatctctgcaagcagaggtcagccacttgacaaaggcagtgcaaaggggatggctttctccggaaatccctcgcttcagctactcatcctccacctcctgccaagtctaggttaggttcccctcagcagaatgtccttctctgttctagcactccccacactgtgttgtcattacctgtatatgtctgtgttcccaactagactttaagctctatgagggcaagggctgaatgtagcttgctcactattgaattacattgcctgacacattgctttgcacgcagtgagggtgaagtaaatatttgttcaatatataacggaatgattatgcatcaaacaccccaactgatagcgactcctgtgagaatcgtcctctttaaatataagtcggtgtcagaaacaacgccaaacctcaaaaaagaatattgaagagttcaaatgagaaaattcaaacaccccaacagacagtgcctcctgtcagaatcgtcctctttaaatacgaagctcagtgtcggaaacaacaccaaatacaagaatagtgaggagttcaaatgagaaaatttcagtcttaaaaaatagacaagatttcatatactcaggcaaaaagagatagaaataagaatctgcctacgtgtgaaaggcaaatacaattcctgtttcctttatcttcttacgattgtacaccctgttcaaccatctttgggcttgtgattactgggtagtacactgctatttcttgaagtgtccataaacacagatagcagagctcaattcctgaaatgtgctcctgtttgataaggtggattggactggatcttgttcagcctttaatctacttccttaagcatctgaggatgttccaaactcaaggctatttcagtacctttgtatttgcaatgtatgatgctttaaaatgataactgtattaactttctatggcctttataacaaattgctgcaaacctaatggcttaaaacattgtaaatttattatcttatagttctatttatcagatatttgcccagatcttactggacaaagattaaggtgttggcagggtacattctcttctggaggctctaggagagagtccatttccttgcatgtttcatctgtagaaggggggctgctttcattgtcttgtgcccaccttcctccatcttcaagaccatcaggctgagttcttcccatgctaccatctctctggttccctcttttcattcccccttccactttcaaagacctttgtgtgattaagcccagcaaaataatccagaataaaaaatcttattttaaggccaaccgtttggcaaccttaattccatctgcaactttaacccacctttgccgtctaccctaatatattcacaaattctggggagtgggatgtagacatctttgggagttgatatagtttggatgtttgactactccaaatctcatgttgaaatgtaatctccagcgttgcaggtaggacctcctgggaggtgttgggttattggggtggatccctcgtgaatggcttagcgccatccccttggtgatgaatgagttctcagtctattagttcacacaaatgggggttgtttaaaagagcctgggctgggcacggtggctcatgcctgtaattccagcactctgggaggccgaggcggttggaacaactgaggtcaggaatttgagaccagcctggccaacatggtgaaactccatctctactacaaatacaaaaactagctgggtgtgggggcacgtgcctgtaatcccagctactggggaggctgaggcaggagaatcgcttgaacccgggaggcagaggttgcagtgagctgagatcacaccattgcactccagcctgggtgacaagagcgaaactccacctcacaaaaaaaaaaaaaaaaaaagcctagcatctctcttgccacatgacacgctggctccttttcaccttctgccatgattgaaagcttcctgaggccctcaccagaagcagatgctggcgccatgcttcctgtatagctttagaaccataagccaaaataaatctcttttcttaataagttactcagcctcaggcattcctttagagcaatgcaaatggaagaacacaggggcaattgctctgcctaccaaaataaatgtacacactattatatatgcatacaaactaggaaatatagtcatttatatttatcaggattcaaaatatcatgtccctatcccaactgtctactgtctgtcccctcactgcccctgaaaaaaagaaaaatatcctaagatgcaaacactcaaaccatggaatgaaatactcttggagataaaaaagtcaaatacttctcttgctatgcggatttaagagaaacatctccacagtatcagttgtgtgggagtttatgtgtaggaatctaactgctcatgagttatctccatgaagtcccgctcacagtatgaatagatgggatcctgttataatctgcttactgtttgccttgcagttgtgcatataaattatgtctaaacccttttcttcttaatcattcttctttcagaaattttgtttatctttctaatttgattagacaaggctctcctatcccccactgcttttttaacagcacagagatagcaggaggattgatcagtgactggagatccacaggggtgataagcttttctgtatatttatgtagaaggcaaaacacagcagaatgagaaatatcagattccagatttcatgtcccatatgtccccatccaaccctgtatcatgcattaaacaaataaaaagtaacagaagggcccagcatgttggcttctgcctataatcccagtactttgggagatcgagatgggcagatcacttgagctcaggagttcgagaccagcctcggcaacatggtgaaaccccatctctacaaaaatacaaaaattaggcgggcgtagtggtgtgcacctgttgccccagctacttgggaggctgaggtagaaggattgcctgagcccggaaggtggagtttgcagtgagctgagattgtgtcaatgcacaccagcctgggcagcagagccagaccctgtctcaacaaacaaacaaaaaaaaaaaaaaaaaaaaaaaaaaaaagggagagagagagaggaaataagtaacagaactagcagcatttcatattccagctaccttttccccatttacaaactcctgagtctgaaacatttgttatatttggttttgagtgaaaccagaatcaataacaaatttgttttgcattcattcctcaatatatttactgcgtgaatatggatcagcagggatggtgtgagactgccacactcaagctgggcgtttgtgcaatccacatcaacacttccaatactctcaagcaaggccaataaatcataaagctcatgtgctactgaattcagcacttcaccatcggcaaaatcaatggagatgcttccagaattttcagttttacagcttcttgaacaaatcttttcccctagtccctctctttgtctgtctggctaaggttgaggcatggacactgggtttgcctcctctccatccaccttctccatccccttttgagaaatgaccacgtggttgaggtcgatcttgtagtcaagccaattgtggtttttccatccctattcccagtgaggcaacttgttgcatgtcattcccctggcaaccaagactggttcagtttgggttgattcgatgctagcagaagttttttggggcttctaggtaaagcgtcctcatccttaagtgaaagtctcaaagagtcatctttccccatcccaaactgattctagaacttctgcaggcatcttattatagatctgatgaagtaactgtcctagaagaatcacagggaggtggagctccttccctatccctgcactcacctctccagttatgcaggaatatatgcattattcttttgtttgtttaatcctgtttgagttggagttttttgttatatttcctcattcattcaacaaataattacaactgtctgctgtgtacaggcactgctttaagcaatgtggattaaaagaacaaaaagggttcctgccttccagtaggaagagtttaaaaagcaaataataaatctaataaatcaggaaactcaacaagaacaagataaagaactagagagtgacaggagctattgggggaaagatgagagcagctgactaattttaaatagggtggtcaggtttcacctcattgaaaaatgtgatttggctcacacttggaatcccagcactttgggaggctgaggcaggaggattgcttgagcctaggagttcaagaccagcctgggaaacatagcgataccttatctctactgaaaaaagcaaaaaagaaagtacaggcatggtggcacacacctgtagtcctagctactcaggaggctgaggcaggaggaccacttgagcccaggagttcgagacggcagtgagctatgattgagccactgcactccagcctgggtgacaaagcaagatcttttctcaaaaaaaaaaaaaaaaaaaaaaaaaaaagtgtgttttgagtagacttttgagtgaatgagcatttgtggatatttggagaagagttttctaggcagaggatactgccaacacaaattccctaagttggaagcttgcttgggaatgtgagaggagaaaggagtggtgggagtgaagtgagggagggcaggggttaacagggagccctgtgggtcttttagcccagtgcagaagcattttgtttggctttgactctgattcaaatggggaaccacagaaggcttttgagtagagtgaaaaagatcactctagctactgtgttgggaaaggattttggagcagtaaaggaaggtgcagggagctgacttagaaggccacagtcccatgccaggctggagatgctgcagcagtggtccagggttgtagtgatgaaggtggtgagcagtggtttggattctggatatgttctgaaggcagagccaacaggatttcctgagtataggggaatgtgggagaaaagcaaggagtcaaggatgactccagctgaaagcaacctaaatcattaactctcaaatttacctgacttgattatcagctatttacaactcatgaatgttacataccatggagaagtccaacccaaacacagggttcacacgcaaaccagtaatttgatattgagggctctacatgttccattaatcacatccccctacttaaaatattttccttggctgccttttaagaataaagttattttccatagtctttgagagttaactcaggtaggaccgaagtgatgaccgttctgtcctctgcagcaacgccattgccctttatccttgttgtgatgtggttttcctgtgtcttctgctgctagatgtgatgacgatatccctcctttgttgatggactcagcatctgtacatgggatattttgactccaattttcctgatgcatcatcctaattgtctggtagttactgactgtcacttaccaaccggtgtgagatattcttcagctcttcatcaggaacagaattacagcctctatctttagaaatgatatatgctgaggattattcatgtttgtaattacaaatctagcagaagtgcaattattaaaaaaaaaacccttggaaaggacattttgttgtataacgcagaacctgctgttagcctcttgtgctggtattacttttgttgctgtaattgccacctgcatttcagttgtaatttaacattatctgtcttctctgtatctttctacctgattgtaattgttaggactcctgccatttattcttaaatactttcttgtctttctgaattactgggctattttctatgattataacctaagaaacagctgcagcaacccttgttgcattgtaaaaacttcagagggctggtttatctctagtttaaaaccagtgaagcaaacagtggggggaccttcggaggtcattcacataaaaccatcattttaagaatgaagaaactgaagcttttgagtgattaactaagttgctcatgatcatttacattcttattgttatgctgtactctggagtagcaagtatggatatatattcagagataggatcttttaagtcctagcactttgcaatttatgctgattaaccaacgacctgccaaacagagctcaagatgggaagggaagcgacactaaatcctttttttgagccagatactgctaggtgctttgtatcatggaccacattgatatgcacaataatctgatgaggtaggaataattatgccaatttctctctctctctctctctctctgtctctcacacacccacacccccccccacacacacacatgctgggatttttgggagattaagcaacaggctcaagagcacacgggtagtaactctcaaatagtaagaactgcttgactttccaccctttctctttctaccaaatcaggaacagaataatggatatcttccaaaggggtgagatatgagcatgagctactttttttttttttttttttttttgagatggagtcttgctctgtcgcccaggctggagtgcagtggcgtgatctcggctcactgcaacctccctctcctgggttcaagggattctcctgcctcagcctcccaagtagctgggactacaggcacgtgccaacacacccagctaattttttgtatttttagtagagtcagggtttcactgtgttagccaggacggtctcgatctcctgacctcgtgatctgcccgccttggcctcccaaagtgctgggattacaggcacgagccaccgcacacggccaggtatgagctacttttaaggcagttggaagcccaaagagcttgggaaaccatgaagactaggcctcacaactgcagttttctcaggcctatgcagctgcctccatccttttgctctgagcaaaactggacctagttaagcaatgttgcccaactgttaaaaaaggaagctcaaaactaggaggtaggatgccagataatttgtttaaatttttgatctttaaaatcttgactctttgagcttgttttgagcctcattggtccaaagtggctcaatctgactgaggaaggggttggaggaggaaggaatgtaaaaatgaaagatcggtgggaaaaggatactgccttaggttgtctgtaggtaaataaaggtttgactctataaaaactctcttcctgaaataatcaagaatgcttcacatcagaagcatcaattaaatggctgccttctttttgttaattctttagtctttagctatttctgctgttgctgcagaggcagagagatggtgaaagaatcaacctcaggaaatagtatggaggtcaagggtcagctaagaggatctactgattttctgatctgcggagctttctgagtgagtctcccttgaattgcaggagggcatccaataggaaacccagtatgcaacaatctcaagagatagcctctagaacactgggattagcattaatccatgaaaatgaggtgctataatgatgatgatgatgagactagaacctatagttacatgcattgtgggaaaggtttgaattgaaaggctgaaggagggagtggttgtcttccaagagggtatgatggtcatgctgaatgaagaatgaagtgaaagaagtcagtgaagatgcattaagaccgtaggtcaggttcaagtagtaactcccaagggttcaaccacataatgacgcattgaaggatgtctattacaatcataagaaacagcaaagtggttgagtatagtggctcatgcctgtaatcccagcactttgggaggccaaggtgggcagatcacttgaggtcaggagttcgagaccagcctggccaacatggtgaaaccccatctctaccaaaaatacaaaaactagcagggcatggtggtgcccgcctgtaatcccagctacttaggaggctgaggcaggagaataacttgaacctgggaggcggatgttgcagtgagttgagattgtgtcactgcactccagcctgggtaacagagtgagactctgtctcaaagaaaagaaagaagaaaagaaacagcagagtgtcccatctgtcctgcgagtcctaaggaaactgattaatggcttcaaaagtttatttctcatcaaaatgaacttgattaattacaaatccagattttttagtcctgccccccaaaagtctgattttaccaatgaaaataacccccaggtaattcctgcaagcagcctcactggaaacatctggggtaggtgaccccaacttctgtcattgtgagtttctgtgtgctacctttcttttttggtttttgtttttaataaacagggtgttgctctcttgcccaagctacggtgcagtggtgcaattatagctcacttcagccttaaactcctgggttcaaggaatcctcctgcattgctgggattacagatgtgagccactgtgtcaggctctctgtgtgttccttctaatagtacttctagaacatctcttatttttttcttttccagctcggagattcttaatttgagtttctggggctcaatgaatagggcccaggggatctacaacccccctgaaattacatgcagaatttcacatatatatgagctatgtgaagagtctcaaaggaatctgtggtttccaaagggtttagaacaattgctccaactgttctatttatctcctttctgccctgacccctggagctggttcacagctttttatcctggccagtcttcctggctttagtggacagtacatttgtctttgactttgaaactttacattaactatgagacatagcgtgaaactttggaaagagaggggatcacttctatgtttctattaaaattaatttcctttggaagaatatgcctgtgacagttttcatagaacactgctgtccccattttaatgagaaacaaaaaaattcatccacgtcaccaatattctattgtgtctcttttctcccagaagccgatctctttgctaaaccatcttcagcacagctccagttgaagtcctttgcttgtctgggtcctttgttgccctcccggtgttctgctgtccacagaatatagccctgactcggtagcctggcatctgtgccctttgcaatctgactacctcctgctgctctcctaattgttccatgttccaagctaactgtgctcctcgccattgcccaagccctgtctgtgccctcttccctctgggcctacaggggatgccctccctctcctctccatctgtcaccgtgtacccttgttcaaggccttcatcccatctctccgtcagccagaaatttcctcttctgtgaacatcaattgtacttggttcatacgggtcttatggcatttgttacatattgatttttgtttgattatgcatgatttgtgtttctcttttttcttattagattccaagacctttcatcacagggcctttgttgatttaactgtgtatctggtcaattgcctgtcacagtacctagcatacaaaaagccctcaataaaatctggtgaatgtatttaaaaacctagatagggctattttaattcagaaaaataaatctgtttgccttttttcctggtaatctaagttgggcagttgcacgagaactgcatataaactgcattcaactcttgataaattagaaaagtcatctgatggcttcattaaaatgtgggctttaaaattatttatgatttcatttttcataacatctttgtgagacttgtagtagtgtagtattccccccgtcttttggatggtgatttcactgaggtgagaggttaaagtgggtcattcaaggccacagagcaggcaggtaacaaaactggcactggaaccttggcctcctggggccacgttagcagagcgtagcattgactgcactaaggatggaatacaaatgtgcttacacattgtcaaatcctgtgggtcaaaaagtttgttttagtgaaagcatcacagataatgaagtatttgaaattttctcttttcaccttttggcatgcaggctcctctctctctgttccctaaataaggacacgtctgtaggtctgatcctcagccctgtctgtctgtgaccttctccagtatccaggaccctcggcgatcaatacctgcctcgtggtttcaatgatcatcactctgctgacttacctaacgtctttgcctatggtgatgacccctgcctgctctccacctcacatctcttgtggtttaccagaagtttccacttagaattctgccatcacttcaaaatccagatatctaaatccaaactcatcatctgctctctgaacaaacttactcctttctcaatctacatttttctaccataattctcctagtcatccaagttcaaaatcattgttatctttaacttcctttatttttttaagagacagcttctcatcccactgcccatgctggagtgaagtggtgcgatcatggctcactatagtttcaaactccggggctcaagtgatcctcctgcctcagcctcccaagtagctaggactacaagcacacatctctgcactcagctattttttttttttttgagacagaatctcactctgttgcccaggctggagtgcagtgctgtgatcttggctcactgcaacctctgcctcctgagttcaaacgattctcctgcctcagcctcctgagtagctgggattagaggtacctgctaccacacacaactaatttttgtatttgtagtagagatggggtttcaccatgttggccaggctggtcttgaactcctgatctcaagtgatccacccaccttggcctcccaaagtgctgggactacaggtgtgagccactgcgctaggcctaatttttaaatttttgtagaaatggggtcttatgttgaccaggctggtcttgaactcctagcttcaagtgatcctcctgtcttggcctcccaaaatgctgaaattacagaaatgagccactatgcctggcctgttattttcagctttttaattggctttgtcttattgatacttccttcaaaatgtttatcatgtccatttgagaatctagagtggtttttttttttttttttttttttttttttgccaaggattacctctttctctagagccctccacctcatgcacattcctttctttctattttcattaccacattgtgatctaggtcttctcttcctcttccttaaatttcactggtgttcattttgttacaggatgaaatccatagtcttcaacctggcatacaaaacctcccacaagctgactccagttgatctttccaactttctagtctaatacttgcctctggtaattttttttccaattcttctgttgactgtcctggaatgcatcttacatggccttgctttggtcctcagtttagttcttttattttccagtttactcctttggatacttctcatcttcaaggtccagctcatgtctcatctttttgatatgaccattcctaattatttaaatccatattctgaagttcttggcccttgttgtctacatctttgctgctcaaagtgtcattaaatgagcagcagcattgtcaccacctggaagatggttagaaatgaatcttggggctctgcctcagacctgctgaattcaaatctgcattttagcatgatccttgaagtgatgcatgaaacacttgtctgtcccatttagatacttagataatactcaatccaaacaccaacttatgtacttatctgcactcctcaagatccttgaaatctgcgaacctgttttatttttctttagtatctctgaaacacaatttcatggtaaagtaggtgcttactaaatagattttagtgtccttctctttctttttctatttaaaggaggaaaaaactcccaagactcctagaaagtgagcatgagctgctatagtttgaatgtaacctcttcaaaattcaggtattgccaatgagatactgttaagaagtgaagcctttaggatgcgattgagccattagggctcctcccttgcaaatggaacaaggtcagcaaaccaataggagtgctaaggtaaatgactgtagaacaaaatggtgtttatgtagcttgatggtacatgtaatttcacaattgcattttgtgtctgaaaaacatatgaggttttgctaagcttagtagagaaatgcctgctttgtggcaatgttgtccattagttaaccagagagaaatatgagaacagatgatgtcactatattcttccactagcctaggttcttaaaagctctaagactacaagtgttatagatgactccagcatgcactcatactgctacttaactttcttcatggaaatgtgtcttattctgtcaacagactaaaagaggggcaaggacatatattatataattttgtatatactcgataatgctcaggacatagagcttcagttccttccctccctccctccctcctgcccaccctccatttctttattcctgcctttcatcctttaagtgtttgttgagtgattgagatcaaatattgatatattgtatctatagaatagaatattctattctagtgctattatatatgctggggataaatcacgcattaaaatgaatgtccttctctttatggaacttgcattccagtggagcaaaaagataaacaaaatcataagaggaatttatacttagaggacgataagtactgcagaaaaagattagagaagagggcttggaattggggaggtatactttaaaataaaaagccagagaagaccacctttgagaacataatttaagaaaagacttgaaggaggtaaattatgtagctatctgagggaagaccttcccagagagtggaacagcaggtacagggctgaggtgggcatgaacagggaagagtaagaacggtcttttgggtttgaagtagaaggagcttgcaggagaatgacaggagagatgaggtcagatattacatctcaataggatctctctggctgcaatattgagaaaagccagaagggggacaaggtggaggtgggaagacgaattagaaggccactgcaataatacagacaggagatggtggtggcttagaccagggaggcagccgtggaagaggtgagaggcagttacattctgcatatattccgagagtacagccaacaggatttgctgaaagattgaatttggcatatgagagacagagaggcatccaggatccaggcatttaagatttttggcctaagcaactagaaagatgcagctgccatcaagtgagatgggggaaggctgcggtggagaagtcttttttagggaagattaggaacttagctttggcaatgttgagtttgacatatcttttagacaagtggagatattgaggaggcagttgaatattggtggaatgaacgaataaccaggatcttaatcaagtgtttaactcccttaaacataaatcaactttttgtctacttcctcataatgtgaagcactttgggatgtgacattggaaatcagactcttctgaccaaggcccaggtctgcctgaattccaggcctagagatctgacaatgtgctggccatcttcccttaaatgttctctagagccacaccatgtctaaaatggaacgcactctctttatcccaagcctggtctccctctttgtgactgtggtgagtgggcaccactaggcatgtaagctggcagtcacacttcattccttccatttcctcatctccatatctaattggtcaccaaatcttaccaaccccacttccaaaccatctctagaacccatctcccccctccgtcttcactgctgcttttttggatttatgctctcattgtctctcacctggattatatgtaaatcttctcctacctggtttcccagtctccaatcgatccttcacatagctcccagagtgattttctaaaatgtaaatgtggccatgttactcttctgcttaaaacatttccaaaggctttcttctgtccataaaacccaaaacttgagtttggcctgcaaggatcatcaagatctggctcctgcttatctcttagatttattatcccccccatcccccccgtcactcctatccattggccagattatactacctgtagttagttaacttattcattcaattttcagatataaataggatgcttcatatgttacaagcactatgctaagctgtgggggatacaaagctagacattgaaaaagcctgaaataaacctggttgtcttccttcctacttacttacagtcgtcatacagtaagctgtggggatacaatgctgcattgtacgcagacttggttcctgccctcatgaaagtatactttctcaatttccatgcctttgctctctgaaccccctgccttgaatttaccaccatctgctcctccctccatctcactgccatgtcctccttctcctaccagctacttaaagaataccatctcaacttttaagaatcagcttacatcattcccttgtattaagctctttactctatctccttttctcttctaaaaatgtttcctccctcaaaaggtatcattgaaaaacttaatagctctagaagtgaggatatctctaaatacattccaggttcagttcagaatattgttttatcttatactagaagatcatagctcaaggaatgggatttccttctttatcccaaaagggaaaaaagcctccttttcctggatttttcccatgctccttgggctccacaagtgggataagcaattgttaacttgctgcagagtgagtgaacccaattgcattggattcacacacagtggatgctccaggattttttttaaatatttatttatttatttatttatttatttatttatttatttatttatttattttgagacggagtctctctctgttgcccaggctggagtgcagtggcgtgatctcggttcactgcaagctccgcctcctgggttcacgccatgctcctgccttagccttctgagtagctgggactacaggtgcccaccaccacatccagttaatttttgtatttttagtagagacgggttttcaccatattggccaggatggtctcaaactcctgaccttgtgatccacctgcctgagcctcccaaagtgctgggattacaggcgtgagctgccatgcccggccttcaggatttttaaatagtaaagcgttaggggtggtgagctgattggtaggggtgctaggaaacttgtcttaaagctaagtttgcatagctagcttacaattttcacttagattaatatacatagatttatagtagcttgtgggggactgataaagatgtgggttaaagattccttttaaagccatcccttaatgctaccactgtacagaaagatggcagagtgactgcctttatagacacctgcccacacttcctaatctgccctcagttgcaactcctagagagtaggcacacagcttagggtggaaaatacatgaaaattcagtacttgtaaatagatgggaggtgggtaatgaggatgagcgacagaagaaaaaaccttctatatttgtctgttctcaccacctaaggggttcttcagaaaaccagtgagctttacgctcaggttgagaaatccttgttacagtcactttaattgcaatctctatttcttctctctttttctttctctctctgtgtctctacacctctccctcaccactttctggatatgcacacatatttacattcagatgattttagaaagctccattggggaataactataaattatgaatatgcaacagcactaaaaccaactattatagtcaaaaatcctgaaataaacctcctggttctcttccttcctacttacttacagtcagcacacagcaatatatcttagagtgaggctaaatggatatctgatactcactcgaatgtgataggcagtcaacaacccagttatcactgttgaagcattttaaggactacttccatgtcactctggctatgataaaaaccatagtctccaaattggtacagtaggatgaaccttccatgacgactggtagcatgtgtttgattacacatatgtatacatacatgtacacacaatacacatacctaaacattataaccagattagtatattccttttgcattgtactgaatactttaaaataatgtttcatcagtgattgtcagagttataaaatcatttgaatatattaataagctataaacattttaattttaaaggataaaatatgctgcacaaaagagccagtacagccactgcttatgtgtttaatttatttaaagagatgcctgttctgttattacttcaaatatagttatatctacatgtaagtgattttaatttgctacaacatttagatgtatcaatgagacatttcataaattaaaattgtatcacgtagggagactatcttgattatgaagctttattaggtgatgattataagtgccttgtttaataattataacagcttaatggctcctgtagttatactttataataaaaatttcacatttaataatatggaaagggatggtacacagtgaactgacaaaaaagtattgattctgaacctttaaattggattcctattgatctgatgtatgaatattttattggtgtaaatgttttcagggttgccagtttctattactgcatgttagcaattttactggctatgtataatggacaaattaaatgccaggatatgggcatatccagcaccccacactgattattttgattcacttatcactatacactactagggccttccctttctctgtcccatctctgttctggaaggtgagccacagacttcttctgtacatgcctcagatacatgacaagccagtgatgggtggtctggcttgttatctggtagaggctgggtgggcatgtgtctcttcctgctaaggcccacagccccttagctaagacttacacatttgctccaaggccagtcatttgggcccgagtacctaatggataataacaggggctctgggattaggtagagcaagatggctgaacaaaagcttcaaccaattgtcctccccacaggaacaccaaactgaacaactatgcacacaaaaaagcaccttcataagaaccaaaaatcagcttaggtaccagcttggccacagtggagtagagcaccaagcaggctcttggggtccctgattccaggcctagctcttagatggcatttctggacttgccctgggccagaacggagcccattgcccttctgggagagtcccagtcctgccagcattcatcacaagctgactgaagagctcttgtgccttgagtgaacactggtggtacccaggaagtactcaccatggacctagggtagtggtgatcacagggagagactcctctgtttgtggaaaggggagggaagagtagaagaactttgtgttgaggtatgtgttccagctcagccacaatcgagtaaggcaccaggtatattcctaaggtttctgactgtaggacctggctcctggatggcacctctggacccacccagggtttggggaattcactgccctgaagggaaggacacaagcctggctggctttgccacctgctgattgtagaaccctagggctatgagcaaagataagcaatagccaggcagtggttaccacaggtgttgggtgagacccaatgctgtgctgacttcaggtctgacctagcacagtcccaagggcaatggccacaagggtgcttgtgtgatcccacccacagttctaggcagctcagcacagagagagagagagagagatgccatttgtttgggagaaagtaagggaagagaacaagagcctatgtctggaaatccaaagaattcttccagatcttatccaagaccaccaagtacctctaagagaccgcaagagtcacagtgttactagactcgaggtgccccctaatgcagttatggctacagtgaccaaaaacttagatcacaacactcaagtccctttgaatacctggaaggcccttcccaagaagaatgggtacaaacgagcccagacttagaagactacaataaatatctagctcttcaatgcccagatactgacaaacatccataagcatcaagaccatccaggaaaaataatcttaccaaacaaactaaataaatcaccagggaccaatcccagagagacagagatatgtaacctttcagacagagaattcaaaataactgttttgaggaaatgcaatgaaattcaagataacatagagaaggaattcagaattctatcagatacatttaacaaagagattggaataattaaaaagaatcaagcagaaattctggagttgaaaaatgcaattaacatactgaagaatgcatcagagtctcttagcagaattgatcaagtagaagaaagaattagtgagcttgatgacaggctatttgaaaatacacagtcggaggagacaaaagaaaaaaagaatgaataagaatgaaggatgcctccaagatgtggaaaatatcctcaaaagggcaagtgtaagtgttattggccctaaagaggaagtacaaagagaaataggtgcaggaagtttattcaaaaagataataacagagaacttaacaaacctagagaaaggtgtaaatattcaagtgtaaaaacaccaagcagatttaacccaaataagactacctcaagacgtttaataatcaaactcccaaagatcaaggataaagaaaggttcggaagaaataatataaatagagttccaatatgcctggtagcagacttttcagcggaaaccttacaggccaggagaaactggcatgacatatttaatgtgctgaaggaaaaaaaccttttatcttagaatagtatatccaacaaaaatatcctttaaatatgaaggagaaataataactttcctggacaaacaaaggttgagggatttcatcaacaccagacctgtcctacaaaaaaatgctaaagggagttttcaatctgaaagaaaaggacattaatgagaaataagaaaacatctgaaggtgcaaaaaactcacaggtaatagcacagagaaaatcacagaatattataacactgtaattgtagggtataaactattcatatctcaagtagaaagactaaaagatcaaccaatcaaaaataataactacagccacttctcaagaaatagacagtacaataagatagaaatagaaacaacaaaaagttaaaaagtatgcagtgggggggaatgaagttaaagtgtacagtttttattagttttctctttgcttgtttgttagtctatgcaatcagtattaagttgtcatccatttaaaataatgggttataagatagtattttcaaacctcatggtaacttcaaatcaaaaatcatacaacagagaaaaaatatgcaaaaaataaaaagcaagacattaaaacataccaccagagaaaatcacctttactaaaaggaagaaagaaagaaaagaaagaaggaaggaaggaagagaagaccgcaaaacaaccaggaaacaaatatcaaaatggcaggagtaagtccttacttatcagtaataacattgaatgtaaatgaactaaactctccaatcaaaagacagagagtggctgaatggataaaaaaaaaaaacaagattcaacaatctgttgcctacaagaaacccgcttcacctataaagacacacatagactgaaaataaagggatggaaaaaatatactatgcaaatgtaaactgaaaaagagcaagaatagctatacatatatcagacaaaatagatttcaagacaaaaactataagaagagacaaagaaggtccatatatgatgataaaggggttacttcagcaagaggatataacaattatatatatatataatatataatatatattttcacccagtgctagagcactcaggtatataaagcaaaaattactagagctaaagagaaagatagacctgaatacaataatagctggagacttcaacagtttcagcattgaacaaatgatccagacagaaaatcaacaaagaaatatcagatgtaatctgcaatacagaccaaatgcccttaatagatatttacagaacatttcatccaacagcctcagagtacgcattcttctcggcacatggattattctcaaggatagactgtatgttaggccacaaaacaagtctaaaaaattcaacaaaattgaaattatatcagtatcttctctgaccacaatggaataaaactataataaatcagtatcaagaggaattttggaaaatataaaaacacacggaaattaaatagtatgctcctgaatgaccagtgggtcaatgaagagattaaaaaggaaataaaaaaatttcttgaagcaggtaataatggaaacacaacataccaaaacctacgggatacagcgaagccagtactaaagagaagtttatagctataagtgcctacatcaaaatagaagaaaaatttcaaataaacaatgtaacaatgcatcttaaagaactagagaagcaagagcaaaccaaacccaaaattagtggaagaaaataaataaagatcagagaagaaataaataaaattaaaatggagaaaacaatatgaaagatcaatgaaacaaaaagttgggtttttctttttctttttttcctttctttttttttttctgagacagagtttggctctgtcacccaggctggagtgcagtggcatgatctcagctcactacaacctgaacctcctgggttcaagcaattctcatgtctcagcctcctgggtaactgggattacaggtgtgccaacatgcctggctaatttttgtattttttgtagagatggggtttcaccatgtaggctaggctggtcccaaactcctggtctcaagtgagccacctgctatggcctcccaaagtgctgggattacagggatgagctactgtgcccggccaaaaaaatgattttcttaaaaagataaacaaaatttttgtcagttgacaagacttaaatctaagacttcaagctatgaaactattaaaagcaaacattgggaaaactctccaggcaagtgatttcttgagtaataccttacaagcacaggcaaccaaagcaaaaatggacagatgggatcacatcaagttaaaaagcttctgcatagtaaaagaaacaatcaataaagtgaagagacagcccatttaatgggagaaaatatttgccaacgatccacctgacaaaggattaataaccagaacgtataaggaacccaagaaactctataggaaaaaaatctaggccaggcgtggtggctcatgcctgtaatcctagcactttgggaggccgaagcaggtgaatcacctgaggtcaggagatggagaccagcctgaccaacatggagaaaccctgtctctactaaaaatacaaaattagctgggtatggtggcccatgcctgtaatccagatcttcgggaggctgaggcaagagaattgcttgaacctgggaggtggaggttgcggtgagtcgagatcgtgccattgcactccagcctgggcaacaaaagcaaaactccgcctcaaaaaaaaaaatctaataatcccattaaaaactgggtgaaatgtctgaatagacatttctcaaaagacatacaaatgaccaacaggcatatgaaaaggtgctcaacatcactgatcatcagagaaatgcaaatcaaaactgcaatgagatatcatttcatcccagttaaaaaggcttttattcaaaagacaggcaataacaaatgctggtgaggatgtggagaaaagggaactctcgtacactgttggtgggaatgtaagttggtacaaccactatggagaacagtttggaggttccttaaaaaattaaaatggaactatcatgtaatccagtaatcccactgctaggtatatacccaaaagaaaggaaatcagtatattgaagatatgtcttatctctgtactcccatatttgttgcagcactattcacaatggccaagatttggaagcaacccaaatgttcatcaacagatgaatggataaagaaaatatggtacatatatgcaatggagtgctatccagccataaaaaggaattagctcttgtcattgtcaacaacgtggatggaacacgaggtcattatgttaagtgaaataaaccaggcacaaaaagacaaacttcacatgtcctcacttatttgtgaaagctaaaaattaaaacaattgaacacatgaagatagagagtagaatgatggttaccagaggttgggaagggtattgagggtgcggggaagggacggtgagacagtggggatggtaaatacgtataaaaatatagttagatatttagaattaataagatctagtatttgatagcacaacaggttaactatagtcaacaataatttattgtacatttaaaaataatcatttgtaacacaaagaaaggataaatacttgaggtgatgcatacccatttgcccatgcaataatgcctgtatcatgcctgtatcaaaacatctcatgtaccccataaatatatacacctactacatacctacaaaaataaaaaaaaaacccctggactctggagtcagattcattcaattcaaataatatttattgagagccaaatagcagacattgttccaggtgctaggaacagaatcgtgatcctggcttcatggacttccattctcatgattgcctaggttcaaatcctaactctacctcataacctcaggaaatatgttttactgtctgaacttatctcttaatttgtaccagattcatgtttgttgcaagaatttacagaggcaatgtatataaagcatccaatatcatgcctagctcattgcaagtgtcacttatttttatttttgggtgaaagtctgatgcaagccatatttatgccataaatttaattggatgtgaatatgatctactagttgaaatgactctgatttctatgctttttaatctagtctgagcagcatttatgatacagtaatggccaaaagacaatgaaaacactattatttatcttaataagacaatcctaagccaaaagaacaaagctggaggcatcacgctacctgacttctaactatactacaaggctacagtaaccaaaacagcatggtgctggtaccaaaacagagatagagaccaatggaacagaacagagccctcagaaataataccacatatctacaaccatctgatctttgacaaacctgacaaaaacaagaaatggggaaaggattccttatttaataaatggtgctgggaaaactggctagccatatgtagaaagctgaaactggatcccttccttacacctcatacgaaaattaattcaagatggattaaagacttaaatgttagacctaataccataaaaaccctagaagaaaacctaggcaatactattcaggacacaggcatgggcaaggacttcatgtctaaaacaccaaaagcaatggcaacaaaagccaaaattgacaaataggatctaattagactaaagagcttctgcatggcaaaagaaactaccatcagagtgaacaggcaacctacagaatgggagaaaatttttgcaatctactcatctgacaaagggctaatatccagaatctacaaagaactcaaacaaacttacaagaaaaaaacaaacaaccccatcaaaaagtgggcaaaggatctgaacagacaatcctcaaaagaagacatttatgcagcccacagacacatgaaaaaatgctcatcatcactggccatcagagaaatgcaaatcaaaaccataatgagataccatctcacaccagttagaatggcaatcattaaaaaatcaggaaacaacaggtgccggagaggctgtggagaaataggaacacttttacactgttggtgggactgtaaactagttcaaccattgtggaagacagtgtggcgattcctcaaggatctagaactagaaataccatttgacccagccatcacattactgggtatatacccaaaggattataaatcatgctgctataaagacacatgcacacatatgtgtattgtggcactattcacaatagcaaagacttggaaccaaccaaaatgtccaacaatgatagattggattaagaaaatgtggcacttatacaccatggaatactatgcagccatgagttcatgtcctttgtagggacatagatgaagctggaaaccatcattctcagcaaactatcgcaaggataaaaaaccaaacaccgcatgttctcactcacaggtgggaattgaacaatgaaaacacttggacacaggaaggggaacatcacacaccggggcctgtcgtggggtggggggaggggggagggataacagtaggagatatacctaatgtaaatgacgagtaaatgggtgtagcacaccaacatggcacatgtatacatatgtaacaaacctgcacgttgtgcacatgtaccctagaacttaaagtataagaataaaaaaaaatgtagtcaattgtggtgagtcataggagggatgccaagtgtggaatcaccacagatgccagtcaaggctcaacgtgaccagctgttcagggtgctttgacaatcccaagccttgaaactacctaaaggctccttctgagtcaaatatcaaaaaaatggatcccaaatgactcctaatatgatttctcccagatgctctttctgataactttgtttccgacgttgatatctgatgctctcctaattactttggaccactttcttcctggaagactctatatggctcttatcattgagcagctctttgcaatgaagatgggaaaagacctccactatcttctgttatgatctaaggccctcgatgaggtacccattgcctccatgtatcttcctgggaaggcctttctgaggctttggctggtatcttaatttcttgtggaatatacatactggtgttctggtgctgtgatgtctggatatgttgaggtattgaccataccctggccagtggttttccttttgtttatatggagagagtccctgctctggcaagggaagagatgaagggaagagagggtagaagaggggaggggagggaagaggaggggagaggaggggaggggaggggagggaacaatttactgtgcctttttaaaaagagatcagccaataaaaaggtagattttggagacagacaaatctaaaaaaaaaaaaaaaaaaaagaaatgaaggttccaaattgatcacctaaatcatacagtcctttatcaaaatgcctggaagcctgtctaggctggaggttggctaacagcatacactcagctgacccggggagtactgatttattttcctatgttagaagttaggcctcatctgaaaggcagagagaagggcatcatcacactctatgccctatggactgggattggggtgggcactggagactattcaagagggcatttttgggaaaataggaagagagctcatggtggaagacagggaaagtaccagtagaagccgcattctgacaacattccacaaggagagaagctaattaaaaatgggaacctgacataggccaactaaatgagtatctctggggctgggatctggcagtgatctttcataagaaaaactcccctagataattctaacatagccagaggtaaaaacaacaacaaaaaaccccactactgctccagactagtagttctcaaagtgtaattcgcagaccagcacacgtgggtatttgtagaagtgcaaattaacaggaccccccaccaccccagatctactgaaacagaaactctgagggtgggactcaggaatctgtgtcttaacaagctctccagtgattctgatgcttgctcaagttggagaactactgctctagataagtcataccagaccaaaaaaacaaacaaacaaaaaaattaggaaggtcaggaaggcaggcagggtaaaatggatcagggtggaagtccactgtggtttccttttgtactttagagaagaatgaaaaacgcacattgctcacttccatacaactttggagaggggaaggtatctaacccttcacctttctctctcctaaagctccttcctaggagccattaaatgacagaggcctcttggttccaagtgggttttaggatttttaaataaaatgcagagactaataatgaaatttgttggaccatcagaaaggacagcagatggcccttgtgcctaggagggagggagggagggtaaccgctttccagaccaggaaaaaataaactaagaataaaaagaaaaccaaatgattaaaactgaactttgctttacttttcccttttatttcatgaaagcagtgtttgggcacagtagagatatgttaataaaattgaataatgtctcttgcactaagttttcagtacaagatgaaaactgcataagaacatgttctaatgatgcgttggttttctcacagtaacatccagcccccagaacattctctggcagcacccacactctcctgtcctagtgaataaacctggaacaaagctgaaaatctgaggagctgccgcctggatggggaaggatatgcttgtgaaatgtagcttggctctgttgctgacttagatgggagtacaggaaagtcattagtttctctggccctcaattttctcaagtaggaaatgacagaaaccacccaaatgaactgaaatgtcaaagtgatctccacaggcccaggaagagggccaggtgccatagccaaacaggatagcagaaaatcgcacaggctcatggtgtcacattctggtaaatgggcatgatgaaatttaactaagctgaaaaactgagaagtttagtgatcaaatgtgggccaaacattctatgggcatttttgttgttgcttattttaatggtcttttcctcctcatactcacatgctgtgcaaaaattatataattatataaaaaatatgaattatataagtaaagaaccccaaccaaatctcaactgattttgtgaaaaagaaatatcttttttttgcttactcttaagttctttttatcagaaaacaaataccacatgggattattattttaaacacaagctgcatttaagagaaagtgtctagtaaaccttctggggctgtaaattagctgctaattttgtttgactaaaggctgtaaaatgcatttctgggaattattgtgcacagagaacatcctcctaatacttcagtgggcttgaacagagaaatggaatcctattcagtatacctgttactaaactgaggctactccacgacccaggctcattctatctaactacatagccagcttttctggatttgtgaaagatgagattttgggaaagaacatgagaaacaatgagtcattcacagacacataagtagagatttgaaattggtgttcagaccatctaatcttcacatttcctcctttgttcaatctcattccagtctctgaaattttccaagggcctgtttattactctgttctattcacctactgctatgttcagttactgccccctgtttctctaatggagttttgctttcaagactgggcacaactcttctcaatatgtatttacatttttcatttccttatacaagttccatcattttttctttatgatagttttctttaacctgtttattcatttgtttcatttgttatattttcatgttttttatcctggtccttattttcctccatgacacctcttcttatacttgatgttgttctctagaatgctgttaaatttgctacctgtctctttcaaaatttacctgggcaatggtagcacacaaagggccatgcagacttgccaatattaggctggtttggcctagcatagtacctggcacacagcaggcattcaatcaatatctgttcagtgactgcctgaatgaaaatagaaatgatatcagtagttttttgcaataatcttaagcaaaattataaactaataacttccactcctttaaatgtgtgtcaacttttctgtactaattggaaaaacatctagttcatgtggatcaaaattgagtctatatgctacgtagggcaaaggcatgcctggattttaacatctcatcctcagtgactctaatggtgcctggcacagaggagatgcccaataagtttatatgaaatggcttagaatggactaccttctccatgcgactaatgatctgttactacttcctgaaaggttagccattattgatataccacttctagatgctgtgacaaatggcacagctcagcagcaaaagtactttttaaagtctatgggcctccacaggttgagtttgaaaaggatctgttaatcctctgaaattacatgtgatttatggggagaaagtttacaaaattattaatactcttgaaggggaatatgacctccccccaccccaaatttcagaaccacagtggataatgaaagtttctatgctgtaagagcaattaggaagtcctgaaaaacagggaatttagtcaggagacttgagttgaaatcctaactctgccccttgctggctgggtgaccttggccaagttttaaactctttcttatcttcagtttccttattatgacatggtgatgttaatgacaagtctctagacatagtggttaaacttcaacttgaacccaaatttttctggctctaaagcccaggctcttaacatctatcatcctacattaattaaatgagataactgatgtgaaaatgcctgatgtaaatatttgttaaagcaacaacaaaaaatgtcatttgtcaaagtaacaaagtattttttaaagtaacaacaaaagagacagataaccacaaagaaaaggccactttagaaattcctctttgacctattaaagaatgttcaagttcaaaatatgtttgtcattatgattaaaaatccaaccccaaaacttgggtgaagacggcataatctgttagtttggatatatacagactaaggggattctttggaataccctttgtctagagtgatcttatgacatggtacggataactagactcacctaacattcaaatgaagggctgtgtgtcttctatactttgtagacagaggtggcagatcatctgcttttaaatatagagggctcccattctgctaggatccagagggaatgagggtcctatgttacagatgtccctctgcctgcacaaaaggctgaagaacaagccatcatggagtgtgggagatccagctgttgtccatttccagaagaggagtgaatagtggcttaacagagaggacccttgcctggttctctttggaaatttcacagtagtgaggccaggtgcggtggctcatacctgtaattctggcactctgggaggctgaggcaggtggatcacttgaggtcaggagttcaagactagcctggccaacatggtcaaaccccgtctctactaaaaatacaaaaattagccgggcgtggtggcgtgcacttgtaagcccagctactagggaggctgaggcaagagaattgcttgaacccaggaggcagaggttgcagtgagccaagattgtgccactgcactccagcctgggcaacacagcgagactctgtctcaaactaacaaacaaaaaatttcacagtcgttatgaacagataatatgctcaggtattagccatttcattgcattgttttgacaagtgacaggaattaggtttgctaatgttggaagaaaaatctcacttgttgcttttaacttaaaccttttatggttttgagataggtttattcactgggctggagaatgaaggatttatctgtattagtcggatttgatcagttttcaagtagctactcagtgtcaggcctatacattatctcgtttaactctcttaacaccatggtaaggttgactgtatcataatctccatttatcagataaggaaacaaagattcagagaagtcaccaagttgagatcattgcccagctgcacacagctagtgagtggtgaagctgagacacaaatcagggcttccgacgccactttctattacactttactatgctgtgcattcgtgtaaaagcatgatatttttaaagtggcattccagctgccagaaggatatcaaatcaagtactaaagacaatattattagaaatggaaatctggactcaccaagaaatgtcttcagttctatataataggaagactggtattttgcttgatatgggtgtttcaatatcatctgctcctaaaatgcagtctagacacctcttgtgacctgctcaggtgatactaatgaagtttgggtcatttttagcatctacagagaacagagtaagagtgctgtgtgttcaatactattgcagacttatgggataaactggattttcttgctttactttataaagctaatgcctgattacaaatataagtttaaaacaaacctcaaaatttcttggcacccactctttgtggttggtaacatggacatctgtataaaatacccaagaccttcatagagcaaaagtgagtgggaaattaatttttattgggtatataatcatcactagccatgttcaaatactttttctctaaatcctttacaaagatcttgtaagttgggtattattacattcagtttagactaaacgaaatgcaaaaaaaaaaaataataaagaaaatagactcacaaggtaaagttgcatacttgagacataacaaaattaaatttcattctatgatgctgccacatagcagatgatacaagcagtatagaatacccataaacattatgttttaaggtatttccacctgtatctttcttggggcaggtaaatgaaactcactataaaccagttacaggtcctcctttatctgaggttttgctttctgaagtttcagttacctgcagtcaaccatggtctaaaaatattaaatgaaaaattccagaaataaacagtttattacgttttaaaatggatgtccttctgagttgtgtgatgaaatctcatgccatcctgctccatccctccagggatgtgagtcatccctttgtctagtgtatccatgctgtctgcccttagtcagccttcttggttgtcagattgattggtacaatggacacaaggtattaccgtgcttgtgtctaagtaacctgtgttttactattattacagtctattgttatagtttctattttaatataagttattgttggtaatctcttactgtgcttagctgataaattaaactttattatagatatctatctatatctatcacagatatatctatagatacgtacctgcgatatgtatctatatgcgatatgtatagatacatatcacaggtatgtatctatagatacatcggtatatatatgaaaaaacagtacatatagggtttggtactaaccacagtttcaggcatccactgggtggggatgcgggtcttaaaacacaacccttgtggataagagaggactactatatggaaagtcagagttagagagcttttgtaggttatgtagttcaatcttttgttttgctggtaaggagaagaatacaccttaattttgacttcttaactcgaaaagttaagaaacttgtctaaggtcacagagctagtggcagagcaagccaagcatcagtgtctccaaaatccagctcagtgttgtttgtgttatatcagaatgagtaagagttaagataagaacatgagtcttacagctccactatccatgttcaaattcttgctgaatgattggggaaacttacccaacctctctggacctcaggttattcacaagtaatacgaatataacagtatttgatagagccaattaaatgagttaatatttgcaaaatgctgaaatcagtgcttgccccataatgaatactcaataggtatttagatatttttattcttatctttcctcccaagcccaacctagtgtagaaacttctggaatggttgaattgaaggagaaatagtataaacagtataaaaaggtaaactttttaaaaagagaatcatgaagtagtgcttctacagagattgggggatggcaaacaacccatggagtaaattcacaagacttgacacttaagaatccaagagggctgcatgagatgagtccaggtaggcctcgtagacaaatcttagatggagttaactcaggaagccaaggagtatgagccagtagtcatcctgagcaaggataataatttttctttctgcctgccttcttgccttcttgtctccttgcctaccttccttcctttcttccagctttccctccctcttttccttccttccctatctccatccctcccttcctttcctacctccctcccttctttcttcttccctttcctccttctttccttccttcatttcttccttctttcctttcttcctccctctctcctacccttcttccttgcttccttcctccctccctcccctcccttccttccttttccttccttcctttccttccctccttcttcctccctctctccctccttccctacttccctccctcctactttcttctgtttcctctttccttcctctcttcttctttcctccctctcttccttccctccctcccaccttcctccctttcctcttccttcctctttcttccttctttccttcctccctcccatctccttccttccttccttctttctttccttcattcctccctccctcccttccttttttctctacctccctccctccttccttcttccttttcctccttctttcctttcctttctccttccttccctccctcccttcctgccttccacccttcctaccttcctgccttcctgcctgacttcctttcttccctcccccttccttctttcttgccttcctgccttgcagtcaccgaatgttttttgagtgactatgatgtgccaagacccggtataagggtgcacgaaataaagtctctaccctcaggagcttacttcctagtgggggagacagattataaacaaagacacaaataggtaatatactattatgtggtgaaaaatgctacgaagggaaagtcacagggagcatttttgtttggtttttttttgttgttttatatagaatggtcacaggtgcctctctgaggagcccttggagcagacacctgaatgaagtgaagccacatgcctggagaacaaatattcagactgagataagagtgaacacacacctgcagtgagagagagagagagttgggtgtgatttgcagacctgtaggaaggccagtgtggttgggcagagggagcagggaatgtaggcaggggccagatcacccagtatttgtaaactgaggcatggactgaatgatagggcggcttcattcatccaccaaaccacgtgctgagtaatctaccccaattccaaagcatgaacttgacaactgcttcttcatagtaatagatgaaggataaaaaaatttaaaaagcatatagatgagccaacttttatgtgcttaaagtgaaaacaatcatgtctataagacaaaagaaggaaagacatttgacatgctccatgtacctgagattcatctcgtgttaataaaatgttgaacatattacactattggccggtgtttagtttcagctgaggaactaattcctaaagctgcagcctgggggatggggagatagggtggacactgagacagggcatggaggaattcagatggtatttaccccagaaatatttactgaaattgggaatgctgagtcaagcctagccatgctagagggccttgggaaggcagttactagaatctccttgatttttttccaatttcagaagaagcaacaagaagaaagtgtcttgactaatccttctagtgaaagatattcacttttataataaggtgcttgtctacacagaggtttctgagtcaaaggaggagaacgtacaaaatagaccgaaagaagagcctgcctagctgctctttttcttttgtaattaccaagatcccgacggtttatacccactcaactgcaggtgctgggagaggagaggctactgtgacaaaaattatataaagaagagcccagcagatgcatttccagataaacaatgtaaaacatagtctatgtaagtgccataaaatttcactaataaaaaacacacatggctcagggaaacatttattatcaaaatggaagcaggaaagggcatatgctaagtcttattcatttcaataaatagcagaacgtgaattgataaaagttcttaattgaaaaacagttgctcatttgtagtttgatatttaaaagctttctaaacatgtatttattttgttttgccttgaagtaattagctattagactaactattttcttttcatgtcaggtacacagtggctccaaagtcaaaacaaggttagattggaaggaagcaaacaatgaaattgaagggaaatatcgacacttctcaatcaatgaaaatgcatcagcatgtatgagcatctttagctggcaataatacatcagaaataaataatgttagcaaaagagacagcatcattggctattcatagtatgtattcacggttgtacaataaaattctaaaggctgaggttgaaagtgaataaaaattattagttctaaacacttgaaaattccagcagcttagacatatttttgtatgctttcagtgccccaaatgtaaaacttaaatcattttatgaaaaaaccttgttcaatcttttaagaaatttgcatttcattgcaaagatggaacatagcatccttggctgagttattttctatagaagtcagtgccattttgtggtatatgattagcacattctaaaggcaaagattccagaacgtttaaatttagttgtgaaaaactgaaggcatttatccattcatatataagcatgaaaatgcaagcttcactttctcagtatgtttaaatgccacatattataatgggaattctagaagatgtgatcatcaaactctgatttcacgcttagaaatcaaataaaaaagagactggcctataattagaaaattagtcaagtcagatctaatatcaacacatggttgtcacagaacaaaaaatttttgctttgagaaaaatgagatatcattctggatgaatattctgggtcagtagaaaatagggaatcaaagtatagaaataaagtgtttatgtcactgtaaaacttctagttttctaaaataaaatttaaatatctgaaatagcagtttatacttcatactcatacagtcaatagacattggtagcttaagaaagaacttggtaagtgatgatttaaagagtgatatagattcagtagtattcaatatacagttgtaattgatgagctcatcaaactatggaatttgggatatttacataatatttacattatataatatgggagagatagcaagtatctataaagagtttaaattcccatactaggaaatgtatagtttgttttaatctatgtctacatttaaagtagatttttttttcagagacagcatatagttgggtattgctttttaaatttttaaatctaatctttgtcttttaaattatatttaacgtagttgttgatatggttgaatttatgtctattaccttgctacttgttttctatttatcccatttattcttgtttttttccctcaatgtctgccttcttttggattatttgttttagtattccattttatttccattagtggtttattagttatacctccttttaaatttatttacctaattttagttggtgccacaaggcttaaagtataaatctgtagtttatttttggaggatctttgccccacagattccagtcttaccatgctatttattttttagcgatttgattacgctctggtcaatatgtgattatgtgcaaactgtgtgtgtgtgcgtgtgtgtgtttatcttgcttgaggtttgttgaatttcttggatctgtgggcttagagtactcacataaaacttaaaataaatttctatattcttttttctggtatactgtctatgcactcttaattcatatagtcatgtttttatgtcagatattccattttttgtctttaaataatataccaattaatgtataacgtgatccttacaatagttatacttctatttccccatttttcctgctattgtgataatacattttacttctatatatgacaaaaaaccccatgatatacataacagtgtatataataataacatatttttgctttaaatagctaagtcttttaaataaatttttaaaacgagggccgggcgcggtggctcacacctgtaatcccagcattttgggaggccgagacaggcagatcatgaggtcaggagattgagaacatcctggctaacacggtgaaacccatctctactaaaaatgcaaaaaattagccaggcgtggtggcgggcgcctgtagtcccagctactcgggaggctgaggcaggagaatggcgtgaacccgggaggcggagcttgcagtgagctgagattgcgccactgcactctagcctgggcaacagagcgagactctgtctcaaaaaaaagaaatttttttttaaatgagaaaaagtattttatatttatccataaatttaccacttacatcacttcatttctttgtgtagacctgagtttttatgtggtatcattttctattttttaattaattaatttttttttgagatggagtctcgctctgtcgcccaggctggagtgcagtggcgcaatcttggctcactgcaacccccgcctcccgggttcaagcaattctcctgcctcagcctcccaagaagctgggactacaggtgcatgccaccatgcccagctaattttttttttgtatttttagtagagacggggtttcaccatgttagccaggatggtctcgatctcctgaactcgtgatccacccgcctcggcctcccaaagtgctgggattacaggcgtgagccactgcgcccagctatctttctctggttttcatagtttatggcaagaaacctgcagaatttcttacctttgttactttgtgaagtgtcttttttctctggatgcttttagattttttttttttagcaatttaattatgctgtggttaatatgtgtaattatgtgtaagctgcatatgtgtgtatgtgtgtgcgtgcgcttatcttgcttgaggtttgttgaatttcttggatctgtgggtttgtagtcacaccaaatttacataatttggtagccattatttcttgagatattatcccccatccattttttaatgtgtccttttttcccccaaatatacatgttagactgcttgatattattccacaggtcacttaggctctgctaattttttcactactctttttttctacatacttcattttggatgattctcttactatgtcttcaagttcatgggctttttcttttaatccaaatggtcacattttcatgtcagatattcttaatccaaatagtcacgttttcatgtcagatattctgttttatttttgtctgtagaaatcacatttgggctttaaaaaatatcctcaatttctctcctcatttcatgttttcctttaaatacttgcaaataggtttttttgtttgtttgtttgttttgagacggagtctcgctctgtcccccaggctggagtgcagtggcgcaatctcggctcactgcaagctccgcctcccaggtacccgccattctcctacctcagcctcccgagtagctgggactacaggcacccgccaccacgcccagctaatttttcattttcgtatttttagtagagacggggtttcaccgtgttagccaggatggtctagatctcctgacctcgtgatctgcccgcctcggcctcccgaagtgctgggattacaggtgtgagccaccgcgcccggccgcacataggtattttaacattcttgtatgctagttccattatctctgtcatttctgaatctatttctatttaatgcttttttcctcctcataatatgtcacattttcttgtatcttgtctagtaatttttgatagaatgctgaagattataaatgccaggtcatctggattttgacttccttaaaaaatattaattttggttttggcaggaagccaaacaaaaatccagatctaaagtccaagtttctagatatttgcccctcagcttctagcctgagcctctccaaactccagtctctgtcttctgagtcagccaggaagtaaatccaagctgttttgggttacccttccctctgcttatggaccataaattgcctcctggaagaaacctggggcaattgtagaaatcactttttttgtcttcttcctctcagagatcacagccctaagctgcctacaatctgatgtttgaaaacagctgcaccatatattttgttcagttaaattttttttttttaggccaggcatggtggctcatatctgtaatcccagcactttgggaggctgaggagggaggactgcttgagctcaggagtttgagaccagcctaggcaacatagtgagactctgtctctactaaaaataaaaaaaattagctgggcatggtggcacatgcctgtggtcccagctactcaggagccatctcaccgcagcctcgaattcctggcctcaagcgatcctcccacctcagcctcctaaagtgctgggattacaggcaaacaccactatgcccggctattgttcagtttttttttcttttgttttttgttgtttgcttttgcttttttgaggcagagtctcactctgtcgcccaggctggagtgcaatggcacgatgtcagctcactgcaacatccgcctcctgggttcaagggattctgctgcctcagcctcccgagtagctgcaactacaggcgcataccaccacgcctggctcatttttgtatttttagtggagacggggtttcaccatgttggccaggctggtctcaaactcctgacctcaggtgacccacccgccttggcctcccaaagtgctgggattacaggcgtgagccactgtgcccagcatattgttcagtttttaatgggaggttagggacaaattttgatactccattaacagcccaaagcctatttcccaaatctgttttagatacccttagatgaaataattcttacagaaaccatgagaccttaaatgattaatcataattatcaaagaaaactcctgagcagttaatgtcaaatgtaatatgatgtaagtaagttgattgataatattcgtgtcttgttaaaagaggctactttagtctgctgagatactgaacggattttcctaagggaaggagtatctgatatgaaataccagttaatcatcagtcaccaaccattaattaaatggctactttataaaggacattaaactgagcgctagatggagtatgttgttgcagtcatttcatagaaaagtctacaggggtaattataagaaaaagaaattgggtatttcaaagatctagtcactgatataagtggaatgtgatatcaaatgtgaatcaatactttaaaataatttttattaaatgcttattagatacagaagaatgctataaaaatatatgtaaacttaaaagtagtgcttctgaaactttaatgtgcaaacaaatcacctgagatcttgttaagatgcagattctgattcaggagtctggggtggggcctacctctgtagttctaaaaaaaaaaaatccaggtgaggacaatgtttctgctctgcagactatctttggagtagcaagagtaagagaagtgaaactacaatgatcatctgtgtgcccaccactggtgtaagaaaaataactttatttttatctctaatgtcttctgggtaccccctcctgatcccttccctccctcttagaaatgactacttccctccctcttagaaatgactactctcttgaattttgtttttatcatccttttgcttttcttaaaagttttaacacatttgcttgtcacttcaatatatattgttagggtttgcatatttttgaatgcatgaacctaatataaatggaatcatttgcatatatccttcttcaatttttcataccacattatgttcctgaggttaattcatatcattgtaatcatagtttgtataaacttaatttattttcatcactgtatggaattctattgtatgaatatacataattcattttaccgttgttgaattttgaaatttaggttttatactgccatgaaaattcttgcataagttcctggtgcacacatgcaacacttagtcagattatatacataggtgatgaattgctggctcataaggtatacacattttaaactttagtagattatgccaaattgttttctagagtggttatattgacttgttctgccaccaactgtgtgtacaaatgttctggttgttcctcatctgtattagttttatattgctgcacagcaaattgtcacaaatttactggcttaaaacaatatccacatattagatcatagctctataggtcagaaatccaggtgggcctggatgggttctctacttggggtctcaccagtctaaaatcaaagtttcagctgggctgactcttatctagaggcgctgtggaaaaatctgcttccaggctttttcaggctgttggaaacattcagttattggcagttacagactgaagccccttttcctgctgtctgttagctgctaaggaccactctcagctcctggaggccactctcagatccttgtcccatagccccctccacttatcaatggagaccctcctttgcatcaaattcctctcatgcttaaaatctctctgagttggataaaagtcaatatataaagagctaatgtgattagattaagcatatccaggcaatctcccttttgtcatataatgcaccatagtcacaagaataattccagcgattaaagttatgagggtcatctatagaattctgcctactctagtttactgatagccagactggccccatgattcactactgtttcataggtaaaatatattcaccacttcccaaggttcctagtgctttgattccattacagcatcagttcaaagtctaaaatctcaataaatcatctgaataatctaaaccagatggaatataaaaaggagtcagcaatccaaagcagtgttgaaatccagtggagcaaaactggttgggaaaactccactgagtttcaaggcctgggaataattctctttagctctcagctcctccctctccacttttggtttcaccctctgagtcaactttcttttttcataaagagtagatgaatagttttatctccctgcttctcgcagtagaatttgagcagatgtaagagtctcttttcattttatactctctctgtcccttttggtccagctggtagtatttctgctgatacaattttctcaagaactttctggatctcctgtggatatcacagtgattcactgcatcatacagaacacatgctgacaagtcttttgagataatcccttctctatttttggcttctactgaaatggttgagggacagaacccttaagcccagaggtcctctggtttaactgagaagatctgtgagaaacacccttaatctcctggaagggtagtttgtgtggtaaaatactctggccttttgatatttctgagttttcaacaaagaactgtatagtatacactcagacttttctttatgccactgttttagcagccatttatgacttttagcatccttttgccatctggagaggctgtgaattttctaaattatctactctggtttctgtttaaaagttcttccctcaatttatctctctcctttcacaatttactataagcaacaaggagaaatcaggctgtagctttaacacctttcttggaaatctccttagctatatattaaagttcattgtttacaaattctgctttccacataactgcaagatgcaactttgctagctatttggccactacataacaagactctcccttcctgcatttctaataatatgtttctcacttctttcttagtccgcactgacagcattctcaaagcccagatttttttaacctatttccttatattttaatgggttttctgtggctcatggtggctcatgcctgtaataccagcactttaggaggctgagtcaggaggactgcttgaacccaggagtttaagaccagcctgggcaacatagtgagaccccaacactgcaaaaaattaaaaaaattagctgggcatggtggtgtgtgcctatagtctcagctacctgggaggctgaggtagaaggattgcttgagcttgggaggtcaaggctgcagtgaactatgattgtgccactgtacttcaacctgggtgacaaagtgagactgtctcaatcaatcaatgaatagataaacaaaaaatgaatggaagttcttgtagacaaatatatgtggtttggcttttatttatccaatatgacaagccctaaattttattttatttattattttattttgagacagtctcactctgttgcccaggttggaatgcagtggtgacatcgtggctcactgcagcctcaacctcttgggctcaagtggtcttcccacctcagcttcctaaatagctggaactacagttatgtaccactgctcctggctaattaaaaaatttttttttgcagagaagagatcttgctatattgaccatactgaagccttgctttttaagatgatatttagatcatttacatttaatgtaattatcaatatttttagtttagtttcccaactttctatgtctttttatccaatttattttctcttcttttccttattcctgcgttttttgataagtatttttatgattacattttatttttcaggattggattattagttacacatttttgttttattatttttagtggttgctctagggtttacattattcatcttaacaaataacaccctacttcaaataatataataatatatattatttcacatatagtataaaactcataacttccattttcctcttttatcctttgaatgatactattgtctttcattttacttctaagatgttgtaaacctctcaacaaattgtttacatattttctttagacattcaattatcttttaaaatctttaaaaataagtaagaaaacatgtctcatatttatctacacttttaacatttccagtgctcctcatttctttgtgtaaatcccaatttctatgtagtgtcatttgtactgcctgaagaattccctctaatgtttcatttagcacagatctgccatcaattcatgttctctgcttttgtttgtctgaaaaagccttttttccttcagctctgagatattttttgctggttatagaattcagagttgacagttcttttttcttttagcactttaaaatgctattccattgttttttggcttacttatttttaacaagaagtttgtaataattcttttgttgttctgtgtataatatttctatttttttggctgtatgaaagattttctctttatctttggttttaagcaatttgtctatgatatgtcaaacagtgtttttaaaatattaattctgcttggtgttctctgtggtctgttatctttattaattttagaaattctcagtcattacctgttcaggcatttcttctgtgcatttctctctctttcctttttctacatgttaaaccaggtgatattttaccacagcttgtggatgctctgctcttgtttttctcattttttgtctctttgtattttagtttagataatttttattgtcttatcttcaagtcctctgacatattcttcttctgtgttcaagctgataatgagcccatcaaaggaattcttcatctctgatatattcttccttcatagcattcccattggacttttaatgactttctctctactgaaatttcccaacttttaatgtttgttgtgtatctcttctactggatcttttgttttgttttgtttttggagacagggtcttgctctgtcacccagcctggagtgcagtgatataatcatgggtcactgcagccttgacctaccaggctcaagctatccttccacttcagcctcttgaatagctgggactacaggtgtgtatcaccacacctggatttttattttattttatttttgtagagacagggccttgttatgttgcacagactgttcttgatctcctgggctcaagtgatcctcctgccttggcctccgaaagtgcttagattataggcatgagccaccatggctggctgaccttttaagactagagtcatagttattttgaagcccatgtctaatatttttacctgggccattcttaagtataatttttttgatgtttttatcctttgaaatgagtaattttgttcttgctttttgggctgtatcatattttttattgaattccagaattggtataaaagtatagtagaatgcgatttaaatagtattttcattaaaaatggatacacatgtttttgtgtcaagtaaacattcagaatcttaaagaaaaattgattaatttattctcagaaatgtgatatatagcatacaagataagaagtttgagcaataaataggtcaaaattgtgctgatgaacttcattaaaattttaacttcattaaaaattaaaattttaacttccttaaaaattaaaaataaaatatgtaattcaggaacatatatttctaaagtatcccattatactgaatattttagagtaacagttacaatggtatgtacatggcaagtaaaacagattttgaccttttcttgcaatagtagcaaaataataacaacaacaacataaaaaatcataatggtaaagtagcttatttacaaagtgaccaggagtaacattttatacccactctcacatgtaaagtgataagtggtacagaaaatgtattcagtgggaaatgtgggagagggtactccagagatagcagggagttataatggtctaggtctggacaatcacagcatcatatccctggattataatgattgatttgggaccggtcacagaactcaaacaaagactattagctctaacaagagctgttttgggaccctttgcagttagaactaaagttgtaaaaagataagactagattgacttggtgccattatgtcaccccaaagggtgagcctgaattaaaacagccaaaacacagaaaaatggagtgatggacagcaataagtttctgataatattatttaagtctttggattgagctatgcctaaagatctttttcagttataagaaccagcaaatgattttttcctatttttaaatgtaatttaattatttatctatgtttaaatcaacagataaaattgtatgtatttattgcatgcaacatgatgttttgaagcatgtatacattgtgaaatgactaagtataattaacatgtgcattatctcacagttatttttgtggtgagaacactttacttatactttcagcattttataagaatacaatatattaactatagtcaccacgttgtacaagggatctcttaaacttattcctcctatctaactgaaaatttgttatcttttgatcaacatctccccaattccctccttgcaatcaccttatcccctagtaatcaccattctactctctacttctatgagatcaacttttttagattccatatggtgagatcatgcagtatttatctttctgtgcctttcttaattcacttaacataatgtccttgaggtttatccatgctgttgcaaatgacaggatttcccttatttttttatggacaaatagtactccattgtgtatatgtaacatttttcttatccattcatccatgatgaacacttaggttgattccatatcttggtgattgtgaatactgctgcaatgaacaccaaagtgcagatatctgttttagatgctgattttatttcctttggatattatctcagtggtgggattattagatcacatggtacttatatttttaattttttgagaaacctccatactgttttccatggctgtattaatttacattctctccaacagtgtacagggttctcttttctccaaatcctcactaacacttgctatcttttgtctttttgataatagccattctaacaggtatgaagtgatatctccttatggttttgatttgaatttccctgatgattagtgatgttgagcaccttttcatatacttcttggccattttgtatatgttctttggagaaatgtcaattcagatcctttgcctatttttaaattggggctttgctgtgtttttgttttgctattgagttaactgaattccttatatgttttggaatattaactccttatcagatgtatagtttgcaaatattttctcacactctgtaggttgtcttttcactctgttgattttttcctttgatttgcagctgctttgtagtttgatataatcccagttatctatcttgcctttgttgcctgggcttttggttcatgttaaaaaaaataattgcctagaccaatgtcatggagctttctcctatgttttcttctagaagtttcatagttttgggtctaacatttatggctttcatccattttgagttgatttttatatatggtaggagataaggatccaatttcattcttctgcatttggatatccagttttcccaacaccatttattgaagagactgtcctttcctcagtgtgccttcttggtacctttgtgaaaaatcagctgactgtaaatgtgttaatttatttctgtgtactttattttgttccattggtttacgtgtctatttttatgccagtaccaggctgttttggttactgttattttgtagtatattttgaaatcaggtagtatgatggctccaaatttgtttgcttgtttgttttgctcatgattgctttgtctatttgggaccttttttgatttcatatcaattttaggattgttttttctgtttctgtgaagaatgagccaggcacggtggcttgctcctgtagtcccagcactttgggaggccaaggtgggaggatcatttgaacccaggattttgaaaaattagctgggtgcaatggcatgtagctgtcattcaggctgctcgggaggctgaggcaggaggatcctttgagcccaggagttcaagacagcagtgagctatgattgtgccactgcattgcagcctaggtgacaaaacaagaccccatctcttaagaaaggaagaaggaaagaaagaaagaaagagaaagaaagagaaagaaggaaaagaaggaaagaaaataaaaaaaagaaaggagggagggaggaaggagacagagaaaggaagaaagaaagaaagaaaaagaaagaaaaacagaaagaaaaagaaagaaagtcattggtattttggtagagattgcattgaatgtatagattgctttggataatgtggacattttaacaatattaattcttccaatccatgtgcatgagatctctttctatttgtgtcttcttcaatttctttcatcagtgttttatggtttttggtgcagagatcttttacctccttggttaaatttatttctaaatattttttgtagctattgtaattaggattattttcctaatttcctcttcagatagcttgctttttgggtacggaaacgctactgattttttttttcccaacaaatgatttttaacttagacaaatttacactgggttttatctcctttcaaaaaaatgaggctgatggaaaattcaagagtcaatgttttttttctaagagagaaacagaaaaataaataacctggcattagggtgtagtatggcctggagaaaagagatgctggagatcagcacagcagcaagagtcaggatgataaagagagagagagagagaaaaaaaaaaaaacactaagtaaccaaagataaagtactgagtgggaaaatattacttccaataagggaatctgatccagcacaaagtctgggctctggaggaaagaggcatgagaaagaaaaatataggatagctctttttaagtcaaagacatgaactgtttactccaaattagggcagtgaagacctgagttgcagactgtctggtgatatcttgcctttctgttaggtaagcactagggtggctgagctgagctgctgcaaatgtgacataaccggtttgggactatggtgtgcacctgcttgcgctatatgcatggcatgacccaattgagattatggtgtctttagttggcttgtcctagtggcagcaggtgaggtatccagatctgcacctgaaccgaggtatttgaataagtgatagaggagcaattcaaaaggcttttctgaaagtaagtcagtgagactggttgtgtgatggatgagggacctcaggaagagagaggagtaaatactgatgccaaggatgctagcttggactctggatgaacactgacatgtgtgactttgagtttaacaattgctaaactgtgatcaaaattatgggaggcattacactgaaaggcaaaactcaaagaaaactctaatatagtattagttgaaaagtaaatgggggtaccatgaagataactaaagccatatttggtatacatttaaaatgctagaatatgtcctttggatgtgctgtttgcatatagggtacacagaaggggacttttatcttgttaggttttatttcagatatataatggctctttttgttcccagtgaatttgggatgttctatgtgttgcttaatagtaaaatatttaaatgttaaattattagtatgcaatatgtgttagtataaatcaagtactttcattgaatctctgaagataaatacaaccatgtaatgtttaattttgactgtcttgcaaacgacctgaacatcaattaacaatctaataataatagtaactaacagtttttcatgctcaggcactattctaagtgctacacaatctggtaacctatttaatgttcacaactaccctacgaagcaggtacaattagttctcccatttactgatgaggaaaccaaatcactgggaagttaacttgctgaagtcgcatagctagtaaatagtagaaaccaatattagattctaggcagtctgattccagcgcttaaactcaaacactcatctttactggctacatgttgtatattcacatacacacacacaaaatttaacaaaacacttataaacaaagtactgtgagatctatagataagaacatccagtcttgctgttaggaaatgtggctgggaaaatagaatatttatatgaaaaagataataatagaagacagtgtgtaggaagtgacagatggatggcacagacaaatcactctgcagaggttgtagagaatggggcaggggtaggttacaggacagatggtcttaaactgatggataggacctacctgtaccatctggttcctgcccacctctctaaacttatcttcctgacattcaccaaattctagccacacggaccttctttgtgttcctcaaaatgccacactcttttctgtcccacggcttttacaattgttgtgtcttctgcctggaagactctttctttaaatcttggcaaggctgcctcctttattattcagaagtcagatcattgtgccctctgatatggtttggctctctgttcccatgcaaatctcatctcaaattttaatcccacatgtccagggagggacctgtaatccccatgtgtcaagggagggaggtgattggatcctgggggtgatttccctcatgctgttcttgtgatagtgagttctcctgagatctgatggttttataagtgtttggaagttctttcttcactcttctctgtgctgctgccttgtgaggaaggtgcctgcttccccttcgccttctgctatgattgtaagtttcctgaggtttccccagccatgcagaactgtgagtcaattaaacgtctttcctttataaattacccagtctcaggtagtatcttttagcagtgtgagaatggactactacaccctccttaatgagaacttccttggtgacccaaactgaaatactgcttcactcctaccccagtccactagcctgtttgatttcattcatgacactttccttacctgaaattatctacttgctaacctgcttatggtctgtttctcttcactagaatgaaagctccacgagcaaggatctatgatgcctgtcttgttctcatcttttttattttttccctcaagtagtttctgaagtttctacctcatctacacaatctttctgggctttaaaggctatgagggaatgtccctctttgacttgttttgaagccttgggcctacttatttgtatataagagaatatttttaaatggttctcttctttatatatttaaagcatgaaatgctctgaatatcaatgaacccaatcacatttgggtaatagaaaaggctgttttcttcatagttgattctttttttaaaaatttaatttcttatttatttattttgagagagagtctcattccattgcccaggctgaagtgcagtggcatgatctcagctcactgaaacctccacctcccaggttccagcgattcatacacctcagcctcctgagtagctggtattacagctgcacgccaccatgcctggctaattttttgtatttttagtagtgatggggtttcgctatgttggccaggctggtctccaattcctggcctcaagtgatccgcccgccttggcctcccaaagtgctgggattacaggcctgagccactgtgcccagcctgtagttggttcttttgaaatgttcctctcctttatgggccaagctgatagcatttgctttaccctctccatttcgtatatttatcagccatcaaaggcttttcttattgcttggaacttaattgaatgatgtttttgtttctttaccaacaaatgaacacaagcggctttcgaaaatactccaaaaaacagtgagctgtaggcaagattttattcttcatgtgtgatatattttggtaattaaggagtcaattctttggctaaatgctgaaagaaaaatgatgattattgtgtaggataaagctgtgaattatagaatactttcaactctgtttaaaatctaattaacattaattgttacattaattttccctgtgaaatttactaactgtatacaaaatgatatttaatcttcctaatggaggtctagtgtattcgtttcagtcctattcgtaggaatatgagttgaaatggcaaagttatagttatgttgaaagtaatgaagtaatttttatataaaactaatttattaactatcacattgtaattaattaaaacactcttacttttacacaatgttcctgtttttaaagtacttttgtgtgtgtgtgatatacatatctatatgtacatatatgtggattcccacagcgtcgtatgatacaagcagaaccattaattattatttatccccatacttatgtataatggagtttccatgaggtttaaaaacttcccctgtaacataaggatagtggatcatgaagttcataatttgtgaccttattaagttctaattactagggatacttcttgttttagtttgctagggctgccataacaaagcatcaagatttagtggttaggccaggtgcggtggctcatgcctgtaattccagcactttgggaggctgaggcaggtggatcacctgaggtcaagagctcaataccagcctggcccaacatggtgaaaccccgtctctactaaaaatacaaaaattagttgggcatggtggtgcgtgcctgtaatctcagctactcggaaggctgaggcaggagagaatcgcttgaacccaggaggcggaggttgcagtgagccaagatcgtaccactgcactccatcctgggtaaaagattgagtggcttaagtgatagaagtttcttttctcacagttttgggggttagaagtctaaggtcaaggtgtcggcagggctgactgcttctaaagcctctctccttggtttgcagacggctgccttctccctgtgttttcacacggacttccctctgagcatgtttatgtcccaatttcctctttcttataaggacaccagtcgtgttggattagggcctaccctaatgacctcgcttttgcttaatcacctctttgaagatcccatctccaaatacagtcacattctgaggtactggagattaggacttcaatttatgtattgttggaggataaaattcaaccataacgcttgtgtaaattgtgaagaaaacagtaattaatgtatagcttgttttaaattttctgagtgaatgagttaaagaggctatatgaaatagtaagtgctattttagccaagaaaattatgtctcagcacatgtggtttgtgtttcaaaaatatttcttgagtaaaatgtctgatttatctaatatttttaataatgctataacctttactattttgataatggtagtactacccgacatatattgagtcttaccatgtaccagactgttttaaacatatgccctgtattaacatatttaattattacaagcaacctatggaatactattattgccctaattttaaaaatatggaagctggccaggcatggtggttcacgcctgtaatcccagcactttgggaggccaaggcagatggatcacctgaggtcaggagttcaagaccagcctagccaacatggtgaaaccccatctctactaaaaaaaatttaaaaaattaaaaaaaagagagtaaactctgtgtaagaacgctaaatgacttgtcaaaggttctacggcaattaagtagcagaattggaatgaaacccaggttctcaggctctggaacttttgattagcaggccagtggttctcaatgggtggactctagtttctggctaagatggagtaagaggaaaagatttaccatccaatgtagaacaactaaaaaatgtatctaaatatgtaaaacaatggattgtaagacattggacttcatggaatgaaaggcagtgatccctgcgaggaaccatatagttgccccactttataatcgagagaaagagttcccaggcttgatgctcaggaaggtgatacctgacccctgcagcctgcagttggaacacagcactgagagtccagggagaccaatgcaatcagagtacagggaagaggacaagagtactctgcacagggagcgagaaagagcttcacagacagtcagagggttcccttgaatcatcagaggaaaacagattagtatatacatgtgcagaaactagccatggctggggaaagaactaccgaaggactagagggaacaattgctggaactcatctggggctggaatagttcctgtccccaaatcataactcatgggacattgggtagaatattcagaagaattttgactcggtggggaaaaattagccctacactaaattatgctagttccaccttaccaagcttaaaagaaagacctgaaagggtcaaactgtttccaagttgaagaggaaagggaataaacattcacgaattactgtcatcatcgtgaagggactctggatgtgaatcagtagctacacaagaaccttcagtgtctctgagcatgggaagatgaaaagatttgcttttcatgcaaggaatttaaatttccaatgtcatatatatgaggacaaaatacattagtgtctgagtgttcccagcacttctcctcttcaccccactgaaaagagtctatccacccagattcttcccctccacagctcttcagagagggttctgctggccagattggttcagaaagaaggtattaagaattaccagctgggtgtggtggctcacacctgtaatcccagcactttgggaggtcgaggcaggtggatcacgaggtcaggagatccagaccatcctggttaacatggtgaaaccccatctctactagaaatacaaaaattagctgggcatggtggtgggcgcctgtagtcccagctacttgggaggctgaggcaggagaatggcatgaacccgggaggcggagcttgcagtgagccaagatcccaccactgcactccagcctgggtgacagagcgagactctatctcaaaaaaaaaaaaaaaaaaaaaaaaaaaaagaattaccatgtgaatgatgaacacttcccagtgtttgttgataactgaagtaaagaccttgagatagtgttggaattactgtttggttgctgggtagtatttgtttacctctcacactactttcagatgggctatgttagtcatagctttaaccagattatagatttactgattggatagatgtttactaaaaattaagtgagcaaatgcaaggactagaacaacatagacaatatattctgatttttatttaaaagaaatatgcaaaaaacactataaaattttaccccaaatatacccatcagtataccaaaagtgtaccatgtatgctaacagccatataaaattactaaaaggatatataccaagctattggtaaaaggttatctctttcactggggaccaggattgggcaggtagaaggcagtaggaacatagcaaggagatcctttcactttgtattccgtatattgatgagttgcttgagttaaataaaacaagaattataatttgtcattaaaaaactaaatattaaaaattaccatcttcccagtgtttgcaatttttttttttttttttttgagacaagtcttgctgtcaccaggctggagtgcagtggcgtgatcttggctcactgcactctctgcctcctgggttcaagcggttctcctgcctcagcttcccaagtagctgggactacaggtgtgcccagttaattttttgtatttttagtagagatggggtttcaccatgttggccaggatggtctcgatctcttgacctcgtgatctgcctgcctcggcctctcaaagtgctggaattacaggcatgagccaccgcgcctggcccaggcttcaaaatttttaaacatttaactggaatagtaagtaaccaacaagcacttagaaagtgcctagtgtttatgattcctgccacctcagagagctacatttgtgttcaatcttcggacacttaaatgttttcaatgtatgtaaataattattgttaagattttcctaatttctttgttaaaatggttcatttcaaggttctttagagcttgcatttatttcattttttgtcatgtttcttttctcttagaataaaaaccagcagtcattttaattacccctgataatgttcatgaatactgccttggcctgtcttctggtttggaaccttttcaagggcgaatggatatttgtctggtgttccatgtataacctgtccttgtgccacttttccaatgtggcaggaagggaacaactgtcatctgttctgagaattcagcactgtgtctggcactgtgggaatttacccagactgctttgggggaagacatctgacacttcatgataattgtaattaaccagaaagacactggaattggaggatttgaagggaaatatgacaagggattaagactttgagattacttttggagccagggtgacttaagcacatttaaaaagttaggtttacttatatattattattatattctaaaccataagacattttctaataaggtttctaagaggaacatgtaaacctggatcaaatttaaataaggttactgaaaatattaatgaaaccaatgactgagcattttataaatgagaactgtattgctttaagttggagaaaagctgcaagtaagacaacatatttcttcatttgaaagcttgtgtccttatatgagggacattgacaaatgagtggtgataaaatggtggtctatgtgccataagggcttaggtacataaattaatgttttattaaccataaaaataaggttaaaaggttgaaatgtagccttcatgtgtctatgtaaaaaagaggcagaaaaaaatcctcagcactctagagaagcttagtctctgagcaatcactgcatatactaatatattcacatataatctagaatgaatgttaaataacaaaaatcatgttcgtttttatattttgctttgcctttgggatacgaagtgatggaacgagctcgttaacactgctcatttctggttagaagaacactagaaccacctagtggatttttcatttattgcatgatccctacactttactattgctaaattgttaattgctgagataggccttaaagtaaaatcagtggttataatctctttgtgggtcataatagaaatagtaattgttaatcttcagcagacaaagctgtccctaagtccttgaagggaagtccctgcccaccaaatacttaccaactagcacactgctgcatctagaaaagcacaggcagagttaaacatttggctgctgagatacaccgtgcaactggagctttaaatttcctgtgaaagtcagtgagcaaggtaaactgcagcaattcatctgcattcatggcagagtcaactttcggtgagcaagactagggaactctgcagagcacagccaaggggctacattagcagcttgacctttgtattcaatataaatctgtgggcacacaaactggcgtttctaatcaattttgtttttggagcaaagtagcttatgtggttacagcgtgccctggtcattctgtttcccattgctgaaccaactgggtctccgcatcttggtggtgatgacagatgttacgtatattacattgggatttgggtcagataaatagcaaatattctgggaaaggatactttatgtttttgcaaaaggttataaaataccaaactttagtaaaccctgattctaggccaaaggttaactctttatatctatgatttattaggtatcaaaagaaaaaagtcaggatctaaggggaatggaaaagtttctgctattctaacctaagagctggttgtcttctcctagtaaactaactgttcagcagatgggatgcatcgggctacaaggttggtgctttccagccggcaccgcgtgtgaagggcatgtggttgggctgggctctccaagtctgcatggcttgggttgactataaccaggggaaacacgcagtggctacaactgcttctcctaacaattctcgtttcattctcttctcccacagtgtgaaggaggctaggtggatattctctggggcttgaaatttcacactgcaaattttacgagagtgatgatctcttcctaactctttagaagccaagataggaaaaatttcagtttacaagaataaagcccaatccctcttcttatgttggaatgtccagtaaaatgctaagaaacgggtgggtagaagaagaggaaaggaagaagagaaacagagaggagagtaaggaaaaaatagaaaaggcagaaaaaaataatgtacatgaacaacaacaaaaatagtgacaaacagaatggactatagagataggggagggtagtgaagggcttcagagaagtcaggtgaagggccttcttttcttttctttttctttttcctttttttttttttttttttgagatggagttttgctctgtcatccaggctggagtgcagtggcataatctcagctcactgcaacctctccctccgggttcaagcaattctcttgcctcagcctcctgagtagctgggattacaggtgcccaccaccatgcctggctaatttttgtacttttagtagagacggggtttcaccatgttggccaggctggtctagaactcctggcctcaagtgatcctcctgccttggcctcccaaagtgctgggattacaggcatgagccaccgtgctcggccagggccttcttttttaaagaaaattttattatgctgtgataagaacacaacatgaggtctaccctcttaaaaattgtgtgcataatacaatactgttaactagaggcacaggttgtacagcagatccctagaatttattcatcttgcataactgaaacttcacccctgttgattagcaatttcccatccttgcaccccagtccttggtaaccaccatttattctactctcgcattatgtgaaatggactattctagatacctcctcaaagtgcaatcttgcagtatttgttcttctgtgactggcttatttcacttagcataatgtcatcaagtttcattcctattatatatgtcaacattttcttctttttaaaggctgaggctgagtaatattccgctgtgtgtgtgtgtgtgtgcgcgcgtgcatgtgtgtgtgtatataatattccaatttacgtattcatccattgatgaacattttggttatttccacatcttgttttttttgaatagtgctgcagtgaacagtgggatactaatatttctgagatcctgattttagttttttgtgtttattttttttgagacagggtctcgctctgttgcccgggctggagtggtggcgccatctcggctcactgctgcctcaatctcctgggctcaagtgatcttcccacgtcagtctcctgagtagctgggagtatagaccaccatgctcagctaatttttgtttattttttgtagagacgaggtctcactatgttgcccaggatgatctcaaactcttagactgaagcgatcctcctgtctcagcctcctaaagtgctgggaatataggcatgagccaccatgccaggccccagtttcagttattttagataaataccgaaaagtgggattgttggatcatctggtagttctatgttttcaatatttttaatttttcccagcttttttgaggtataattgacaaaaattgtatatatttgaggtatactatgtgataatttaagttgtgaaatgattaccacaatccagttaattgacacatctgtcatctcacataattaccatttgtgtgtgtgtggtgagaacatacaatatctactttctgagcaaatttcaagcatgcagtatggtattattaaccgtaattatcatgctgtactaatattggatccctagaacttaattcatcttacaacagaaagtttacatcctttgctcaacatctatttctcctacctctggatctctggtaaccaatttctactctctgtttctaagagttcaacttttttagatttcacatataagtagaatcagacagtatttatctttcttcatttggcttatttcttttagcatgatgtccttcagattcatccatgttgttgcaaatggcaggattttcttctttttttaaagactgaataagattttctttttatgcatacatattgtctttatccattcacctgtgatggacacttaggttgtttccataccttgactattacgaataatgctgcaatgaccatggggatacagatatttcttcaagatacttatttactttcctttggatatagacccagaagtgggattgattttattatatagcagtgttgttcttcactttttgaagaactgccatactattttccatagcaacagcaccattttgcattcccacaaacagtatgcaagggttccaatgtctccacaacttcaccaacacttttctcttttcctcggagctttttgtctgttaaaccccagcttcccccagcctgaagcatagttgacaaagattgtatatatttacagcgtacaacatggtgttttgatatatgcatacattgtaaaatgattcaatcaagctaattaacatagccgacacttcatgtacttatctctctttttttttttgtgatgagaacattggctttttgatagccatcctaatagatgtgaggtgatatctcattgtggttttgatttacagtttcctgattaggtgatgttgagcatcttttcacattcatgttggccatttgtatgtcttctttggaaaaatgtcttttcaggtcttgagccccgatttaattaggttattagtatttttgctcttgagttttaagagttccttgtatatttcagaaattaaccccttctccattacatagtttgcaaatgttttctcccattctatggtagtttttttcattctgttgtttcctttgctcacagaagcgttttagtctgatgtagtcccatttgcgtatttatgcttttgtcgctgtgctcttggtgtcatatctatgaaatccttgccaagatcaatgtcatgaagattttcccttatgctttctcccagtggtttcacagtttcaagtcttacatttaagtttttaatctacttggcattgatttttgtgtacagtgtaagatatggatccaaattcattcttttgcagttggagagccagttttctcaacactatttgttaaagaaaccatcttttgcccattgtatattcttggcacccttgtcaaagatcaattgatcatatatacgtgggtctatttctgggctcctgattctgttctattggtctatagtctgtctttatgccaataccaaagtgatttaattatggttgctctgtaatgcattttgaaatcaggaagtgtgatgcctctagctttgttctttctcaaaattattccggctactcaggggcttttgtatttccatataaattttagaattgttttgcctatttctataaaaaatgccatcgagattttaataggaattgcactgaatctatagattactttcggtagtgtggatacttccacaataataagtcttgcaatccatgaaccaggatgaagggcttctatatatagggcatcagttctcaagattggctgctgggcttctcagagcccatgaagataataatgagacactgttagttaattttaatattttaaagtttgatattctatcttttaacgtttacaggaatttgaaattgtatatttatgtgtgtacctatttgtttcatggctctatgaaggcaggaccatgtctcttttactcaccacagaacaactagcaccactgttgtgcagtagagcctgatggttagagctgcacgcatgggcagacctcccggtttgccatcctgctgcgaccactgactaccaatggcacatataccaccaattggctaggctaacaaacattccaagccccattttgccttgttgccttccattatagaggcttgtacaagaaaaaaaaccctacattttactttcccactctcatgctgctgggggatggtcaaaggacacagacttggccaatgaggggttagcagaaagctggcgaaggattctggaaaggctttgaattcctgctgaaaaggaaaaatgcagttgacagatgacactaccctctctcttcttaacttaaacgtggatgtgatgcttggatataggtccgccattctgtgcttctgagggaaagagtcagtcaattctcagagggagcagctctaacaccgtggagccatggaatgaacactaggaacaaatgacctcccagctgattgttatatgagagaaataaatgtccatttgtttcagccactgtacatagggctttctgttctttttcagcaaaacgctcctattacagcagttttgtgacttcaagcaagttactttactctgttttaatgttcccatttaaaaacagggattataccaatatcgtcctcatagggttgtttgaaagactaaatgagataatatacgtaaagagcacagagtaagcactagatagggataaattactatttttattactattttgatgatgggctcttaataagtcttagatgaataagtggagtaggtcaaacccaaagggtatggcttcaacccaaggcaacccaaggcaacccaagataactcatttttttctgtttgagaaaaatgagaaagggtggagaaatgagaggaaggtggggtgcggggaaggaggcagggctaaagtggagccaggtgggtgctgggtgggggggaaaatgccctatgaaaatctcccatggtgaatggtcaatgtgttggggccaacatattggccatgtgtggtccaggcatgccagtatcaacagacactaaataaacattttttttttttggctcattgaataaatgaatgcattgtgagggtgttcattaacaaagaaattgccatctcatccttaaaactgaagagatagaagtgagagggcagaaggtttttctccagtgtcactcgcacacctattataatatttgcctggaattatgtgggtgaagatgcattgctcaataattgcctgtgccctcgcaaggagcagaggagaacatccggtgggagcagaagcagaggcagaaagaacagatttcccacggagtaaaatattctgttctcataaaaagtcccttgctgtaacaaacgagaaaatgaaaaggagagcctgtagaagagaggcagacacctcttaataggcacatctctccaaagtttcccaccaggggccaactgttcattaaacagggaacaaatgcgggagcgtagctgtgatgggctccattccacagcccagtgctgggactgcagtgcgctaggaagggcgtcgctgttgttgctgtggcccggtgtgacagcaggtctggcatgtcagaatcgccctgcacaaatagctcctgtgcagctgctctcacccaaacctgctctgaggaggctcagtgcattctaatccttcctaaaaacatggacagaaagcaatggaaagttgacatgtataaaaggtttagtcatggggtttttaagtggatgcctccatgaaaggatcaactcagatggccacgtttctgaacattatttacatcaaaacctgacataaatgcctcagatctagctattttcttcctctatcctctttttacatgtctccttttccctctcgattgctttagcttgtaacctgcatgcgctttcaaatgtggtaagcaaatagaaagcaagacgccatttgaatagtgaatggacttgtattcctgtttaggaatgtgtagttgcccttgggctttctcagttataagactcataaaataaaaccttaacacagatggaacacacacacacacacgcacatgcaccacttaaagcagatgtgagtcaaaaacatatgctgatgaactcaatttgctgatggcattctgagcagtgagcccactcagtagggctgaagggttggcatagcaactcttcctgggaaaaaatagacagctggaataaaccatgacgatgaaagtcttcttccaatgactgaagaagtagagagaaattgccatctcttctaaccccttcaagcaaagcaccttggttgaggtttatagactaggatcttacaaattagaagttcatgtattttcctaggtcagattctataccttgggttatattccagctaagaaacactttcagataggctgcatggggctgtggggaaagagagagcacaaacctccaaaaagcatggagctttgaccaaagtttatttctgtaacttatcctaaggctatgccgagtgaagacttgtttactctagctgtaacttactccatcacatagcaccattactttgagaaattaacatattcattctcaattatttatcaagtatccagcactagcaatagggacacagtccctgcttttgagggattcatgactaggcagacagcaccctgagtatattaattaagatctgatcccatattagaataatatgcacaagagacttattacctctgtctcctcattcctataaacatttatctgggacctatcttatgtggactgtgctaggtgcaatgccaagggataaagcaagttaaatggcaacagtcctattcgacaggccagggactcaggatcagactcaggaccctttccctcttgttgcaaatcctgctatgtgtgggctcagccccaaactgtctctgaaatctcagaaatgagcaaaggctaaggatgtcaaattggctttgagatatgcctgtagactgataacaatagtgatgatgacgatgatattagttaatacaataaagctaatactgtgctattattaccaggcactgttctaagtactttaaataacttatttcatatactcttctgtcatttagtatgcataccattattctccttcccattatccatatgaggaaagcaaggcactgagttaaaacgactcacctttaactgttcatctatcaggtaagctaaccccggagcctacataaattcttaactattaaataagctatgccacttctcaaccactctgctgaaaactatacaaactgacaggtcctacaattaaaacccaaaatagatataataaagcataaaaaatcagttaggaattttctcttgcttttgctctgctgttattgttgttctccagataagtcccattttaaaatccacagtcaccttaaggatgtgatgtgggagctggagctgtctgcctacccaccagctatttttaaaggaagatgatcaggaactagttatgaaagaatcagattgtttaatctggtaccacagaacttgagaaactatagacttggtaagttggaaaatatgtaggcagaagtgatgtctctatggaaacagatgtgaagattcaagtaaatactaggcctgttggactttttatgaagatagcagaagcttttttccccacttcttcttctataacctgtttattgaggaatctgaccatggtgaggaacaagctagagacatatttttatctctagtcactgcttccaactctgctatgtcgaatctcccaactcttctagacatctctcaatgacatcttggacaggaaccatagtcacttacagtctagtccagccttatagcatatgcaactgcatatccagttcaagattttccattgctccattgatggctacacttattactcaaggatctactgtgggtgtgcttaggggtaactctttcaccttggagagtggtgtgggaatgttcttgttctagtatacttcatcccaaagacccaattcctcctgttttggggactgggagagaagatgagatggcttaatgtctcttggctttctctattgcttttgctgtctctctagcataccctagcgaccactgagactcttgtggggcagagatccacacgttatctatcttagggacatgatgggttcttcgaagtccctcatgagaggcgtgactctggctcaaacatgttcagcccccttcagctgtccaagcccccccaccctctatcagctctaactacactgcttgcatttttctttcctggtgggctgctttactggcatgtggaggagtgctgatatagcaggaagagttttgctacttcttattaagtcctgaaaaggtatctggtgggtgctgtgtttgtaataagatacttagcacctgtttcccctcgagctttgggcctaggtatcagttctcagacaaaaggaaaagtcaatttttataccctattataatgataaactttgattgaaactttggggataagaaagcatcgagatgtttctctctccttctattcctcttttctcctccctccctctctccctccttcctttgctcccttctttccttcctttctttcttccaaatagcaaccatgtaatctaaattatgaatgataaaaaagcctggcaaatcaatgagagaacttagagcaaaggaatttggaatattataagatagggaacaattttagtttcctgagcattttggttgtattaccacctgctccaatcatagactgtactttttcatgcccagaaaagacttctacaacccagccttcatagcaatcagccactcgggactttcttgcagtctgagctcaacctgtcttattttgctctgagttttccagttctgaaggcttgattactggtccaagagtgtcatttaggtagatatgctgaactcacatcatcctcgttacaaattgttatggaaaatcccaaaaatataaaagaaaaaaattttaaaaactagctaagggcactgttcacatgctgcaagatctcacggaggagaagatggaatgagtggaggatacacttgctgtgtgttcatcattgaagaagggaaagagcttgtgaaatgacccctagcagaaactcactggtgctttcaagttcagggtggcagggttgaaggtgagagttagcttcagggaagatggtggagaagaatgtttgctagtatctggaccccaaaggattacacaggatgctggagcctgcatgggctaggaataccattagttcaatcatggtctacacttggcaaggaagatgcattgagaataggtgaagggcatagtcaagaccaatgctaactgtcattccttatggaggaattatggaatctacttcaggctgccatgaaaagcaaagcagagaatctgttgggacaactcgttcagcagcctcagactacagctgcatctttacttatctaggcctctagatcactcagaagtaaaggaaaatttaaacaaatctaaacattctcattctttcactggggtcttcaaagttttgaacacaatctctcagaagaatcaatttctgatacctgaatctttgtaagcacgaacagagagaagggactggacagatgaaaaggatttgtagttcaaagaagagggccattgtggggaactgatgctgagctctcggttctatgccccccagacttccttcttcagttacggtccctgcagaatcagcatccatctgcgactctcctttattcattgaactccttgttttggagaggagaggcatattttctactttatgtagctctccagcccatgatctcctgtggtcaggggctaaggattcctttccctgtttcctagtaatgcataactctatctctccataaggcagggtgggccaggcattcagaaagttggggaagctaggcagaatgtgaaataagtgaagggaattgaagggtgctggaaaacctcccatcaaaatttcctcccccatgttattccaccattaggtaattagctccctggttcttaaaggattacatcacttttctttgttaagagttgagtcatctatgcaaaaaaaaaaaaacaaacaaaaaacccaaaaactgagtgaattaaaaccagaatccttattagttattacctcaggagctttaacagtgtcccacttcaattagagcaaagctcactgggaatgtgtgtaggataaagaagatgttggaggtaatagacattaaggaaggggccaggagcgtggagggaacccaagagacgtgggaggatctcaaaagtgatctttgcctattgccaactgtgactgaggccctggcccatcatttgatgttctctgtcattcttgggagaggcagaggagtgtgatgattaagagcatggactctaaagctagacttctgggttcataaagggtaacagcttagctctgccccttcctaccttggggactttgagcaaataatttaaccgctctgtgcttttttcttcatttataaaacaggagtaatattggtccctgcctcaaagggttgttgtgaggattaaaggagttaacacacataaaatacttagaagagcacatggcatagagtaaatgctagttgttattagtatgctttcaatttcacaaagggacttaaaaggtcagaacccttacttactcctaggaaccactggggaaggagtgaggaccaacatatattgcatatgtatgccccagatactgtatataaaatatctcattgaaacctcacatattgatgaaataggtattacaatatccctattttgcaggtgagaaaactgtgtctcagagggtgagaatctggcccaaggtaatacagctaaaaagtggtaaagttatctatgatatcccacaatgttacttacacagttctctttggaaataaaaatataaacaaatggtacaggcagattaagaacaactccagcattattattattattattattattatttttttttgagacagggtctcactctgttgcccagattggagtgcagtagtgcgatcatggctcactgtagccttagcctccctgggatcaggtgaccctcccactttcaagtagctaggactacaggtgtgagcttttgtttttttttttttttttttttaatagaaacagggtttcaccatattgcccaggctggtcttgaagtcctggcctcaagtgatccacccacctcggcctctcaaagagctgggattacaggctccagcatcaaatgtttacagtagttgtcctcacagaaaatgcatacataactcttatcttcctgactcaatgctcaccttcacctcccaccctgactgcagcctattatccctgcagtcagtggacttttaatccagataccttggctgagcaggctcatagaggaaactggcccacagaaactgtgagaaataaatgtatgttgtttgaagctgctaaatttgtggtaatttgttatacagccataaaaacgaaaagaccaaacagtcatatcctgaatgattaaaaattggttgcataagtaaaagaatgtatttgagttggaagatttggggttttcacatgaaaaaccaagtgtgagtaaaataaccgcagaatagctattttggaattctgatactcaaacacttgctagttgaaggagtgctaagattatggatataacaattgattctagggtttcaaaacttatttcccataacataggaaagctgaaactctggctataaagaaaaggctatttttctttctcttgaaataatttgtactattcattgcactgtcaatagccaagaacatgctagaaattacaacgtgctcgcacatatgggtatttctgctatgatgcaacatatatgtttctaaaattcattttgttttgcaaaatcaaccaatagaaaaacaaaggacttataagaaaaatagggttggggcacaatagtcacaaactgtcagtaacacaaaacaaaaagataaaatctaatcaaattgtggtagcacagtcttacacaagtcaaatgggtaagaaatatgtaaatactacaaaaataagacactttcctttgacaaagactttacatttgcttgtggaagtgggagtcagagcattgcagcttgtgagtttttgtgaaattgtggaaggaaggtgatttgaaatcaagggaaagttgtatcactgatgtggatggatatggcccatgttgagggtggtggactgaggtagctgacatgtttcaggtacgtgcatgtctgttttgtacatcttacctggctgggttcaggtgtgtgcaattttctgtgtttccctagtgtttttcatagactaaacagtgcataagcaaccccaaattcgtgttatgctcaaaatgttctctaataaaatcttgtgtcttgaaaacaagtgttaaaaagtaaaactgaccagatgttatttcatttgaatcttacgataaaagcaataaatagacatgaggaaacagctttagacatagagctagtaaacagtcaaggcagattgaactgaggtcttcctcctctgtgcttttcccattaggccactccaggaatgtctcagtctagcatattttaaatctgtgtgatgctatagtttcactactgcaatttctaagactttatattttcaattagacatttattttactaccaagaagtatcctgatccagaggtactattctcccagccatggagagttcctccaaaagacaaaattctatctttgctaatgaaaatgcaaataaaactgtatcaagagtttcatgattttactaggtatttcccatcatatgtttatcatacagctcaaaattgatgtcaagttttttactctactcttttctcaagttcattcactataaattgaatttcatttttctgcacttgggttgtattttttgaaccactgactttgcttatattagttttactatgatattcatcaatttgtttaaaaaaattcagaagatacctcttgcacaaattcattttataatttaagaactcacttcagaatgttgagactctgttaagtatcaattctaggattatgaagatcctgtctaccacaaagagccccacaaaggtcttttctccctcattcccaagcagtttaacttaatgaattcttctggtagaactttgtttagacggacttaaagcaggtaagagttctttttaaaatacttgtggagtgcatgagtgtgcaaacaaacttaaaagcacatattggctcaggaaagctgaggggaaatgataattttcaacagtccaaaatagccatcctggggcttacagaaagtaaggtagcaattagcctaactctaagcctaacaataacacagtcattaatcctgggtgcccagacacattccattagaggattttggcaacaaaattttgcttttctaattctgagtagatataaacaataatcccttaatttattagtctgtttatcacacttattaagcatttcctatgtcttaagaactgtgccacaagacaaggatgccctctcttaccactcctattcaacataatatgggaagtagacataaacaataattccttaatttattagtctgtttatcacatttattaagcatttcctatgtcctaagaactgtgccacaagacaaggatgccctctcttaccactcctattcaacataatattggaagttctggacagggcaatcaggcaagaggaagaaataaagcgcatccaaacaggaagagaggaagtcaaactacctttgtttgcagatgacatgactgtatatctagaaaacctcataatctcagtccaaaagcttcttaagctgataaacaacttcagcaaagtctcaggatacgaaatcaatgtgcaaaaatcactagcattcctatacaccaacaacagtcaagctgagagccaaatcatgaactctcattcacgactgccacaaaaagaataaaatacctaggaatacagctatgtagggtggtgaaagatgtctataaggagaactacagacttacaaatcactgcccaaagaaatcagagatgatacaaacaaagggaaaaacaatccatgctcatggataggaagaatcaatattgttaaagtggccatactgtccaaagcaatttatagactcaatactattcctatcaaactaccattgacactcacagaactagaaaaaaactattttaaaattcatatggagccaaaaaaagaaaaaaatccagaatagccaacacaatcttaggcaaaaagaacaaagctggaggcaccatgctacccaatttcaaactatactacagggctacagtaaccaaaacagcatggtagtgacacaaaaacagacacagagaccaatggaacagaacagagaatccagaaataagactgcacacctacaactatctgatcttcgacaaacctgacaaaaacaaacaatggggaaaggattccctattcaataaatggtgctgggataactggctagtcatatgtagaatattgaaactggatcccttccttacacgatatacaaaaactaactcaagatgaattaaatacttaaatgtgaaatcaaaaactacaaaaaccctggaagacaacctaggcaataccattcaggacataggcatgggcaaagatttcatgatgaagatgtcaaaagcaattgcaacaaaagcaaaaattgacaaatggggacaatttaagctaaagagcttatgcacagcaaaagaaactatcaacagagtaaacagataatttacataatggtagaaaattgtgcaaagtatgcatctgacaaacgtctaatatccagcatctataaggaacttaaacaaatttacaagaaaaatacaaacaactccataaaaagtgggcaaaggacatgaacagatacttttcaaaagaagacatatatgtggccaacaatcacatgaaaaaagctcaacatcactgatcattaaagaaattcaaatcaaagccacaataagataccatcttacaccagtctgactcttactataaagttaaaaaataacagatgctggtgaggttgtggagaaaaaggaacacttatacaccgttggtgtgagtataaactagttcagccattgtggaagacactgtggccattcctcaaagacctaaagacagaaataccactcaacccagcaatcccactactggttatatacccaaaggaatataaatcattctattataaagacacgtgcacgttgcatgtgtatgttcattgcagcactattcataatagcaaagacatggaatcaacctaaatgcccatgaatgacagactggataaagaaaatgtggtacatatacaccatggaatattatgcagccatataaaagaatgagatcatgtcctttgcagggacatggatggagctggaggccattatcattagaaaactaacacaggaacggaaaagcaaatacctcatgttctcatttataagtgggaactgaacgatgagaacacatggacacaacacacactggggcctttcggagggcagaggatgggaggagggagaagatcatgaaaaataacttaatgggtattaggcttaatacttgggtgatgaaataatctgtatgataacccccatgacagaggtttacctatgtaacaaactcgcacttgtacccctgagtgtaaaataaaataaaataaaaagaactgggtgccagatgttgaaggaaaatagtaagatcttaagaaaatggctttggccgggagcagtggctcatgcctgtaatcccagcactttgagaggccgaggtgggcggatcaggaggtcaggcgatctagaccatcctggctaacacgatgaaacaccgtctctattaaaaatacaaaaaattagcctggcgtggtggcaggcacctgtagttccagctactcgggaggctgaggcaggagaatggtgtgaacctgggaggtagagcttgcagtgagctgagatcacgccactgcactctagcctgggtgacagagcaagactccatctcaaaccaaaaaacaaaaaacaaacaaaaaaacacagcttcaagtttgtagatctatggtcattcagtctatgacactgaacacttcctttagtagctcacttgttgaataacatctagaattaaataggagaaaaaattttcctaatagaactataccaggctttacatgattggtagtcttcgttcttcacaaaccagtttattttaatagatatctcaggtagagttttatgaaggcctcaaagcaattaaaacttcatttgcaggaaggacaatcttatacttaccagaaaactacagctaacatgaatttctttgttagacatttgctatgaaggatctttgagaaaattctgtgttagaacccatgacacccctaacatagctatgccattatttttttcttcttaaatgaacagatgagttttgtaagcaaagtaggataccatgattgatagacctttttgtaaagtatactcagatttgctgaaagagcctacataattcagtctgggtgcagtggctcatgcctgtaatcccagcactttgggagactgaggtgggtggatcacttgagatcagaagttcgagaccagcctagccagcatggcgaaaccctgcctctactaaaaatacaaaaattaaccaggcgtggtggcacatgcctgtaatttcagctacttgggaggctgaggtaggagacttgcttgaagccgggaggtggaggttgcagtgagccgagatcatgccactgcactccagcctgggtgacagagtgaggctttccctctctcaaacaaacaaacaaacaaaaaaaacaaaaaagaaggagattacataactcaagaaaaccatactcgaagcctctctttttaaataatttttatctcaaataagggaaaaatcaaaatggaaagaggttatgatcagtttcaccattggcctacagtattgcttcagagaacaaaataaaagggttcttgcctctccccttgctggaactgggcctgccccagggacttggctgtagggttgcaggtactttccctgtcctttgatcttaatcaccaagggagcaattaaagttccatgtccaggaatcacttagtaaagagtcttgcttttagttagagagttgaaggggttgtgggcaatatctaaatatgctttggacattgtatttgatggggttgagaaataaaaaaaaaattctaggctcctaactaactgaatggattcccctcttggccaagggtgaaactgcctttgcaaaattattacacaaagagaaatctaacatagttgactccatcttgcttctgacttccaagctgtccttggtcattcctgggtgtaggccaagctcactttgggaggaatttagtttatagttttaccttaaaacaaagatgataatagcccttctcaaaactaaatcacctttgtaaaactaatggaaaggcacaaggttaaaattatgagagaggcccgaattctgataggataggcatagtttttatcagcccttacagatcaggaatcatgtgaccagaggtcacaagatttgtgaccttcccatttactcctatagttaacattgctatgttagaacccaagattgtattttgtgggggatgttttccagactgatcctacctgaacttgtgattcatgactcaattgatcctatggcctcacccagaggtagactcagcatacgaagactgttttccataccagtatgattccatccctaaccaatcagtggcacccattccctagccccctgcccaccaaattgtccacaaaaaccctaagctccaagccttcagggagactgatttgaatgataactccagttctcccacgtgagttagctttatatcaaatgaactctttctccactgcaatactgtggtctcagaggattgatctggtctgtgcagtgtacagtgctgggtgattaccagagaaactcgggaagctgagttcatggccttggcgggatgggaggttgaactagtctcactagtatgtaatcacttgtctcactgctgtcccctccccaccttttttaaaggaaaatgtacaaatagtaaacttcctgagaccctctttggaaaaaacagccatagatgcatctgtgacttatgtttttcctggacatgccctcaagctggctcgataaaccttgatgactgagatttatgactcagtcactcattttgattgtcacagtataaagggcctgctatggtctgcatgtttgtgtctctccaaaattcacatgttgaaatctaatctcaaatgtgtgggcattcagaggtggggcatttacaaagtgatgaggtcatgagggtggagcccttgtgaatggaattaatatccttctaaaagaggcccaagggagcttgtttgccccttctgtcatgtggggacacatagtaggcaccatctacaaggaagggtcctcccccagacacggaaactactgttggtgccctgaccttattaattatgattgagacaatcaaatatggtctggctaagagaagaatagtccataacattttgatgctgactccctaaagtctatgttttgaaatattgaatatttaacatgaagagcaaattacaattaggacgtcttaggtccatacaaagtaatattctatggactgcctttggaattactaggtttggtcttgggatcagattgaatgaactcagtatagattctgtgtcacttctactcatgaaacacatttactgatggttaatctaagagtatctttaggctaggtacagtgcctcacacctgtaatcccagcactttgggaggccaagacaggcagagcacctgaggtcaggagttcaaaccagcctggccaacatggtgaaaccccatctctactaaaaatacagaaattagctggatgtagtagagggcacctgtaatcccagctactcaggaggctgaggcaggagaatcatttgaacccgggaggcagaggttgcagtgaactgagattgcgccactgcagtccagcctgggtaacagagtgagactccatctcaaaacaaaaaaagtatttttatatatggcaacatgttgctatatagttatgaaataaagtgttgacaaaacttgactgaatgtaatcatagtgaagccaacgttatgtgtcatatgtcacctgtgcctgttttgtcacaagtgctctttacaaaccacttagcatcttcactttgaggttgtatgctcttatttaatgctccatagagttttgagattgttgtgagttttctattcaacattggcttctccaaagatttgatcattttttaaaacagctgtaaacctattcaaaatttatataacatatatttaaaatataaggacgctttctgatttcaaatgcatctcatgcagttaataaaattggtaattggtaatttagagtcacagataactctaagtaagtcaattaaaactgtgtaagaatttgaaaagaggatacagggcattgaggggattgacatttggtggccaagtcattatagctattgtttggaagaatctgatgatattcaaatgatcaaagcaagtattttgaagaaataaatgatgtgaaataactgataaagagatactttaaactgacattatcctacacttaaatataataaaaatacacagtaataaagcaaaataacagatttgttgtttggctacaacatcaagtcattctcaactacatattttgacaatagtgactctaaatattttctcaaactaagctttcctaaatattttcccaaaccaagctgtttctttacggactttatatgcattaattttatatgaatgactatttttctaacataaaaacaatctttacaaatattttgagaattcaggaataaaactaaagcattcaaatgaccactgctcagttgtacttgagagattttgcccaaaattatttaaaagtgttgaactgtagaaggccttaaaatagaacttgtagaatttcaatattcagaaagtaaagtttgttactatgggtcatactgttgtgaaaaagcagaaaaagaattcagaataatcaaattgaaactattttgctgatataatcaaatatgcctgatgtttgttgtggttttaaagactgtattttctctttggacatttctccatctttctttttttttttggtgtaaaatatacacaacataaactttccctttttaactacttttaagtgcacagttctgtggcattaagtacatctacactgttatgcaaccatcaccatcatccatctctggcactttttcactattcccagttgaaactgtacccattaaacaccaacttcctatttttcccttcctcagcagtcaccattctactttctgtctctgtagattgactactctaggtaccttgtacaaatggaatcatataatatttgtccttttgtgactggcctatttctctattgttttactaacataaaagtattttatctgttattaattttatctagtcagaaactggaaacactgacagaatctttggctgattaattacactacaattgacaaaatactgcccaaacataagtgatttactaaaatatgggacatgatgtttaaaattaaaaacctgatgaaactgtagtgtcagtctcaattgcagttgtaatatttttcctatagccaatgattaaaatgtgcatttgttagtgattttaaattaatttatattaaatttactattttcccatctaaagcagaattaattggtcatttttttggcacatgaattaaaacatatatacactgtctttggtttgctaaaagaatgaatgaatgatataaaggcatctcatgtagaaagatttgttcttgttaattagcaggtttattagaatatggtttctttcatctgaattttggagattggaaaaacaatctccaaaatataaagaatgcagagaagtgcaggagaagagagaatggtaagctaaaaattaccatcaaatgctaagtgtcagacctacacaaacacaaaatttaacatacttaacagtggcatgttcagtgaatatgagcaggagacatgagctcaaatctaatgatatctatgatgccagaaactttgtatatgctgaatttaatccttatgacaactctctgagtcatataatttccccatttttgcagatgtcaaaactgaaggtaagaaacggtaagaaatttgcctagtctcaacactagtcagtgtcagagccagaattccaattcatgtctacatttccaaagcccatgttgttcccatgacacaaaattgtagcatgccttacacttattgacttgggagagttttttttcttaaaaatatagtatcaatataattttagcaaatcttactgccattagaaattggtaacatttatttgaggatagacttcaaaatctttatgagacataagaaaatgaagttccagaataacaggaatttgaatggtagttttcacctttcagaggatggttttttgggggtggtaagaaacatctaagtattggttctcatttgggggcatgcttagaggcatcagtagtttctggtaaagtaagggtctttcaaaagaaagacaaatgaatgatactgtataggtgcagttacatcataggcaccacaataaggtataaaagtaaagcattatgactttcaccttgggaaagaactttgaaatgaggaaaacaaaattgcccaataaaggtgatattttataaccaaccagtgtggactagtggagcataaagtttctttaaagacacaaaatagctgtagcttggattgcacatgtggatacatcaaaataaatatgtgtcaatcaaaagtaatatatgagagtttctgctttggcacattctaacttggtgttatcaaccatttacatttttcataagctaaatagtacgaaataatctcatacagtggttttaatttacagttttctaatgactagtgatgtggagcatctttttatatgtttatttatcatttgagttttctcttctgtgaactgacagtgcatatgttatgcaaatatccaaccttcaatgtccaattttgaagtcttctaatagatgtgaaatttgtgtatagattcttttgaactctacctagacaacatgggagagacggagatgcttaccaaacccattctcttcttcccaggcacacagttacagcgtgtttccccatctctcagttgttttgccatgtgacggactgaattctagaaaatgtaatgtggacagaaatattgctatacctattccataaaacttcccacaactgaaccttcattgtgttttaccatttaccagctggttggagaggatcaggatctaaagggggtcacaggtgagacgagtaatcatgtgaaaggctgcacaacagagaactcccacattggactataatttgaatgggaaattaatctattgggttaagccactgaaaatttgaagtttatctgccatagcagctaatattgtcattaactaatatacactatgtatcgttgtgaataatgactattttgtttcttcctttacaatctctatactgtttatttcccaggagttgacattttattatgttttgtttctttcttttcacttccccgccgtgtcacctaggaactctagttcaatgttgaataaaaaattttgaaagtggccatctgtgttttgttactgaatttcgagggtatgttgaagtttctcttttaagtggggttttcttttcttttttttagagtcaggggtctctctctgttgtccaggctggagtgcagtggtgtagttatagttcattgcagcctcaaactcctgggctcaagggatcttcctgcctcagcctcctgagtcactgggagtacaggcataagccaccattccttaagtaggtttttcatacataaacttaattaggctaagaaattttccttaaattcctagtttactaagaaaattttactgtaaatctgtattgaattttgtcagatgttcataggcttgtattaacatagtaatacatattttttggcctttaatctgttaatgtaatgaattacataacagacttttccaatgttaaactatcgtacattcctgggataaatccccttctgtttttacatattattgttgtctaatattttatataatagttggccaatataccaatgtttgctatactgcttttatatcactgttattggttatttttttcattcttgatttacatggccaatgttcatttggttttacttacatatttaccagtttctttactcactactgtctctttcttctcactttttcctttgagttcagctttcttatttctgaattacagtcttcacagttcttcagctaatagcaaagttttaaagtctttttctgacaatgccctttttcattcttattcttgaattttagatagctgggtataaatcctttgaagacactgaattctattctgaattgtattgttgttattgaaaggttcttcttcttcctcctcctcctgctcttcctcctcctcctgctcttcctccttctcttaggtaatatctttgtctttgtttcttctttagatattctctttgtctttgatgttctgtgtttcaccaaggatgcactgtgtaatggctctagttgtgagtttctttttatttaccctatttaggattcttgactttaatcaaatcaattaaagtgtacttttctcccattcttttaatattctctatgtggaattcttatgagacatagattaaacattacttctatgtctctttttaacatatctatatacctctctgtgaatatgcacacacatacacacatatataatatatatatttgtatatgaatattacatatattttgtgtatatattatagataaaagtatatatacatgtgtatttatatgcatattgcctgtgtatataaaattaatcatatgtaagtttaatttctatataaattatatataactttaatttatagttaatttaattatataaagattacatatatatatttgttgtgttttgtttttacttgcagtgccgagaattgaggtaatcatgttgctcagttcatggcacactattgttatcagtgggtgtactatttctcccttggttgtttgtttaatcattcctctttattctcatttcccacttatattttccttctcccataggaatctaatgtatttgttagaataagcaacagcacagtaccacagttgtataaattaaaatatatacccactaaagaacattatgtatttttaaagtacctatttctcactttctatattcagcattctgttttaaagatctatatatgttgctgtatatttatctagttcactgcttctaactgctgcatcttaatatataatgtgctgtcattgcatttccctgattcactcttcagtgctggaaactcagggaacttccaacttcctgctgtgcaaacaatgatcaaataaacattcttttacatgggttttatagacccttttgagaatttctctgggatgtattcctaggaattagattgattggtcattggatagacatatttgagccttatcctcttatattttgcatcttttgctgaatttgggatagtttcattaaattgatcttccagtttgtattttatatgttttaaattttctgtatattatgatgttttgacatcttaaaaaaccctttcttgctgtaaagagaccgcccttcctggctctagccaattcttagagatagcaaaggactcagttaggagcgtactttagatttgcaaattaaccaagttgtgtatcttctgtgtggcctgtacacccccagggaaaaatatgcttgtgtcttaatcatcccagggccatgtaccaggcaattagggactatctctatagtttagagcctgcagttattattcaaactaaccaattctaagaagtttatcctgccctccctcacgcttcctgtcccacggaagctccaataaaattctagttttggttttcctcttacttctgtcttctgccacctgaccaaaacctggtgattccccggtaactctgtatggcatgtggtacccccctctctagaacctgtgaaagtaataataaactttgttttcttgtggctttcctgtgtcccctgtgctgcacctgattaaccatcacctaaaagaactcagaatacgattcatacattttctcttcatctgcctctaatatgatatttttaaaatgtaaatgattagaagctctatttgaggataatagattgagaaaatgattgagcagaaaaagtaaatcaaatgagaatactaagacccttcaaaaaagatatggcagaaattcttcatgtgttttacaattttagaatgtaaactcataatttgttttgagttcatttgaaagaatcacatttgtaccagtcatgagttgatcagaaaaacggatcgtcatgaatgaaatagaatagtggatttaattagaccttgtacaattggggaactggttaagaagtccatgtcaggctgttgctttttcatgtggtatttactggacctggggtcactgtagataagctggaaggcaatcaggaatgagagttggatttgaaataggaaagggcaaggacaaactggaacccacaaggtcagacgggaaccccagaagacaaaatggagcccaccaggacaaactggaatttgactctgtctctcatgatctctaacttcaataatgttagtgacctgcagagaagtttgaacccttcatcctgaagttgcacatacacttggcccaggactgaaggaagtcaaagaaggaaatccactggaagctggagaactgtgggtctaggtgcttctcagtgtcaataaggtgggttaatagattagtgacaacatgtgcaaattgccaatgcctggtgtcatatattgagtttcagagtataaaatggtggcttcttcatttgtgcccttcagttcccagaccaatgtgctttatggcctactccaaattgagaaacacacaaagaaataaattctgagaatgtaattccagtttagctaggttgacatagtataaaaccatattacactagtttagttgaaggtatgtatctacggatatattttgtgtttatttcttttaccacccttgaagtatctccagctttggattaattttaatgtaaatttttcattttggagctttctagaccaatagccaaacttaaaatgagttacttgacagtggttctgggttctcaaggaagagtctctatttcgccattctgaacagaggctgagaagacaacttacccagttatttccctatacctatgggcatattagttcacacttacgctgttatttagagtggagtttctctaggttctagactctggtggtctctgttccaactccctataggagtagggacagacgaccttatctcctgcctcacagtggatattaagacatcagcctctagattacctaagacagcccttccccagagtagacaaagagtcagatctgggctttactgctgtgagtttcagttctctattattctctgtcccctgaagagctatttattttccttctagttcagaaatgcattaaaaattaaaaaaaaaaaatctagatttttcagatgtttttagttgacattttcaggctaactactctgccatgttacctgaacagggagtccattgcatttgcaaccaagaacttaaatgcagagacctcttttacaaggatagggtgctttagcaaattcagatttacaggaaagaaaattacaaatatacaaaacagatcaattagagggatgaatttgcataacaaaaggactcgccataggactagttaaaatagctaggatctaacagtgaatttagagcatctaggaaaatgtgcattgtataaatctatcaggcctgtagttaaagaaatgcggggatgaatccttttgtaaagcagaaagtcctttttgtaatgtgaatgagtactctctaatttacaagtctgtaagtttgagaagtttgagtctttgtgtatctggcttctcaaataatagagatccagaataagttatttatacagagagttcaggtttaactctcctgagtatgatttttctatgttaatataaaataatcaaaacaatctgcatatttaaagaatggaatcatgaggtccttcagacgtttaatatgtgcatttctacataatttcccatgggtcttgttactggaaatatgttgaagacaaatgtttccacaaaatgaccgatttcttttgatagatctatttaagcacacagtaaaaaacatcttgaccagaaacataattgctaattcactgtgttggacattagctattgagttattaaccagttatctgagggcctaccatgtgctgatcagagagtcagagttccttagatatcaggtacccaaactcttcattttccagatgaagaaactagtgatgtcaaatgacttgataaacagtttcatggctactcagaggactgcatgaaacttccagcatattatactgctttctttaatagagtgaaagagtccactaaattaaagaggttgtcaactccatggatgagaaatttatgttaaggaaccatgactcaccccgaagggtgccagactgagtctgtggcccagtgcaaagggcacagagacatgccatcagacaggcttgtgcctgcatgtcttgcattgacgttgggcaatttattaacttctctgaactgcagtttccccatatgcaaagcagaaaattaatactcatcctgccatcctgaaaatgtattgttagaaaagaacattattatatgggagatatactttactgtataaactccaaggtactttaaaaatgtcatttgttatgattattgccatagctactctagagaatgcatatatcaaaagatctatgaactttcacaaatatttttgcagaataatcaaggaacaagttgttaacctttttctcagaagcaataaacaagaaaaatctagactagatgtttatacaaaaagttatttacaattcagagctgtgtccaatgtcatttgttatcattattcttatatgagtgaattaaatattttttaaaaaattaatacatggaaagcaatcagaagaatgatttgcacacaacaaaatgtatatgaacattggttattgttaattatatcctcatacttttctattcctcctgcaattgtgcaagccaaactctctcaactctgaattttattttctattgtttgaaatgacaaagatcatgggtagctgataattcaagcattgtttttgctcaatgggaagactaagatgttgctttagggagtaaaagtatggggagacattgtaacaacagctatagtgtcaaaggacagtgtgtttttaaatgtatgtatacattatacatttattcccacttagcttctgttataaaagtcctgagacatcttctgggctttgatctgtttatggatccagatggcagagaggtgatgagaccacaggttagagagaaaatttagtcacaagattggaaattataagccttttactgcttaattattcccttcctgaatttcaggatatggtcacctatgaaggttattttacttcaatcaatccttggatgaagaagacaataaccatagctgtacaaaagaataatgagatttaagtattgcaccgatttttacctacattctctaattgctcattacctaaggcagctcagaaatgacgaactggctcctttttcatggtcaggacagctgcttttatatgttacatacttgtttaatatgaacttcaatggtttttagaagaaggaataattagaacaggtacagccaggggatttttataactcctttaatgaatactaaatagtattttatctttaaaagggaccatggctgcccttaactgcaaccaagttcattaataaaaagttttcatgcagcagacacaaaacaatataaagaaaccagagaaaaatctaaactgagagctgtagttactatctgtgctaagtgaatcaagcctacttgcaaagatgcataattattttttaataaaaaagaaataaaagattttgctggcttaaccaacgataggtaatgatactaaaaatgacatgagagtaggatgctgtatactgattccagctgcttctctttcgagttgggattatctgaattggaaaagaaaatccccatttccccagcaaggtacagattttacaaaacagagatccatccttgacatggtaaatatctaatgaaaccacctcttctttccatttttttcccaccctgagccacatgctgtatattaaataaaggactcaactttgttcgtactggagaagttgtctgggctgctgcaggatggaggtttacctgaggttacctgtatgaagggtgaattgctcacgctttagagcactgttatctttctccccatgtactccttcaacagcacaatctacagtgaagtacttgtcagggtaagcggtgaggaaagtgagagcaggttgatcaataaaacatagactggaggaagcctcttccacaggaaactaacaatgcataagaagcatattcttaacaatgtttggcaggaaactcagcagcatgaaatgtacttaatgtttaacagaagttctggaagaaggcagctttacacgtgacgtaaagaagattgactgaaggcatgctggggtctctatggaaagagatttggatgtgaatagacctgggcttgagccctggctccaccatgttctcaatgtgggaatgtgtgtgagttcctgctcctccccttcctctgctgtaaaatgggaatggtaacacctgccttaccagactataagcaaacagtgatctgagatgtgtgaaagctttgtcaactctaaagcactattaaaatgcttcaggaaagtagagggaatttatcctggtcacctgccttgggaacagtcacgaaaccataatgtgttcccagtcctgacactggcttccctctggctcaaaaactgggtcttgcaatgactggctttcttctgattttcaaggttgagtgactggcagtctgcctgggcacacgtcaaagagcaccaccacatcaactgcatggctgcagtccctgtgcaggcagcttcctttgctccccagcaagtgcaggggctggcagaggctgcttcagccttgtattgtagggggaaataggtgccacatgctgttatgaccatggtgatggtgggggcgactggtgcttctacataccctggttctaagctccttttctggatctttgtagttacacatgggagtcaacagcccactgccttccctttatcctctatctaccccattgccttcttccagcttccccccaacccccacccccgtctaatgaaaaagaagttaaattcctatcttagcatcaaatccagctgtagttttttctcccaactaagcacatgcagtacggtacctcctcctgtaccatatacctcctccagtaagatactcctgatctctttctcctcctctaggctcactttaaggtccttgttgtatgtgaccctatgtataccctgaatgtggttcttattgaactgtactataactgttaacttgctttcaattagaatgcgaactcttcaaaggaaattcttactcaccagttgtctctccatcatctagcatagtgcttggcatacagtaagtagatgtaaatgattatcgaactgaattgatcagaccctaccactcccattgatttaaaattatacatatgcaaagaagggtcattttgagaccacagtgcaatcaagatgaacatgtctctaacttctgacttctctctttctgaatccgtctaccctagctcacccatctgtctctgcaagaagggccaagaagagcacagactcagtcaaacaaagatggaacaaaattggtcacaacttgaactattccttctttattttccatttctgttttgaccctttaaaaggaatttcaaaattttactttcttctggtgctactaacgtaaaatgcctaataatctctacatggatacacgatttgaataattatacacttgatggggttataaggaaagtttggaaatcatcttacaccttctagacatattccaagtcaaattgattaaagaaattagttctttctccttagttctaaatcatatgccaggaattccaggtttgtggatttgtcatttaattgcatattattgataaatagtattaaagacctttcctgaggactcactgttctgagtggtttctatagctctgtgacagatgttaccagttggccagtaaaatccattccaatttcctctctcttgcttgttttctcctgcagagcctggaaaaagctaagacacactttcccagtctcctgcaagttggacggtggctgtgtgacatggtctggccaatgaggtgtaaacctgagtctgctggaaagatactggaagaacttttgatatcctgataaaaggaacacacatctctatcattgctccctttccccttcctccatctgggaatgcagatgtgatgacagaagctgccatagccactctgcagtcatgaggcaaaaaacacaaaagcatgaggacaaagtgccatcatgctaaggagagcacagcaaaaagacagaaaggctctggtcctaaatggcacagctaacaagtgcccatttccatgcctcttgccaaccaacacaattcatgtccttatgatttcaatccctggtggtcaggttttggtcacttgaagctaaaagcattcctaactgattcaaaccccaaataaaaacattgccctaatgatgaaacagaaattggttactttggcctcaattaaaaaatgaaatgtagctaatctttaacaaattcaatcctaaatagttctctttatgcctactgtcaggcaggcccttcttctgtggctggatctgatttcctaaagccttaatttctaactcaacatagcaaagaggtggagggaagccatcgtgcccaaaccctcatgggggtcatgacttacagttgactgaggatggcctccatttatcacatagtctattgcaacttgaggttcctttaacaaatactaggttataacatttaaagctgatatcacagcttctgttacaagaatattattgtactagtttcctaaggttgttgtataaattaccataaactgggtggcttgaaacagaaatttattctcttatagttctgggggccagaattctgaaatcagtgtgtcagcagggcattctccctctgaaggctcaaggggagaatccttccttgcttctttgagcttctggtggctccaggtgttccttggcttgtggcagcatcacgccaatcttcgtcttgtctttacatggccttctctgcttcctcttctcttttgtctgtcttcttttcttataaaaacacttgtttgacttagggcctatcctgttaatccaagatgatctgatcttggatcctaaatgaattagatttataaacactccttttccaaataaggtcacattcacaggttctacgtggacatatcttttggaatgccaccattcaatctactacaactctagaaaatttattccactttccttatttatttttgttgggtctcatgaactttgatttttttaagctgtgtgaggaaacatttatggcaatttaagttttgtgttgcatcagaatttaaggttgtttcaggaaacacgtgttttatttcacattttaaagtaaagaattatttctctgattacattttagtctttatttctcatgttaaagtaaaaaataggtgacttcagatcagtaagtatatcatggtagtgatattaaagagtatttactaggcttagtataactcaggcaaaacatttcttgcaaattattcaccataatctttgacataggctggattattagttttaaggcatgaattactttctacccaggtcaatggtttttaaccctgttacacattatagtcacctggtgaacctttaaaaatgcatgcccaggacccatttcaaccaatgaatgcaaatatgtggggatgagcttgtgcataaaagtctcctaagttattcttatgtatagtgaggattaaaaactgaccttgactcttattagcagttgccttattcaacaccatttatttattcaatcaagtaatcattatgcacttttaagtgtgtaagtagttgcagtacatataaggacatataagaaatgcaggtttataatttagtagtcatggtgtataatattttgtgtaatgtgccatttatactccagggtggtagagccaaatgcttatagagaccttctctgctggtcactcttaaaaattcaaatcaatttatagaagtaacttgtatcacaaaaaattagccaggcatggtgaagcatgcctgtaatcccagctactcaggaggctgaggcaggagaatcacttgaacccaggaggcagaggttgcagtgagccaagatcgcaccactgcactccagcctgggtgacagagtgagactccatctcaaaaaaaaaaaaagtaacttgtatcattattgctttaactcctctgcactcaggtgcgtgtgtgaacacacacacacattgctggtaataatcagagcaaaataagactcctatggttgactatcttcagattacaccctttacaaggtcaggagccttttaattattttagatcccccttccgcagagtagaaaccaatatatgcttgtaaaaactcacgactggtagtgatccctattagtagaaaaagcttgagcagtaaagttgcctgtgccctggagaagtgctgaggactagaaattcctctagcttccagctatttgggaagacccttgggtgttgagccaacattggcaggtgcgaaagggaatgacactggggctgaggagaggatctggcagccaattagcagcgcttgttagagctcaccccagactgctgtgtgactgctcattcagacattcatagacacccctgtcacaaataagccacccagagctctgtagtcgtacaaagcagcaataggagtggagaagaaccatgtttgtcaggaaggccctgcatgcaagagagcggcagggcagagagcagagtagagcttggaggctatagttgtaataagctttcaggaaaagagaactgagcaccttaattattttatttttttttttgacatggtcttggtctgtcacccaggctggagtgcaatggcacaatcactgctcatttgcagcctgatctcctgggcttaagcaatccttccacctcagcctcctgagtagctgggaccataggcgtgtgcaaccatgctcagctagtttttgcattttttgtagagacggggtttcgccatgttgcccaggctggtctcaaactcatggactcaagcaatccacctgccttggcctcccaaagtgctgggattacaggcatgagccactgcacctgacaagcaatttaatccgaggagtcatggagtcttatacatgtgaagtcttgttgatgaaagataggaagatggagaggagctggaggagaacatgatattaagccaagtatttaaaaactactgatgagctaggaatcaagctgagtgcattcattcatatgttaatcaaatactttttgaacatcttctatgtgtttcaggtgttgacagtgcagaggtgagcacgtgttctccagggtgaaggacactggaggagatttagggttataaaaacaaacagataacaaatgcacatatattcagagtaacatgatagaaatagatggtcaggagataccacctcagtttgggcgatgaggaaggccttgacccaaggaggtgacatgatgtgagctgagatgatgtggaaggtgttggggcttagaaaacaacaccccaaaatgaaggcctcagaagcagcctcagaagcaaaagtttttctctgaccttctcctgccctcctgtttctcagtcccattctctcctgaggctagctatagaaactaggatccctcttccccagggtgggtcatagaaaccagaccccttcttccccaaagccagccataaaatctaaaaatattactctaactttccctccacctttctatgtgaaaactggccacagagaaattatctgacttaccttgtttgactgtaggtcgtaatacccccattccagagagggtcttgcccaacacagagaaggaaggaatgcatgctcaggggggccaagaagaatctagacagacaggccttcctggctttcttcactcagtctattagcattagatcagaccctttttttggtccaataatatttcggcacagctgtccatactttgttgaaacgaagtgtaaaaatggacaatctccccagtatttttgggtcttcatcctgaaggctcccatgtttacatgctaaataaatttgtatgccttttctcttagtaatctgcttgaatgtgaattgatttttcagcaaacctttagagggccaagggcaactttcttcttggccccaacaaaggagaaggacggagatgcatgtaaagcggtccaggcagagggaagagcaactgtaatggccctgaggcaggaatatacttggagtttgcaaagaatcagatgatatccaggctagaatcagagtaagggcatgtctggaaaaagtggaaaaggcagcaggggttaatgataagcacgtggccatggctgggcttcgggaagggtgaggcttcaggtctttgtggtttggtctgaaagcgactgaggttccactgggtgagctgctcagggcacatcctgatgcagacagcctgttggctctgacagcagctctcccatcctcccagctgcaatgactgccgagttggctttgctttgagtattccaatcacacagggcctgcacctctctgcattccctgggggtgattttgatagtttctctgtgtgcacagtgattttgaggcaggagatacatgagcgactgcagcagcataagaagtcagtggtgtcaatgcctgacaactaccatgactgaaaaagttagattcctgaagtgacttcatttatattgccatatcctgacagaatctgaggccactcttggtatatgaacacagtatcatcttatatatatggaaataaaaaagaatgggaggtttttttttttcttaagcaaaaggaaaatattaactcaagacccaaactgttttattcatttgtggactcccacaataccttccttacacagttatttcactgattctagaacacacacttttcctcatttaccatctgtgaaatgataatgcatcttacaatccacagtgcctcacaattgccatcacatggttgtcatagcccatacccacatgcttggtcatagctgttcatgtgttgagtataattggcatttaaactgtgttcaaaatgattacattataatttggcatcagtacttggaaagatacaaatacagtagggagaggataatttgatatttgtgaagcaaataacttcactggagaagagactgcaatgacatatttcctttaaaagcagtaaccatgtgcattgtgggtctgaaggaaggaagatatccacaaatgcatgaggccttattatgctttgttactgcaatatatgaaaaagattacatgttacatgccaaggaactcaacaaaggcaggagtaattgacaaagccctctatatgaaggaaatgttcaatctgtgtgaggctgtgatgggtttatgtgttggacagaatcaccataaggctctgtgtcacagattaattggcagcacttgtttttcttttgtaggaatgcataacataatgatgcatcttataatagatggtatttctaggttccatgaaatagagtggaacaaagtagatgtttttgtcgttagactagggctatgcaaatactagacctcacttatcccatcacgttcaaaatgtctctgcagtttatttacatattaccaaagagctgtccacttgaaaacttatagtcagcattgtgtctcaagccaaggtaaaccaaactaaacattcttatggcaacatggccaggcgctgtggctcacgtctgtaatcccagcactttgggaggccgtggtgggcagatcacgaggtcaggagttcgagaccagcctggccaaaatagtgaaaccccatcttgactaaaaatacagaaaactagctgggtgtggtggcgggtccctgtaatcctagctactcgggaggctgaggcttgaacctgggaggcagaggttgcagtgagccgagatagcgctgctgcacaccagctggggcgacagagctctgtctcaaaaaaaaaaaaaattcttacagaaacttgatactcttggttggtgaactgaattttatcaaaagcatctatggcacacaggcagatgattgtagaatacatggccttaatgaaaaataagctaactgcttaggcgattatttcaaattcagtttaaggaagtcactgtgttttagcgtctgattttgaacatcaggactaaagaccctgaggcttttttcctttaaggtactatcaggtcagtgtgaaaaagctgtttgccaggggagccagttggaaatgaatgaaataatttacattcctgctgtgggcaagttgtcaatcattatgtgtgaagcctgtaccatcatttttctcctatatctacacaaggatgctgtcttaaggatgtagtcaagtgccgtgacaaatagcaggtcaatagctgaggacacgttgcctggtgtgtggtggtagagaaagggcacacctctattccccaaactccaggccggctgcttgatgtaatagcaggttgtaaagtgaaaaagcttctgcatgaaaggatagcctttacatggggtacagagcgcagaaacgttttttggccacacattggtttttctcagccatggatcataatgattatcagtagaatcatttgttttaaatgcagagaagagctgaaatgcttctatgtatcattgcttctggagatttctagaaatgtgtgctaggtagttcaatttaccatgtccaaatggaactcttgatttctccctccaaattttccctaacaaatattcccaatctcaagaaacctcaggccaaaaacatttccaccgatccttaattcctttgatttatctacaatcaatatcacattcatcatctctattttccttgtaaatcctgactcagatattctcaccttcttcaccacaccactttagtacaaggcaccaccatctcttgccccgactactaggtgaatgcctcagtaggttttcaatgacctccatccccattcccacagcagccaaagtgagcctttcaagcataaaccaaaccatatctctctcctgtttaacacccctctgatgctcatgctcacatttagattactatgcaacccctctccacagctcacaatacctgatcctgggccaccactgtgacatcttttctatcagccttttccctggctcatgctactacagccacactggcttccttgctggtcctcaaacaggcacggtcctgccgcaggggatctgcacttgccgctccctcagcctggagtgctgatctctgcatggcttcttcccacacttggttcagatctctgcctaaatgaaacctccttaaagaagtctttcctgatcaccctcctgaagatctggtcactgtctatcctcttaccctgctctatgtttccttatagtatgtgccactagctgatatcatattacagacttatctgttacctgcttattgtctttgtccagctctagaatgtaagttccataagagcaggagctctgttggttttgtttccaatgcatttctagagactagaacagtgcttggcatatagtaggtgttcagtaaatattttcattcaatataaatactacatatacttcttcatatgtcgtcttcccagttggacactttctaggcatactgggccctcacaaagatatatagagtgtggactacctttcaactgaagcattttaccggacatgccaactgatggcagcacccagggatggcaatgagatggtgtgtgcatcacccaagtggccctccacagtcaagtaggtcgctgaagtctgtctctgatgactttgcctcccacgtcttcctctgtgtctttctttcccattcctcccctggcagcaattcattcagtgggtatttttaagcacctgctttgtaaagggcattgtgtgaacatacagctgagccctccgaagtcaggtcttcaaggagtttggtgtctggtggagaggcgcgatgaacccacacaaatacaagggctggtaaaaggtgaagtgtcttgccccagtggaataaggaactagaaactgaaattggctcatctgactctgagtccagcctctcatccactctgctgccttgcagcccacccaagcctgccttccctctggcgctcctctgcagtttgtttgtttgtttgtttgtttatttatttattattatactttaagttttagggtatatgtgcacaatgcgcaggttagttacatatgtatacatgtgccatgctggtgcgctgcacccactaactcgtcctctgcagttttaatctttgttctaaatcctccttttccccttctctatattcaaagcaccaaatcctgcccttctaggtgaagttatacatcagctgatgatcagatcagactagttcacagtaagtgagaatgactcatagatttagttctctcaggtggcgtttgtattgtagtttgtctctgctgcagccagtcacaaggagatacatgtgtgggagtatctgtttctctatttttggggggactgcgggaaaaaggatgccacctggggtctgcttatttactgtaagtctttctaccttaccctgcctcttgggcttccataatgaagtaggtctggccatgggtctttctccttccttagtacaatttctaaagggaaggcaatattccatttttggcatttgggaggtggtgaaacaggcaccctctctgttctctctcactctttctctctctctatgtgcgtgtgcgtgtgtgtgtgtgtgtgtgtgtatagtggtactacagggtcatttataccagcacgcctcataagttgcacccctgttcgtcttgtgcaccatgtgccctccagtggctgccacgaagaagaaatggaacttcctaagtcagccatcctgacagacactgttggaaactttctctgcaaggctgagaacatgagggaaagactgcggatgttcattctgttgttaaacgtatctctgttgcaagaccagcctagtgtaccgcctttcatgacacaatacatctgtgaatataaaataacaggaactggtggcttttctcatcaaaatccaaccagttctcttcagacacttcttaacctgtaaaatgggaatggcaacagtgtgcatctcatagggttcaggtgaggggaaatatatcaggatatatgatgtatatatgacatatatgtcagacttagaacactctcacacaaaagtgtctttaggtcaatcaacaggtatttatttgccacctccggtgtgctagaaactgttctaggagctggggatacaggagtcaacaaaataatctatgccctgatggggctgattgtggttaataatcatgatagcaaaggcatagccaggatccaaatccccgcagtctagctccgagtccccagtctcctccatgactccatagcacctcttgttcactgagcaagagaatgcgaataatacacttgagatgacgttgtgagttgagagcctggacctcagggataaagacctgtacttggcagccatctactttgagtctgctagctgaaacctgtccaagaacataacactggggaaaggaggtttgagaaaaaattcttgagcaagattgacaattaacgaaggggaagataaaggaagagttactaaaacaaattcccattattgttactactattattccctgtgctcatctagaggagtcaagtaacctaaggaatcaaattcaatgaaaaaatattggttgcacacccactctgagcgaagagtggatgtgcaacaaatatttgagcaaggcacgaaaatgatttttcattagacagatactttgcaatttaattttctaaaatagctgagtttgatggtcaatgagttcaataaacaattttccagctttttatatatctagcaattccatgatcacacagtgtgtttatcatctatcattctccaattactgaatattggttggggttcctgtcccccagttttccatacatttaggcctccttgcatggtaccctatccaggtcatttttttccccccggtgagcccccattgatcatcttagattttctgagatggttttgatttcacatattttgagtgggggcttacaaacaataataagatcatccataattctaaaatctctcttcttttctctaattaaaacctttgtgggccaggcacattgactcatgcctgtaatcccagcactttgggatgcctacataggaggatcacttgagcccaggagttcacaacaagcctaggtaacataaggaaacaccgtctctacaaataataaaaataaattagtcaggtgtggtggtgtgcgcctagtcccagctacttgggaggctgagaagggagcactgcctgagcctggaaggttgaggatgcagtgaaacttgattgcaccactgcactctagcctgggtgacaagtgagaccctgtctcgaaacaacaacaacaaaacaaaacaaaacaaaataaaacaaaaaaacccataaaacaccaaaataaaacaacccccccaaaatctctggggtgcactgattgcagtaatggtcccatttcttcacccttccctactctcaagctatttaccgtgtgattttgcagttgctcctattgagaggtgaactatatcctcccctcccaagctgattttgagttttccatatagcttcctttggccaagtgttggcagatgtgatgtaagtagaggtgtaaaaaagcgcttgctcatttttgtttgtttgtttctttctttgttatgaagacatgtctgcgatagcatactagagagtggggcacagggagtcccagctgtttcagctgagaccaccccaggtcagtcaactctcatatgccagaagactagagccaactgccagatgtgagggagccagatgagatcagaagaaatttgcagccaagcccagcctaaatcgctgacccacaaactgtaagctcagctaaacaaatgtctatcgctttaagccacttcattttcagacagcttgttccatagcattgttgaggcaatggataactgataatgcttcccataaatcttaggaacttggaagctgcccctccatttgccctcctttaagcaaaaaattgaatgctatttgcaaagcattgtataaaatgctttattagattatcttattgaatcctgacaacaatatctagcagacagatataatgctattatccaaatttcagaggcaaggaaattgaagcttagagaagtttaagtgacttgaccaaagtgcttttagaaaagcagagattctacaaccagtcttctaaatcttggaagactgcttttagccacggctgcctgccatttactctttggattctccattctacctgttctgctgcctacttctaccacctaattaggagaagaccttgtgttcccatttgggatatagatacccactttcatactgggtttacccctaatatttctctccataccactcatgtagatggttgtcttccgcattaatctggaaattttttgagggtaaagactaaaatacttatatttttatccccacaactctatgcagtatttttttaaaaaagatcatagtcatgttttaaggtagctattccataaaacatataaaaaggtaaaaaatactctcctagagaatatatgcatatttaaaaggacactgttattcaaattaatctaatttgtggaatacacagtagagggttttccccattttgttaaatagttttagttatatgttatttgaatgtagtgtttgcctgaatatctacaaaaataaaactctcttgactcatttatagattaattccagaagcagggattaatacaaaactggcagtgaataatttctgttttgcagttagtttctgcatttaagaaattgctttagggttcagtaacttgccctggacttcaggtatgctgccaccagatggcagcagggtgccaggcataaggcttgtaagcaaagaatttgtgtgctttctgaggctcaaggtaatagctctttccttaagttcaaaaagattttcagaccactgatttccaatttagcataatacatttctttacaaaaataggtaaactaaaactctaagccaccctaagacatctttagaacagatataaatcccaagctataaaatcacctaactcattattacttctcttctctagcatctaattatttctgtaatggcttatacaccatgatggcttatacgaatcttatacacctacctcagtgatagtgttaaccattataatttactttgaatctttatgatcaatctctgccatggcaccgtgtatgttagttttcaaaattctcaatagtttttctccaggtaaaaaaaatctatctggctttcctttcatctgtcttaagagagcagaggtttatcttttcagtattatctgagatcttctcttaagaccaaaagtatttctccactacagtggcatgaacagtgtttatttgcatttcgtgtatgtatttgtgaatatggagtacttttgcttttgtattttctatactatataataatctactagaatatttcccctctcaaagctcttggaagcacagaggcagtttaccatactttaacagaaatatagctggattaaaattttttttttttagcaacaggctctgccctaaatatctcaagaaaatactttaaagaacaaaaatcttcatgccaaattagcaagatacaggaaaaaaggtaagtgggcaaaatacagggaaaaaaagctaattcaccctgacagttgttacacaaagctgagagagtctttccctctcacatttacaaagtccaggagcggaaagactttcagcaggagtaagccatgagggtttggacaaggctggtaggggaaaatgttatctcctgggcatactgggaagctgagagtccagggcaggtgaatggggttggagatgggaatgagggaggacagcatctgagcagtaaatcctggaactagagttagcatatcaagcagggctatctatgcacccaaggtaagttctggctgggagaagcagatggcaactaagctgtgaaaataggctccaagggaccagctcccagcgtaactctgggggagggatctggggaagtacaaaaaacatagagaggcaaaagacaaataaaataggaggagaagagaaagggatggatcatagaaagctcttatttgattttgagtctcacaggaaacccatgaagccagcagggcaggtattttttatcctctatttacaaatgagaaactgagtcccagagggggtaagtgactttttttaaggtcaacataccgaggggcggatataagattcaaagtcaagtgacctgattccaagctaaagatgaaagaagagagggcacatttgaaaccctgacacacacactgtatgtcctactctttgctttataaacagtaagtaaaattttcaaataatggaagcttagtcttttaagggtcaaacggaagcagctttagccactgttgaaaagcatttctgaaatgtattatatttgcccttgcctcctttgaaaactgactgtaatctactctcttcttgatacatgggttataattacaaaaatttactatatttatgaacttctaattcagtagataccctcaggttctatggaggcacatgtgttttttaaaaaattaattttttttgctgccccacctaatacattcatggctagaaatagctgtgtagcagaactggctgagtcagctccttcttccctcacagccagctcttccttcttaagtgtgtctgctgctggtccctatctactgcttctgatcaggtcattccgcttattaaaatcctttagtgactccctctaaccactggttgcagtagtttgcaaaacaggctgcacatgaaaatcacttgaggagcttttaagacctcctgatacccaggtgccaacacgaaagatttcaattcaattgttttagatatggggccctcacctacagggattaacataagtagcatgaactcttgcttctggccaagatggaataacgggggctagatttatctttccaatggacacaactaaaagtccagatgaatatattaaacaatggttttcaaggcaacgggcatgaggcattgaaggacagtgatccctgagagatggaaaacaaacaaaatgagttgcatttgcctgcaattgcccctgagagaatttctaggccatgcagcagaaaggaagaattcagaaggagtctgcaagactccttaaatagaaaagatgaagcagagaatccaggtagactagcgtggctagagtttgccaggcagagtattagagagcagggagttctgatcagtacatgcatgtgaggaaatggtataaaatcaaatgaaaaaccagctgaaaagatgagtaggaatagtctttaaagttcaaactggactggtaaaactgagatttgaaaactattcaaattgggaagccctgaaattcaaagagcattggtcaagtactcagaagggtattgccctcgtggtggggaagtattgtcaatagactaaacaatactctgccttgcctaaccttaaaagcaagacctgaaagatcaaagactattcaaagaattttcctgtatcccagagcaatacccaaaaatatctgtaggaataaaaaaaaaatccagcatccaacaaggtaaaattcataatgtctggcgtgtaataaaaattaccagacatgcaaaaaaacagcaaggagaaaaatcaataaaacccaaacctaaactgacacaggtgttacaattagaagacaaagatattaaaccagtaactgtaactgtattccatatgttccacaagttggaggaaacagcatgtttaatagagacagaaaatataagaaagacccaagtctggccgggtgcggtggctcatgcctgtaatcccagcactttgggaggccgaggcaggcggatcacaaggtcaggagatggagaccatcctggctaacacgctgaaaccccgtctctactaaaaatacaaaaaattagctgagtaaggtggtgggcacctgtagtcccagctacttggaaggctgaggcagaagaatggtgtgaacccaggaggtggagcttgcagtgagcagagattgcagagattgtgccactgcactccagcctgggcaacagagcgagactctgtcttaaaaaaaaagaaaaaaaaaagaaaaagaaagacccaagtctaacttgtgaagatgaaaactataatgtccgagataaaaaatacactgcatagtaacagtgacagattagctattctaagaagaaaagatgagtgaacttaaagacatagcaatagaaacaatccaaatgtgtcacagagagaaaaaagactgaaaaaaaatgaataggacattggtgaactgtagtacaactttaaatgacctaatactgatgtatttggggtttccaaatgagaggagaaataaggtgagtaatagaaaatattctgaggccagatatggtggcttacaactgtaatcccagcactttgggaggccaaggcaggtggatcacttgaggtcaggagttcaagaccagcctggccaacatggtgaaaccctatctccactaaaaatacaaaaattagccagatgtggtgtcgcatgcctgcagtcccagctacttgagaggctgaggcaggagaatcgcttgaacctgggaggcggaggttgcagtgagctgagattgtgccactgcactccagcctggatgagagaataagactctgtctcagaaaaacaaaaaaatttaagagataatgactaaaaaatttccaaagttgatgacaatgataagtctcatatttaagaagctcaaaaaacttcgcacatagaaaacatgcaaaaaatgataccaatgtgtgtaataatcaaattgctgtaaaccagtgaaaaagacaacaccttcagtgcagccagggggaaaaaaactgacccattatgtatagaggaacaacaaaatggcggcaggtttcttgttagaaataaagcagaagagaggctggtggagcaatatctttaaagtactgttcgttagaattctatacccagcaaaactatgtttcatgaatgaaggcaaaatgaagtatttttcagacatacaaaagctgtgaaaatttatcactagcagcctcacactatagaataatgtcaaagacagtccttcaggtagaaggaaaatgacaccagatggaactaagggtctacataaaggaatgaagagcttggttggcttcaagggtgtgtgacctgtatggttacacaaggtcctgcagatagaagggccttgtgctagctttaatgttttgatgttactggctaaaaatttttaataatttttgaacaaggggccctatattttcattttgcactggtagctggtcctgatgaagaatacttagtagtccatagaggtggaggcagaggctggaatgccgagcttggctctgaagatccaggccatatgttcaggcatggaatagggaagagatggaggtggcttcttcagaggaaatttggaatgttttaattttaatcacgagaagggtgaatgaacagatgtccactaaaataaaaattttaaggtagcaatttctgggtaattagaacacaattttcctttctgcacagagatagatcataaatggctataattagagagtttcagttttttctgaagttcatttgttgcggagtgttcaaaactgtctcttcaggccaaaatgccttgtttattgtgtgtgtgttttactatttctgatatcaatgctttaataatgcctgttctgtaatattggcccagaggtactgcaagagtgtaaattcactttacatgaaaaagaaaagctatattacttccaatgacattttagtgattaaatgcattttatttgtagtataattctatcccagtttaggtcaaagctccgaagttgagagtagtataataagtgtggacatgcaaaagatgctgaaaggtagtagaaataataatgtcagatctagcccatcaccaccctccagaacatatatgaaaggattagaaatcaatgttaagtgtgtatttatttgggagactgtccatcctaaatgaggacaaatgtcagggtgcttttcccaaaacttgggctggctgagggaagcttcaagagaatccctggaacagcttgaaatctggatgcagggggtggagttggtagagtccagaagctttacctgatatatgcctggaaaagtctaaagctcagaggtggtatctagctgtcctgaaggcttgtggggagccagctgtactgtatataggtataaatgcaatgcttaaatccacagataatttataaagttcactctacacttgaatactcacatccagtcatttagttgaagccttcggctttgattaaagttgttaatatttgaagtgctgactgatgtaacctccctggtatggaaatatgaatatttctcatttattatgtcccgtggtgaaagcataaccttttacttaaaataattggtttgaaaatggaattagaatattcatcctccccattcctcccctgcaatttgtgaatttagtaattattcttcttggttatgagcataagttaccatttacctttattcaatatgtacacacgcacacacacacacacacccacacactctcacagaatgcaaaaaaaaaattaggaaataaagttatcgcaactttagcaatgagagcggggtagacagaagtgtgagtttataatgctgatcatgaaataaaaacttcaaagcaagcctaaatctgatactcataggatgatagctctactgcatttaaagcaaataaagttacatttctcaagaattaatgcaaaattagaaagtttcctttgaaaatctcttagcacatctccaagtggttagctttcctgggaaagctggaaattaaatcaacaacattgaaagaaaaaaaacctcacagtcctaaattaaacagtcatgtaaatatagtttccaaagctattaggcaagaagcaaatgattttctaatcaatttactgttgcaaaaataatgccagattattttcatggggcatgtgaaataatttacatgggacacacgtggatattgctaccttagcaatcttatctagttctacccaaaggtatttaaaaaacaaccactgacgctgaagttatttgtaatcatatcagcagcctatctcctcatcctccattctcttcccctccaccagctgacttttgtatcaaaggcaggctacccttgcacttctcttttcacttaacatagaacaacagttactggagcaatctggttcccttaaaactagcgactcattacaatggttcaggatgtgaacttccctaaaaggctttgctctaaatcaaggtgactgtacattcccttttaggctagaaaacaacaaactatgcattcttagtataggattattcagcccatatattatatgagactacctcatatttgggtacctctctcattagttgggataaacaagtcttgaatttgagataattcaaaatctttgtaagccaaaggcatgcacacattttgcctttttctcattttaaaacccagtaacccaaaaccatcacatgaactacccaattctattgggcatacaaattttgttttctgatttccaagtctgaaggttcaggtcaatatttgtccgtaattaacatggacataattaatctgctgagttaaatgacatacaaatcctcaccaccaagagtgtgaacttgcccataaagttgtcacacagaaaattgaattcaatcagcttactttaaggaaaatatactgagttagtggtagacacagatggcatgcttcagaggattttggccttaaggtctaagagacagtgactatgttttcaaattttgacacaatgcttgtgacaggcacttctccctgtattgaagccagaaaactgttaagagccaacatgggtggaaaagaccagttttctttttttctttttctttttttttttttttttttgagacagagtcttgctcagtcacccaggctggagtgcagtggcgcgatctctgctcactgcaagctctgcctcctgggttcatgccattctcctgcctcagcctcccgagtagctgggactacaggtgcccgccaccacgcccggctaatttttttttttttgtatttttcatagaggcagggtttcaccatgttagccaggatggtctgatctcctgatgttgtgatccgcccgcctcgacctcccaaagtgctgggattaccggcgtgaaccaccacgcctgactagaaaagactaattttctgtctcaagtcaaggctgattggcctcatgggtggtggtggatcagtccctaagccccggcagtaaagccaggggccgtgatccccatagtcactgcagctgtctacaaggtctggctgcagtcactaaacaaggatctctaggccacaggtacccccggcactggggaaagtgagtgcccaagcttacatcttaaacactagttcaggcctttggattttgagagacatagagcctcacattgtaagtgatccttacttcagtgaaaacatataatagagtcctattgaaatccattctttacaatgggagattactgctaatgctagctaggtgagtgattcatgtgctacctattgtaagtattaattcttcattaggtagcagtgtgattcagaaaatgttacatagggatatttttcaagctattccattaactaattaactgggatgcaacttaagttggaagattgtttggttgatgtatggaaggtacccctttaaaaaatatctatgagtagccatgtgatgagtgtcaagttcttgacagagaattgaaatcttagcctgctgcgaccaaaaagcaatactgtttcagttagttccgttgccacacagactgaatgaaattaaccaaaggctttatgttagacaatgagtctcttctgaaataatgatagcttttgtgagggcataagaagcagaaagttaagaaagagttacttatggccatacaatcacattaatttgtctatttaatgtgacttttagattcaagaacaatttctatacgatgttctagaaaagacattattttttcagaaagacttttaaaagcaaggaattaattagttactaataataaccatcatttaaaataagcaatggcatgtaatgtgtagaaccgggacttttggcgagaaagtgacataaagagtagaacagagcacttttgaaccagcagaaacttatttgctttatctcttagttcataaatgccattttcctcaatcatttactataaaactaaaactattctttaaaaacctaagtgatttctcattgttactgttaaaaagaaatgtgtgctatgccaaatacaattcaaatgaatgaccattttatgttacattttcatcttattccttcatttatgctagaaaataacaaaagtaaaaatgcaatgagaaaagtatcaaagtcatgtatgcagattcagttgatctctttgggcttgactatttggcaacatatgttggccagtttttataggaaatctatgctaagtgtatgaataaaacagagacaacgtaagattagacactagcttcagaaaataaaattttgataatacagcagcctatttagtaagaataaaagcagtctcttggagtgtgggatttgtatatgtgattaagaaatagagacaaggggccgggcgcggtggctcacgcctgtaatcccagcactttgggaggccgaggcgggtggatcatgaggtcaggagatcgagaccatcctggctaacaaggtgaaaccccgtctctactaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaagaaatagagacaaggaaacatgatagagatagaaaactaaaaaaatgataatttaaatctttaacagtgaatatgagcaaagatcagaataggaacctatttattatcatatctatatcctataactgaaaaaatttcctaaaaaggagaacacaaaaatgcttggaagattttcttggataatgcaaaataccctgggagttctctctttacctcttagttcccccacatttaaacttcaaaagacaatgactctggagcttgagagagatcgatatttaaaacagaaggcatatctataaatccccattggatgtccaaacacttataaaaaaagaaaattaaatttcatttatcaagggttgaatagttaaggtgtcactaagagaccaacttacattaataagttcaacctcccagatttttttcaacaggtccatcgaagtgtagccattaattagaaaggctttggtgtagtcgcccagttcaatggaatccagccactcagctacagaggtgggatggtagccatcatgcccaatgggtctcatctgtaataaagaaaattacattaggattaaactgtatactttgtgtcccaacaacagaatgcagatttccccttgaaaatttatttgacatgaagaacagatctttctggagacggaaacaaggaaaaagaaaacactttctgatgtgttttcacaattctaaaacattaataattttcacgctgaataggttttcaaaatatacacagaaatttccaatttagctgctagattaactctatatttggaagagctaaacatgtcaaacttctgtcatagacattattggcattctggtgggtggaattaaaaatgatgtcagttgaatggcattaaattcgatgcgaaagtcaccaggaagtgcactttcaacatgtagatgataattctcatatgcacagcaccaaagcatgtgaaaatactgcatgacttaagcattcaaagggaatttgtgcttatgcaagacatgtattggaggtagtgcaaacacgctggagaaacatactgctgcggtgaaccagtaaaggagaggcctttgggtattttaagaccatgtgttctgcatcgactctacagtatgttagacatgaatagagaacttgctggcagacaggcatctattttttgtcagctatatacagatttttaaaaaataggagaacaaagaaatgtgacagcaacataatgtttctgagtttaaattggagtgtgaaagtaatttaagcaagaggaacttctgggtttaaaattttgtatggattattctggtcctttagcttttatttgaaattgtagctgaatctgtggttcttggttttcgaagtgactcacttctaaaacttgggctgctttgcatgccacgccgtatatctaatacttcagtttttcaggagagctggcacctcatcaacctgatgggggccttcggtaaaattcacgatggaaacagcaaggctgggcaaaacacaacatagattttcctctttctttgattcaaagagataaatattaatggaaatttatatgattctgatttgcgagcagagaaaagattagtctgggaatcagggattcagattttaatcttaaacatggtaagctttctatcactatgcatggttctcatttttgagattctccctactccttcattttaaagttactttttctcttttccagttgttccgctccccattctagtttccatttcaaagtttaaatgttctctgttttattttattttttttgaaatggagtcttgctctattgcccaggctggagtgcagtggtgtgatctcagctcactgcaacctccacctcctgggttcaagcaattctcattcctcagcctcccgagtagctggaactacaggtgagtgtcaccaagcctggctaatttttgtatgtgtctctactaagagacagagtttcaccatgttggccaggctggtctcaaactcctgacctcaagtgattcacctgccttggcttcctcccaaagtgctgggattacaggcatgagccactgctcctggcctaaatgttctctattttaaagttagagtacaatttattatttacattagagtctgaacttggtcagacttttgtacttcacttttacattgactgacccattttagctactcattaaatatttgttcatgtaacacttaactctgtgtttattatgtggtagctacaaatgtaaatgacaactcagcatttgcagaatgaaagtcagtggcattcacaaatccctggatgttatgtatgtataagatcagaggctaggacccaaaagggaggctcatagatattcggtagcttcatattctatagagaattacaaaaatattggggctgggtacattctccaggcctcgttaaaaggtggttgaactaactctgttaacctaaataatcactctggccccaggaatcttcctgactgccccagtgacatgaaataagaaagaaagggaagaaagtgagaaacactaaggttgaagttaactgcttagtagggaggtcttgccgttggcccatccataaagctgaccactccagcagcagatactcgggaaaagcttagggagtcttgatgactggatttgggtcaaagtcagttgtctcataccagtgaactgtgcaatggggttaccacaggttacccccaagcacttacacaacactcttttgaggaagcaattagtggccatctgacacacagagggtgttgatggtcggtggtggccaaagaatcagggaacccatgacaggactgcaaagaaaatctaggtaagtacaaagatgtttgcttgtccctccaatccccctttcttgtcccaatgccagaaaatttagaatcagaagagagaagtgccagtcccttaggggaagtctaaacttgggggggggggaggtggtgaggaaaataaaactggaggtttcaaataaattggaactgagccttcaacattttacatggttggaaagttattggaaatgtctgagatgatatttataaatagtaaagggagggtcagttgagcttggttgaatgattggaaaataaaaaaataaaataaaacagcaaccatcatatcaggattgcacggaatgcaggctgttcagtggtctgattactcctgtaaggcaagttctcctagaccaatcttaaagaggtgagagggagggaaatatttggtgggaggatgaaagacaagggcagggtagagagcacaactgaagagaccttggaaatgggtatgctgaggtgtacagggcagtatcatccgcccactcattcaataaatatttaatcaatgcctattctgatgaatgttgtggaaatggtagagaacaaaacagtcatagtctctccctcatggagattataactcttaattaaaatatgcaaacagatgaccaataaattatgaaggttctgcatacctgaagagaggaaaccattagagccaaatgcagttacaaaattaacttgacacatatttaatgatatgcagaatagttactgtgctgcacaataatttcttccaaagcaatgatcccatctgttcctttatttctgtccctactgccattaccctgtttaggttcttgttagtgcttacaaaaactaacacaatagccttctacatggtctcccacctttgatccagcttgtatcttgctactacattagtcttcctaaaagtcagacccttaagtgtacctttgtataaaagcctgtagtggctccttctcgaaaaaagtccaaatgtcctattccagcattcaaggccgattgagattagcctaatctcccactcctctgctattgtgtacccaataaatgtaactagacacgtgtatgtctaaacagtacattaaatcgctaggcattccctgaaaatgacctgtatatgacacagtcaatatctttgctaatataacttcccatgcttggaatgcttttgcccctgcttctggagtgatttcttcaggactggcttctcttcttgagctctgagatgcaaatttctaaccatttgtaggacatctcacataaatgtcctataggtgtcaccaacataagtcaaaaacaaatttaactcctttagttcaaaaacaggctctcttcctctttttttccatttcagttaagggcaactattactccactgcccaagcagaagcttgggagttatcttactttcctctttctgtttactatcatatctaattaggccaacatggtctatcaatttgatttctaagatgactctcaattcatttctcttcttccaaaatggactttggaatatgacattcccagcagtgctacgtatttgttgggtgatctttggcaagttactctttcagcctgtttcctcttttttagaataagcataataatacctattccaagtgttgttgtaaagattatatgaaatagggaataaaaattgcctagcacagtgatttgaatataatagctattcaattataactcttagttctcttttctccccattgccctaaattagacccatgcttattttgaaattgcataatattctgccattggctgctagtcttttcagcttccaatcaaagctctcctctctcatcccttcctatttcctctatttccttccttctttatcttgttttagaaatggtttgcatctgctaacatctttacccctctccccttcagccgacagttattttttagaaacatatctaacgaggtcactcaagtcgattgaactgtttattccaattcttcgttctcttactgtattagaattatgcccctgtgccctttgccaagggatcaacattatgtctcagtgtggctggagttacttcccagtctcatcaatgctggccaatagaatgcgtgaagtgtcagtgtggtggttagagacgaggtctctgtgctcctgtgttctactaatctttcagtgttcatatgctctctcataagaatagcaagtgctgagaagttgcataactcctggttctaggagaaagatgaagactcgtggagcaaacctaaatttaacccaaagcttggaatctaccctagctcgatggggctcaggaaagtccagatgaagttagctgaagcacagcagacccgtgagtaagaaaaaaatattttttgttgttgttgctgtgaactactgaaattttgattacagggaaaaactgaatagtcactccttgtttaaaaacccttggtgtttatccattatgcctgtggaatataaatcagaccttttagtttatgaatctattggcaaatgcatcttcatgagactgagaaagattagggatgctgaataagcaaacatcagtatccttcccaagctacctcactgtcatgcagaaactctgcatgccacatcttttttttttttttttttttttaagacagagtctcactctgtcacccgggcacccaggctggaatgcagtggtgcaatcttggctcactgcagcctccgcctcctaggttcaagcaatcctcccacctcggcttccctagtagctgggaccacaggtgtgcaccactacacccggctaattttcttttgtatttttagttgagaccagggtttcaccgtgttgcccaggctggtctcaaactcctgagctcaagcgatctgcctgcctcaacctcccaaagtgttgggattacaggcacaagccactgcccctgccctatatgctgcctctttattaaccctaaactaagtaattctttattgtatgagtttgatttttggggcataatccactgtacatgtaatatacctccacatcttcgctcatgccattccctctgctaggaatacagtttctactttttctcctaatgaaattctatctatccttttttttttttttttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaattctatctatccttaaaaggtcctgtttaaacgttacctcctgtgtgaatctttctctaatgttaccattattccaccgaaaaatcatatcttctgctatatttctgtagtattttccatagagttctattatagtattattaaagtctgctttcaataatagagaagtgagtatctgtcttcttcattggactgcctaccccttggtgaagaaatgaggtgttaatcatttttgaagtccctaaatcgtccagcagagcatctcacatatggcaagcatatgctaaatgtttgttaaattaagtgacttaatgaatacatgaagacaaaatgacaaattcatttcagtggcttggtatccatttgtgggagagatttgtattttgtactccatgttatgaaaactaaggttatctttttctgcctaacaataacattcataactatttaaaacctccatatatcaagaaccagttccagataggatattgtgttacagaatgcaatggactttgtttccatagcacagaagacttgattctattagccatgtagccatgggcaagtcacttcatctctctaagcttcagtggtgtcagctataaaatgaaggtattggaccaaggatctcaaagctgctttgtaattcctaaattttgcaattccatgactcgtaaattaattttaaattagtaacctatttgtttacccaggaaagaaaaaataagcccaaagacaaaactaaaattcatatatatatatatatatgataggacgtgtagactaaaggtcagatggcattcacatttctttcatgtatcttcagcagtacccacagggagcactgtgactgcattctcaaattagcaatgatgaaactttttttccagcgggaacatctggcaagacagggctaggaagtgacagctccatcggcctgccaggccagcagtgctgctaagcatgaacggaagtcaggctcactctataatctgagaggcagagtggtgagcaggcagcaggcattcattacagaggctcgcaacaaggcaatttgattcaattagttgaattccaaagtctggaaaaacctaagctgagacagaaattcgagatagcagtgaagctttagtcttgggaaaattgagatatattaacatattttttttttgccaaatgccttccttgttcttgttccacccaaatgactttcctccaggagttttttagagcatacttggcctcagagagagtatgctgttaacatcacaggtggtacagcaggcagagaaaccacaggacagtactctgtggagttctgggtttgagggggtcagctacggggcagctgaacaacccatgctctgagactgcttgatcgacttcaaccagagtaactcttattttatgcgttttatacaagtaagaggaagaaaggttttctcggctttaaaaagaaatgtttgaaaaccacgaatctagaagacttttgtaagattacatgaccactatgattttattttctcttaactttttagctttatttgaaatattatggatctgttatatatatgtggttatatatatatatacacacatatacatatatacacatcacacacacacacacacacacacacacacacacacacacacacacacatatatatagagagagagagcctgtcattccatcattctttctctttgcctgaagccagcattttctgtgcagataaggataatatcttatgagatgacggagccacaggatggaaggtatagcaggaggaaggcaataaaaacaggtaaaaaaaataaaaagagagagaaaggtgatatacattataatagctttgggattaaatgagaaaagtagttcttgatgggacaacttattaacctagaattatgatattggcatggtatttagaacaagaggataaggaaccctgaaaagccaataatggattagacaggcatttttatgtccaaaagtgttagaaaattgagaaaaagactacttgttgttcccttaaacttgtcctctcttcttccacataatggggttaaattgggttcatgcctgccggactagagacaagatacatcagctttttttctggttgctgctgtgaaaatatggttgagcctgtggaatgctaatgaaagtgttgcatgtaactttcaggtcacctctagctaaaagaagttcctcgacctagaattcctcttttttcttcatcttcctataagctggaacatcagtgactgcagttcagctttgactacacaggcaaaacaataccctggagtctgggaaatgcttctcagacctcaacgtgcttaggaatcatgcagagaatcttattagcagacgattctaattccgttatttggagggaggattggagattctgcatttctaaccagcttcctggtgatgctaatgctgtcagcccatgaaccacactttgagtagtagtgctttggaggatgacagaacaacaaatagaaggtcctcggtccttccacaattgcatagagcaaagccaccttgtaaacctgcactgctcatttcaagactattatatgagagaaattaatattcgattctttaaaccactatattatgaatgtctctatttcagtatcatagcctttccttgaatacaaacataactaaaaataaggcagtttcatgtagaacatttaaatgaagcctgtacttccatttgacattacattgtattatctcttgttttgtggggccgtaagttttcacatctgttatcgttaaagaagcttcatttcctttaactgtgtttgttggcatttctctgtcaatcacagcatcatccctttgtaacaactatgcaagggataagaggagaaaaatgcagggaaaccccaagtttctagcttggatatctgggcaaatggtggtgttaccaggtaaaagagaaaagaaaatagactgggatgacatgaataattttgagacatgagaaatttaagatgctatgctgtggaatggcactttaaatttggagaagtctggggagacacgcggccttgggcatcatcaaagtacaggtaagagtgttggcaactccacttattagctatctgacctcgagcaaatcactcatacttcctaagcatccattttctgattagtaatgtgaaagattaaaagaatatctatcgctgagcgttgccatatgtattcaatgaaactacacaaggagaatttagcacaatacttggcacacagaagcactcaataaatctttgttattttttttctgacagctgaaatcatgcacaggtaggactgcagaggtgactttgtagtgtgagaagagaagtggcctgagaatgaaccaacactttcaatgcataaggaacagataaaaataatactcaggagaccaaagaaggaatggtcaggacaagaaaagaaatgggggaaataagagtgtcaaggagagtgtggtcagcagtgaggggatgctgcagagacgtctaataaaatgatgaaggagaagggtttgtgggatcacaaataggtcatcggaaataggtcaccagacaccttattgagaagagcacagaagctgagctgccctaggttggggagtttgtatgggaagaaaagggggagatgagattttagaaagcacagaggaaaacacatggaaaggggtaaagaaatgaggactcagggttgagaagggtcagagtcataaaacagttaagttccagggtgcagtggagattgcaggggagggcttgccttttgctttgacactttgccctcctttcttgaaattacggatctgacaaggatggttggagctaacttcagggtgaatactctgtgttaaaacagtgcgagtgtttggaagctacatggtttagacttggtgagagctggatgcttgtacgtgaagtacctgtgaccttctggtgaaggtcctcacgtgggcaagagctgtcgcctgtgttgtcttcactcctcagatacaaacacagcaacctatcatttacatagacccaccagtgccgatatccctgatgtgccaggctcagctacttaaacttgcctaggaagctgccgtggaccgtggcttctcttttcccacctggatgtactttgtacactcagatttcctgcctgatatggcttttgtaatacagatagctgatatcgtcaggtacttccctctattctggctccttgttctagactcttctgctctgtcctgctgctacccaagtcttggactaacagcagtcctgaaaataaacgaggacaagcagtgctagcagacagtgtgctgccaagtccaaatgcaggtctatcaagtagtgtgaggatcaaatctacaggctgtgagacctgggcttagacatcactgtgctgtttcatcagtggctcttaaaaggctgattgaacataaaagagaaaggctgatcttctgaccacgaggccccagaaaaaagtctacctatcaccatctgagtgctatctacggcagtgcaactttgctgggagggacgtctccaaaatgctgagcactgttaatgataagaacatcacttaacaatgatgtgggactttaaagagcctcaagtgatttcacgcatgtcacctcagttgtaaagtgttttaggtgatctttaggaagacaccctttaaggagtctgagagcctgagtatcccatataattatattccttctgtgggaatggaaaggattaatatactgtgactgttgttggaaagcaaggagtgataaactctctgtgttgtgcatctgtagcaagggaggtatacatgtacaaatacgtctgctacttgcagctcctttgtttacaattagactctgttatggatacaatttctataaaagaataaagagaaacataaaccctcagaagtaagaaaactgtgtctgatgtcactacgaactcacagctacagaaagtggtaacccctctattatttttcccaccactgactgagccttactgatttggggttccttgagtgttcagatattgaagactcccagctgtaggcataaggcagaagcagtgaagaagtagtatctggatattacttgatactacatttttgggaaataaagggaaaggaaagtgctttggactagacactgtctctcaatgttctaggttttctatttcgtgaaaaagagaaatgaattaaggtctattccagagagggcctgaggtatccctaattttgaaaagtcttagatcatggagtaaaatagaagtgaagcaatggacagcaatgaaggactagatttaaaaatgttttcaagacacataggggatcagcttccaacagcacagaatagcctagaagcactagactggccctgtctctagtcatcagggataggggcacgccctctggacaaaggcactgggaagactacaagttaaaggagttaagttgccaatgcagccaagttctataaagcatccttgggaaaaaaggtcaaccgctacagcaacaactacaaaacaatctgtcttatttcaagccgtgtgtgagagctactagtcaggcactgctctttttagcttcatctgtgcccagggagattaactctatctgtagcagcacttgagaaatgctatctgccatgtaggatctgtgtgggatgcagatgaaaagaccagtagagccctaacacagtagacatataacatggtccttggggttgaattattttattgaatggttttgttgtacctctccctgaagctttgcgtaaaagaggtgtttttaaaaatttaataagaggaaatgtttttaccatcttttcatttctaaaattcttgttgaggtaatgttgaccctagagccttttgttaaacatcgttatttgttttgatatgtttccttgttgcaaagctttttttatgaagcaagagttcagattaaagatgaacagaggatttactgcaactagaataaggcgctgaacaatgttcactagcattcacatttccaagctctactagtgatgtgaactatatttagaaaaaagacacggggtctctttttttctctgacagtacatgttttctgtcattcatgcagctatttggtggttatatagtacactgctttgctcttcaaacagaaactttaaatgctactattaatcaggaatatcatttgcatacttttagtctcaactaaaataatttccccaaacttgagtcttcagaagataatgaatgccctgaatgtcaattctatttatttgatatttaaaaaccatgtcctttctcagagcctccaggcacatgcataataacataatccacagaagtacttcaagcagataaatgtaccacacaaccagaattagcagtacacaaatgaatgacttatgttctacctgggtagagcagtacaaaatatgtcattcacatggtggtcaaacaggagtatactcacgttcacttagggagttacaaaaatgaggacctaccatccattccattcatccatccatccatccatccatccatccatccatccatccatccatcccatccatccatccatccatccatccatccatccatccatccatccaaccatccatccgtccacccacttatttactcaacaaatactaacagtatgtttgctatattctaagcactgttctggatgtgtcagtgaacaaaacatatgaaggtgccagtccttgtggggtttaccttctaagtggggaagacagataataattaataagcataataaataaagtatatagtctgttagaaggtgataagtgctgtgaaaaaagagaaagtgcagtggggggatcggaagtactggagtgtgtgtatggtgtggcaggtgcagtattaaatagcgtggttaggggaagtttcattcagaggagaagatttggacaaagatttaaagacagtggattggctgggcacagtgactcatgtctgtaatcccagaactttgggaggccgaggagggcagattgcctgagctcaggagttcgagactagcctgaacaacatggtgaaactctatcgctactaaaatacaaaaacccagccaggcatggtggtatgtgcctgtaatcccagctactcaggaggttaggttgaggcgcgagaattgcttgaacccaggaggcagaggatgcagtgtgttgagattgtgccactgcactccagcctgggtgacaaagcaaaactctgtctcaaaaaataaaaaagtaaaaaataaagacggtggattggctgtgttgagggtgaagatttcaagtagagagaacaactagagcaaaggccctcaggaaggagggtccagcatatgttcaagaaataacaaggagaccaatggggttggagcagtgtgtgtgcacagagaagagagggaaccaggggccagataagtgagggcttataagacctggcaaggattgcctttcaatctgagggaaatggggagtcagggtatgcatttgagcagagttgtgacatgatctggcttacatttcagcagaatcactttgactgctgtgttgagtaaagctaataggtcttttcagaggctgtggaagtaattcagaaggaaggggctagtggcttggataaggtactaaagtaaaggcagcaagaagtagttagattctgggtatcttgacggtagaccagcataatttcctgaaacacaaaataaaatcatccttgttctctaacatggatcaggaatctgtcagtttggtggttgcagctgtgtgtcatgggtctcagcttgaagaggactgtattcgttcatcgtgtgtgggaacatatgggtgactggcagggacaggcttgcagcagtctgtgctcagtgaggattccaggggcctggaaagactctgctcagagattcaaggaataatagatgagtatcagagagaatgggtgattctgaatgattttaaaatctggcactctgactgtgccctggccagtctcccatggaccatcccttaagatgaagaggtttcaattaaatagctgtatcatgaaacatttttggacattgagaacaaaaggagtaggcagaattagcaccagcaactttgtcagcaagaagagatggtgccatattgcagatattggtgccctcaacattgggcaccagcagttggcaatgatggccactttggcaggcttcagtggcattggcagaacattcagttggcattggctaaggtgcccttgatgggaagacactgggtatcatagccagagacacagacatcagtacctttgacacattgggcacctgcagctctgaagcagcccttggcattcattagtggcagatttggcaccttcagtgagtatgaagaggactgagagcacttttggtaggtcctggtggcactgtctcaagctgtggtgacagaagacatcaccacaataggctagagcaagagaggcagaaaagggcagatgtctcatggtcagcggtagtctagttaacagtgcacatgtgacaggagacactttgaatgaatcattagaaggaatttcagtaaggcctagaatatgcagagaagtgttgctctatgattgttgctgttatcctattttgaagccctggttggagttcctgaaaaccccttttatatttatagttaagggataatctaagaactattccactaccattggagtgagaacagcagtcacaacaaaaaatagcttgatctttaggaaaatgtttccagcctcatagtctgttgtatgtgcgtgtgtgtgcatgtgtgtgtgtgtgtgtgtatgtgtgtgtatgtgtgtttgtcagtctagaatttctaattatctcagacaatggagtgactaagaatcttcagctctatttatgggaatccccagtagagtcactcttacaatagttttagtagttattatttatttaattcaataagaatttttaggcactatagtgcatcatatgtataacatcattctagatattgtatatctaggacaatatatatataacatcatcctagatattatataaatgcaaaagggaataaagttcctaccttccaggaatatgtaatttccttgggtatacatttgaaatacatgcaaataaagttctgtgtcacttaacaacagggatacatcagaatgtgtccttaggtgattttgtcattgtgcgaacatcagacagtgtacttacgcaaacctagatggtatcacctgctaaccatctaagctattgctcctagtctataaacttgtccagcatgttactgtactgaaaactgtaggcaacttaacataaattactaggtgatggaaatttttcagctctattataatcttatgggacctcttatatatgtggttcatcactgacccaaatgttgttatatggcacatgactgtatacaaagataagtgccagtttttataagttctagaaaaaaatgctagagtggattggaaacatttgggtgaatttcttttatagtttctcttggggttaatatatggtgaagtaagtgattgtatgtgtgcttgtgtgtacatgtttgtcagagagagggatgcaggtgggaggggtggggggcagagagagagagagagagagacagagagagagaaagggagggtgaatatggacatccatttctctttattgtccctagtcctagtcctagtcctagcaggcacaggcagcatcctctgtctgaagtgactccttcaatgtcctagttggctaaaaacacctgttcattctttgagattcagttcaagcaccatccacctgcccaaaaagctttccctgatccccatgcatttagctcttctctcctcttgtagcattttccacatagtattctagtttttgacatatctatctctgtctaaaatgcaggcagaactccttgaggcagggaccaagtcttctccatgtttccattcccatctctggacttagcatagagctgaaatgaatagacagtctgattgaatggatggacaatgagcaatttgctaatgaatgtctgtgcatggccgtgtgggtgtttgcagacgttatgcctctggagttgctctagcttcctttcatctacctctgagcctgctgggtctcgggacacaaggtaattgttactttatgtctacatcacgtggcactcagaaaagtgatctggctgaagtgcatgataatgtaattgagtcccagaggtgacaggcagggaaattgatctctctatatttactgaaataatctcttgtacatctgtggggaaaatttcacattcaaaactttcttatgatacatttacctcttagtatttagaaaattgtaaatacaatcctttgccaccaagcagtagcttccaagtaaagaaggggttgagggttaaaactaatataatgcattgaagaaaaagcttttaacctgtcaggactctgtgattcataaattataaccttagaaatcatttaaagtgtatccatttagcacttataccttcatgaattcatggaacaacaagtaaagctaaaatgtatttcctcttgaagacatgaaagaggaatcttgcagtttcttgggtactcgtttcctttgataagggcagtagttatctattaactgaatgtctatttactaaaatacaaagcaatagacttgtgtgaaatagtaaaaatggccagtcattttttccccaagatgagtaaattgatgggtgattccacagagtacagagacggggcactccagtaataggaagtagaggaaagcagttaagggcatagactctggagccagcctggccagtttcaatcctgactctgacacttactagtggtgtgacctcaggcaagttacttaacttctttgagctttaatttcttcacctgcaaaatagggatttaattttgagatttaaatgtgttaatttagagttaatctgaagtacttagaatagtgcctggcacgtaggcaattttctatttaagtgattgctattaacataggggtttggcccagaatgtctttctggcatgctgaggaacatcttggggaacgtgtattctttagatagagttcactatggatccacagaagaccaaccatcaggctagaacccaaagccaaaggataggtggaaggactactggtttgaagtagaaaatctcattgattaccgcccctcctcatcccccacaaaaataaccacaaagaaataccacgtaatgaaacagtgcttagcttagggaaggaagaatagtaactatgtcacttgtttagcctgcttcattaagctcactataggtatttgtttgggtttgaaatatttgactcattatagcttgaaggacaaagtgatgaatgaaatttatagctggattgatggcactagctgtatttcagctgtaataaccagaggatggttattacgaatgagaaaaaatagcatctctatctgcctgttagctaaacatatgctttggatcactttttgcttggagtgtcatgagttatcacaaacttccacaacaaagaagttttcttttttaactttgatctatgtattatttgtttttttagagacagggtctcattctgctgtccagactggagtgcagtggtgggatcatagctctctgctctctaactgctgagcttaagcaaagctcctgagtagctaggagtataggtgtgtaccaccatgcctggctaattttttaatttttttggagagacagggtctcactatgttgcccagccttgtcttgaagtccttccctcacgcgatcctcctgccttggcctcccaaagtgctaggattacaggcataagccaacacgcccagccacaacaggtaagttttaaaggtacataggaatggctttttgattcatctgtctccttctccaggaacctactcctgattccctgaacagaagagaccttcccttttacttaacgtacaaaacttgttatttttactcctattatagcttgtttcatgttctgacttgtactatattaagatcatttgcatattggtctgacttcctttgctagactaaaatcttcttgaaggcagatactgtgtaatttcatcttatttttctccttgcactgtgtcttgggacataagtaaatgctcaattcatttgcagacataacttgaacagaaatatctcacttgaatgccattgatggaaaataagaaatatagccaaattctattcaacaattaagttagcacttatttcaattgtatggtaaaggcaggtgacaatgccttattcaaaatggcgaatatgctgttttacagttttcgtgtaaatgcacacagttctgcttttctgtgaaatcacaatgcctttagcaactaaatggaactacactgtcaagatctgactgctcagcttctcagttcacttccattccattctatgctatgtatatttatattgagtccttgcttctaagagatgcagacaggaagatctctctgtattaggcttattcatttaatctctctcttttttttttttttgttttttgagatggagtctcactctgttgcccaggctggagtgcagtggcgggatcttggctcactgcaagctccacctcccgggttcaagtgattctcccgcctcaggcacccaagtagctgaaactaaggtgcgcgccaccatgccaggctacttttgctatttttagtagagacggggtttcaacatattggccagggtggtcttgaactcctgacctcgtgatctgcctgcctcggcctcccaaagtgctgggattacaggtatgagccaccgtgctctgcccatttaatctcttaaatagggaggcatgagttatgactttaaacaccttctcttctagcttctgatggactaaacaataatctttaaatacatttcaaaattatcagtttagtagatgacaatcaaattggaaagttttgccagtttcttatctagaaaatgaataactgcactgtgagaaacccactagctcagagtagaatgttcactatgcaatgcagtcatgggcatttttagtcacggactctcttaggtcagtaattgagttcttttctgttacttcttggctccaggcaaaagcaacatcaaaaatgtattgatttttgttaatttagggagaatttattgaacaaatgcaagtggtcataactaatattgagttcctctaaatgtcagaaacttcatatgcatttttgtatttatatctcacaatgacctaatgtgataagttccactattatctattgttttatagataaggacactgggattagagaatttaagtaacttggccaaggtgacacaagcagtaggtggctaaactgggattaaattagatttaactaaaagctcaagagagttattttttgagcccctgcaagattgcaagttccttaaagatgacttaagtggattatttagcttactcatctcattatccccttagtatccttagggtgctttgaagtacagcgtttagacaatacagtggggtggttaagaacctctgttaagccgcctcagtatgaattctagtttatccacctaaaacagcattcacagattcccatcattttctgtccatttcttgcttaatagttctccatagcatttatcattacctgaaattatatagttttacttctttttttctgggtccctcactagaatttaagctgcacgaggacagtgaccttgtaagtcttgcttcctaacaccaaattctcaatagctagtacagtgcctggcatgcagtaagtggtttaaaaatatctattgaatgaataaataaaaggagatacattttgcttaccgtttatgcctggagtcgtaattttcaatacaattaatgggccaaatgaaccctaccttttttcttggttcagcttcaaaccttctttttaaaagtgtatttaatagacactaatatagcacatatgctttggaaaactccattttatgtgctttacaaatattgacccatttaattctacagagaaggtgaaatcattacatccattctaaaggtgaggaaccaggcacagaaagatttagaaacttgcccatggtcagacaattaggcaaagaatggagccaagattcaaactcggatagtctgaccatgttcccaaccattccattatgctgcttcctagattaatcccataaaaatgtcatttccctggagtttaatgctctaaagatgtgtctttgctctcttagagaatgaccttccatcttgcctatttttccttcctctctacccagattaagaaggaaaataaattaagattattttacttattgaaacagcacagtatgctatcagtgaagcttctctcaggctaccttcaaggataaataagtgaatgaccccggtggctgctggacagctcacatggcctatatctgcttttcttctttttcatatttgtctttttcttgtatttctagagctcttggattcctgctgcaacccttccttctagccttgagaagggagttcagtggtccatggaggctgcaaaaactgccttttaagcctgaaatgtaaaaggaaggccgattttataaatgattcctgttcttgcttttagtcaattggttctttcatttcctgtcccttttcagtttctttcacaaacacacaagcaactcacagccttgggtctctgatatagcaccatattcactcaggaggcaattgtcatgagcacagatatctgggatttagttccagttcagttactaaggagcaatcttccttggggcaagtcatttaataggactgggacttagtttcctcacctgtgaaatgactccagtgagaggaagagctggagatttaaaggtcccttccagctctaaactgtgattattctttgacgaattatgtaaggaagggaaagtgctcagatatctaaagccctatttctctcactacagattgcaggataactccaagggagccactgttctttattaaatgggggtgaacttctcagaattgaaggatgacggctgctggggatagcaatagatcagaacctattttcctgcctaattccttccctatttctctgtaaatatcagaaggagattaggagtaaaagtgatatttcagctctgtggtctacataataaacgattccaagataaattcttaaaaaaaaaaaaaacactaaaaagttctgcctctttagcttgggaagaatgtagtagccatcttgctttgtgaaactgcacaaaaaacttggagcagagcatgggtaagtatgtttgaattgcgtgctctcacgcccagcagttgtttaaaaatctatccagcccatacagttattgcgattttgcattttgtacatatggggctttgtcatttcaaagggtgcaaagagcttcatgaacaatggccattccttctctcgatgtgaccccgtagaacagactagttattggtcatcacttgtaaacaggaagcatgaatctcaccctaggaaatgcaggccgccagtgctgtcatgcttacatgaaggacatgccttatccctttgtaaaacatttaaaaataaaggcactcagtttggaaatatctttgagcatcctaacctgacccattcagaactgacctctaatcagcatttttgtttggctcagtccagtctaataaatattaactgggcattactatgttcatgatctgtgtgctccatacctaggaaaggaagatgaacatggccaagatcctaatcttgagtaagagacaaattagtcaacaggtggtttttatgaggtgtaatgggaacacagaagggttaaatcatctatcccagagagaagatgttgtaaagatttctccaaggcttaagtattaaggaatgaataggagttacccatgggaagaaggatgagagttaaggtacagaaggagatgatgtttctggcacagaatgactagattctcaggaattctatcacatattcctaggaagagagataatacttcttggcctaatttgcagtttaatgagggctatgaacctgaatcctggtgaatcaaatgtgatttaaagtaagtgatgcatttcctgtcctggcaatagaacatcccaagtgatcttctatgttcctctctaccctgctgtcatggcagcccacaaagaactccaggatggaagggtccatgatggaagaagccagggtccctgaattactggttggaggagagctgcctgacccacactggacttagcatgtgtgagaaataaatttaacagtgttaaaccactgagaatttggagctgtttgttacagtggctaggttcattaccctgatcatactgtgtgccaggctaaggaataataaaagggatctgaatgacttgctgtcacttcaacatttatatagcccaaataacttaggtttttgaccttaacattgattactctttcttcctttctcatccaatggcaccaatgatttctttcttaaaaaggtgatcttttacagtctttcagcaagtcaactgctcctcctgagtatattatcagcatcttgtgtcttttaatgacatttgtctattgtatataattatataacattatatctattattatatctattattgtataacatatataatatacaacaaaaaatgtattatcgtatatataatatatgttttatattatatatactatacatttgtattataaaatatatatcatattgtatataataggttataataggaatataatatgttaatgttatacaatatagcatgtatatataatgaaatatcatttcaaaggtatctctatataaaaatcaatttttctcattagaatacacattttatgagggcaagggcttcatctatattactcattactgtaaccctagtgctaagggaaatgactagtatatagtaagcactcacagttattttcagaatgaatgaataaagataaatataatagaatagaggctgggttttttaaaagaaatggacttcagctgtgttcagatgtaggcgttctgaaggcagaaagagctccaaacccagacgagggttgacagttgctcatatgaaggtgatagcagaagctatgcaggcaaatgaaggcgcctcaggagggtaagggaaggaagaagatgagagaattaaggctgaattttagggaatatcaatgtataaaatagactaagtataagcagctaatgaaacaatattagaaaaagtaaggaaagtaaagagagtattgcggcacagaaacagaactctgtaagaatcacagttttggggtcagatctgtgagtacagcatattcaataaacacctgtctattgattgaaataagtgctgaacactgaatagcatatagtcccatgaagatggtcaaaggggctgactccttttctaaaagacatatagccaatgtcatccctgttaattatacacatttctctgggatgacatcaggaggcttgggttaccctggggcctttcactagtctgataaagtaggctatatttctgatctgagttcttccctgtttagaagattctcagaagtatggaaaagttcttaatctagctggatatttattgataagttacgggtcagtaaactatgcctacagtctaagcctggtctattgcctgtttttttaaataaagttatttggaacacagccacactcattcatttctgaatcatctatggctattttcactctgcaacagggttgagtaaccacaatataggacatatggccagcagagtataaaatatttatgatatggcttttcacagaaaaagtttgccaacccctgagcactgagcatatctgttttgcacccccggcaaaaaaacaaaaaacaaaaatacaaaaagcaaaacaaaaaaaaccccacaagacattttcagaactgagtggagcttgtaagaaccctgggaataccacagcctgtcttactaaggactggacctataggaaatagaatattctgtgccttcggtgagactgggtcccgtcatgtatttactttaggttaggacctccatgctaacagtgcacgtatgtgggtgtgagattctctttgaccgtgtatctttaactgatgtccactgggtggtaggccaacactgagtggcagtgagtttaagacatgcaataaaaagaataaaaagaaatgcaagtgaaaagaatgagggtagatggagagtgagtgatgggatgggagaatgaaaataagtcgccctgtcaaaaggtaccatgagagcatctatgcctgtgggctatattttgtcattgcccttctgaaaaataccagaagaaataagaacaagtttctatcatttttctaagtgacagggaaataagactgaaccttcctttctagacttttaaagaaataacattggttgtacacttttccgctaaagcgtacacacatctgcgtcaaccatcaagcctagaatcaataaacatctgaatgttaaggacttagagagcactagcgtctttaagagaatgactctgttctcttgaagatgctagttctttcaaggtccttaaaattatcttcatagaatgtctctgttctcttaaagactctagttctttcaaggtccttaaaattcagatgtaacttctttgaaagaatgtcacattcctaatactcctttcaaaggctgaaataacctgtgatctcatcatattaagacatttctagagtgattctcttcatctatgacataggggtagcagagtgacacctataaccaaatctggcccccaatgctttgttttgttaacaaagtgtttatgaaagaaacccacagtttttttggggggtgaggaggggcaggacttctgctctccagtgtgccacagtttccaccactccatattgtcttttctttaaaagtgtttgagttttcaatccctacaatctctgcccacaccattttgagggggccaactgttgctttgatctattttcttcgttcaggcctaaaattaaatgaccacttgtaactttctagctatgttagtttattagaacccgttttatttgctaacattcttcaagttttgtccaatagagtttagtagactcactgacctaatatatatggtaaaatactcttttcagtaatgaggcaacaatgaagaataaatacattttaagaaactgtgctgttttatgggattactgatttgtgtatatcacttagatcagtgatgttcaggttatgaagtgattatgtacaatttgcaaatatctagtgtccctaacttctgtattatcttatatcatgctacattatacctaactctacagaccagagacatgtgcctcttttttgagtggcagtagcaaaggtggctcttaaatcatctgactgtgaacaatacagtcccaggaagatggcccaaggaaataaagggtgtttttttccttgtagtttttgacggattattccattttaactacaaatgtggacaatggaaactaggctgtaaagtagatcattataaaatgtacctggccaacttctaagatgtaccccaccctgcccgccctaccccatggtccccaccgtctggtattcacgcccttgtgtaaacacctctattatgtatgaactgaatctggtgacttgattgtaatgaatagaaaatggcaaaaagatgggatgtcacttgtgtgattaggtagcaaaagactgtgacttccatcttgctagcactttcttgtcttctcacttgcttgttctgttgaagctagctgcatgttgtgagatgctctatgtggtgacaaggaactaagggaggcctcagccaacagtgtgtgaggcactgaggcctcagtccgaaaatccctaagagcctgaatcctgcctacaaccatgtgagtgagttaggaagtagatcctcttgacttgagtcttgagacagctgtagctgtctgaaagatccagagacagaggacccaatcaacattgtacctggattcctgacccacagaaattgggagataataaatgttgttatatgccactaaaatttggggtaatttgttctttaacaatacagaatataaatcatctattggaataacagcaaaaatttttttagccaaagcctcaaactgaggatagagaagggggtaatttaatccattcattcagaggttctcagtgccattcagtgaaaaaaataaatatatgtagctccaataaatattggttaaactgagcagaactcagaagtaaagggccactaaaattcaggtgttcattatgtagtaaagtaacagtagcaatgaacaaaagtgaataccagacgtcgcactaagatcaagagtcctgtgataacaatatttactagtcatcaaatatttttgggtttgagttttgaggaactccaggatttaaccgaggagaatgagtaggcagagagacaacagcagagatgcagagagtaactacgtattgtggaagccgaaagaagacaatgttaatagtgaaaatttgccccatggggttaacaagaatccttgagcttgccttgcaagaagacagacgaagaaacagcttgttataattctctctgcttgcaacaaaactggctgactggctgaaactggctggaaccaataaggctgactggagtcagaatggcacagaatagactcgctctcctggggggtgacgttttgatgtcacagcctgaatttccacgtcatgtttcagaccagttccccatgaatttgcacaggcaacccacggaaaagcacgaagggacaactgcgcatgctcaacggactttccaaacttcccattcctttctgccaatcactaaccaaccgggaagccccgcccccagaatctctcccttaaatataccgctttaaggctggtacagggcgacggatttgaactggattcctgcctccttgcttggccgccttgcaataaacctttctctctacaaaatccagcgcttcagtgtttggccgcaattgtgtgcaggcaaatgaacccagtttggttgataacaataattgtcaatagtatcagagtctgctgaagtcaaagtagggtggagataacaaagggcttatggaatttctgatcttctgcttactggtgaccttagcactggttgtaggaggtcgcagcagagaaacaactcaagcccttgagggattagtggagcaaaggaaatggggagacgttgagtatagacaactactaagtaattccaaaaggtattataaaactggaaagcattagaagaagaaatattgaaaaacagcgtgagcatacaatataaaagttgcttatgtgctgaaatatactgtcaactcaggttgagggatatgaagagagcagatgcgatatgagccttgacacaaagtcctgcaaacctttaaaatgaaaatcctttgaatgcctgaccttcaggtgttatattatcaaaggacagaagcgtttatgcccttttaaaaaggaaaatgtattagaggattatccaaagacttggccacatacaattcttttctggaaaaaactaagttttatgttgaaaataagtaatcaggtaatatccctgtgtccaaagagacagaaaaagcacaataaacttaacatttctaggacagtagaaaaaaagccattttcttgtggaactttgggtttgtttcctttcataaaaagggaaaaaggtgaaatttgatcttcaagaagtccaggaaagcttttagagctgagaaaagacagagttggggttggtgagggaagtagactctgggtgaaaacggataattaagctttacaaaaggtcaagcattgcaaaagacagcgagaaagatgcattctatgtgttgaatgtatcaaatgtagttgagaagatgtaaatcttcgcattggtgaatatttcagtattaaaaaagacatattaaagaatagctattcttacaaaaggaataaacttttttctttgaagcttgacacaacatatacaaataaaagcatgaaaaatatgctttgaagtgtgctaacacatcaagattgtactgagcaaagcaccttttctctgtttaggaacaatctcactaattccacaacacaatatgttaattaaaggatcccaggtagcaatcatggaatatttcttctcatgacagatgaagaatacaaatattctgaagactgaaattgtataaacaaaatgaagagacattttgtccgttttctggcagtgcaaagttaaagtgaatgcagatgaatgtgctggcaataaaatgacactattaaccatctgaagatcgggctcattacctaagaaggcaaagcatcaatttgtggcattacaacattctatttgtgctgctcaatgtgcgtctggatgtttttatatactctctactaatttgtgtgcagagtgagctcttctgcatcagcctctctatagaagcttaattttgtattgtttctcttatattattttctctaatgagaatgatattctgtattagaaataaacacttcatttattcttcaaataattctacgttcagtttctcttgttttgcattatcaagtggtgtgtacaggattacagatatatcttaaaattgaggtgctctgattaaaaatatacatttgaatgacatgtgaggaaaatattcattcactcagtcactcactcattcattcttaaaagaatgtctatgtattgggttaagcatcatgggaaattcaaggatgttgcactgtctctgccctcaggatgtttatagcatagaagtggctgaatgttattagtaccttgagataggaacaaggacagggccataaaatctcagaggaaagggaaggtcagtgtattttctcataccacaagtattacttgggtacctactatgtgacaggtgctattctagaggctggatatatagaaaagagaataagacagtcaaggtccctgaccttatggaccttgcttcctgagggtgagatggaaaataatgaagaaaaaaagcaaataaataatataacttcagatcacactaagtggcatgaagaaaaataaagcagagcaatagcaagaacagtgatggtaagggaaggatgtgaattttagctcatgaaggcccctgtgaagatgtcacattcgaatagagatttgacaatgtataggagcaagtgtatgaagttctgaaggaagggctttctaggtagtgggacctttgtaggacaggataaagactttattctaagtgggaaggaaattcactggagaattgaagcagggtatagcatgacctgatttatattttagaaggatcattccagatactgtatagaaattcaattatagaggggtaagaaggtaacctggacagaggttaagcatctgtgaatagtccaggatagaggagaacaatgagaacttgattcatgtagtctaaccaaggatgacagactggaatgcactgtggtagtccatctagatagaggtggttggtgaggactaggttgataattacttagatggtaaggagcggttccattttgaaggaagttgcacaaaggaagtgatatgatatgataatatctgagttgaactttaaatgaatggcagcatgtgacaaagcaagtagtcattcatggatttgttgagtgcttatctatttttatgaaccaggcactgtgctaggtgctatagatacagcagtatggaagccattgctgaaagtgagaacaacaaaacttgctgagaaggtaatattttaagtaaacatacacaagcagagaggtgaacaatatgctcataggaattacttcctgaattggttctaaggatgttttattcttttccatttagtgtagaaaattatgtgattaaactcctttgtatatttggctcagtgaatttgcaaaaggagtaagtgtctatcagtagaaattcaattcactgtcagttgggaaatttcatcagacaatttccttagaaatagtggctaatatttacttttcccacttagggagggagaaagtatagcctctctagaaagaataggaggataggagagtacaaaacctaggacaatctcaaatatccaggtgtatctattacagttcatctgccacctgcctccaatctgccccacagtctttttgcaaacagatgacccaacttcaactttccctccttctaatcccacttgtacactgcctctagaattaactggcctaaagtagtccagtcatgtccattccccagtgcctacagaataaatttcaaattcctcagcctgacacacactgacccaacctactttttctgctttatctctgactacacacttctcaattgttttaatcaccttgaattttcttcctctttttaaaattattttttgaattgcatgaatatgttatgaaatacacataacataaaacttaccatcatcgccatttttaggtgtatatttcagtggcatgaagtacatttgcattgttgtacaaatcccattggattttaaatgtctatttccctcatacttccagcaatttgttgcctgaaccaaatttgtttttatatggttcctggggcctcctgaaatgccttttcccatccaagtactaaccagacccgaacttgcttagcttccgagatcagacgagatcgggcacgttcaggttggtatggccatagatctgaaatgcattttcctttccttatcaattaaaatcccacatatctgaaagattcatgctcagattttgcctcttcctttaggctactttgacaccttatctggaaacaggaggtcaactctgttgctaggtaacacactgcttacagtaaaaatgatgcctggttggtaaattgcatctggactaggagggcctatacatgaactataaatacatgatggggatgtgatactttggacttccctgagtaatgactcgtgtaattaggtcccttgtagggaccatggaggataagtctatggagttgttgcaggagatatcgtctcttatggggcaggaggcttttaagccagggccattcctgcacccacccaatatgaatctagtcttcttgaacctgagctgccacctggggggccagaactgatatttgtactgatattaggactctcactgaagagaaaatctgaagcttccctggtggccagcagtgttttctgtatcacatttttctaggtaaatctcaagctaagggttcatgcctgtaatcccagaagtctggaaggccgaggtgggtggatcacctgaagtcaggagttcaagaccagcctggccaacatggcaaaatcccatctctactaaaaatacatacacacacaaaaattagccaggcatggtggtgtgtacccataaccccagctactcaggaagatgaagcaggagaattgcttgaacccaggaggtggaagttgcagtgagcctagatcataccattgcactccagactgggtgacagagagagaccttgtctcaaaacaaaaaaacaataaaacctcaagccaagtgtggcccatagtagtctcataagtctgaatgtgcagttggacctaagaagatctgctcttgaggttgcatcaatatgtagaactactgtactaaatacaaatactccttgcatgcctggactcaaaatcactgggaaccgtacacaggactagggcaataaaagtattgctcacctttggaaggagctggattgcctgtagaattctttgtctgtgcccagaattaaggattccaatttccaacaaatcctgatcttccataacattgcttccctgaaacaaaacagaaatgttacaagttaaatcaagcatttatactgtggataaataacaaggatttatttaatacagagaaaaccagtgagtgacctgatttttatgaacaaagacatagagtcattcttccgtgagggtgagggcagagtcggtcaccttgttactgatgtgaagtctaggagaaagctcccctcccctcacaaatatctatcgtggcttatatccacatggggttatctgcactggagattcattcgtgtgacttaaaactttgtttctgcacattgtgcacatgtaccctaaaacttaaagtataataataataaaataaaaataaataaataaaaaaagatccaaaaaaaaaaactttgtttctgtaaaaatgtgaatgcttctagtaagagttgccatttaagattatcagtgacttacacattgatatgaatgaatcatttttccccccttgatgacagattttgtgcggaaggctgatagaaaaattgacatatattaggcaggttaaaagtgagagttaatacttaatttcaaaatattgagtcacaatagcaaacacatagaatcaacctaaatgcccatcagtgatagcctagataaagaaaatgtggtacatatacaccatggaatactgtgcagccatagaaaagaatgagatcatgtcatttgcagggacatggatggagctggaggtcattatccttagcaaactaatgcaggaacagaaaaccaaacaccacatgttctcgcttataagtaggagctaaatgatgagaacacacggacgtagaggggaataatacacgctggcgcctgttggagggtggaggatggaggagggagaggatcaggaaaaataactcatcagtactaggcttaacacctgggtgatgaaataatctgtacaacaaagccccatgacacaagtttacctacgtaacaaactgcatgtgtactcttgaacataaaataaaagttaaaaaaattattgaatgccagacaccagatcacgatatgaagattgaatgatgaatatgatgcagggccctacccacaactgcctttattccttccagtcccgtgatggaaagggactgttcaaaggcagttaggtaggatgctgagactgtgctatgatggtgacacttgcttaggagtccagagggaatccagggtattttttcagagaaaaggacatctaatcagatataggaaaaatgggtggttaaggcatagcacctaaaagaggaaggacaatggggaaattatgtgcaaagacctgtgagtaagaaggaatgtagtatacttggaagcatcatgttctgggataatatggagagaggagcaaacggtaaggctgaatgagtaagcagagggcagaccatacagatattgcatgccatgctgagggcttcagactttatcctgaccataatgggtagccatggacagcttttaagaaagagagttacatgctgagattccaaatttagaaacattattttgatttctggggctgggcctcagtttccctacctataaaatgataaagttgagcccacaatgtccaaggaccagttcagtcctaaaattctgatttcaatggttattttaaacctgtgattaatatttgaatgcagaagtttacatattgctcattttatccctagattttaatctttcacggtttgtaagacagagtttctctttaaattgaggcgtctatagaggttcaagaattcagatcactattttttttgacaaatcaaactctgtcctacttatgtgtaacacaaaaacgcaagaatagaaatgacagaatatccatttatttagtgatgagtaccattagacactcaaagcaaaggagaatgaatttgaaagggtgattctggggcatggagaccactgtggttgttttctagaggcgctgtgggcatagactaacgtagtagtcacaggagcaaaaagaagcaggtggatttgcaaactatcaggaagtttgacgtggagattgaacatgtggaatgatgcagaaatgtggaatacacaaaaattcaaggcttgggcagtgagtggaacttgatgccttttcctgccataataaaggaggaagaacagccctggtggggcgcaaagtgagactaacatctttccctggacagggacagaatagatgcatgtaaacaacttaataatatcagactatgctataaatggataactggctgtgcttagaaggattaaagccactggaatggcacaacagctagggatttaaaacgggcattcactggacaaaagcattccacctactcatagtgtcattcttatgcttaagcaacaccagccatctcggaggaagcagaatgatccaggtattcagcagcatgataatgaaaagcctaatgaaaaacaaataaagccagtcttggcaacatgccacaggaaatattgctctcaagaaattactcagtgcacacaacagagcatggctgagaatacaaatgacttcatttagagaaagcgttattatttccagaaatggactagtatggcatgagcgagatatgtgataccattctgacttttactctttgaggagttacctggcccttaagaaaaaatctttcgtcatctttgtgctagaacattaccaggttttccaggtcctaacttaccaacccacaacttcagcccatgtagaatagaggacctggtttttttgcagaaacagaaagcatacgaatatcccatagtgtgcatagctactatctctaggtaatcctgacaactggatttcagtgtttgaatactgaaatgttttggtaaattaaatcctaaagatcactgttcttcctctacacctccaatatgctattttctgtatctcagtaagagaggagtccttttgaagaattatagggaagttagatatttttaaagaaggtgttgagtacataagaacatctttttgagccaaatttcctagcatataggataattgccaaacatttttgaaaaatgaaccaaaattatgggaagcacaagaaaaatagtgaaaatgtgtcaaaggggaaatggcactaattgggaaatggaaaggaaaggatttactgtccccagtgaggcatgctgttagaaattttctattttatctttttctataatacatagggatgccaaaaatatcctagtacatcattcagccagccttttgtccaaacactaggggacttggagtctgcagaactgggtttggatcatggcggggcaaacttggctaagtcatacattctttgtaggcttcctggtcctcacccaccaaatgaagcagtttaatgaatatgtattcagtttcaaaatgctatgatttcagccatgtttgatttttggttggtatcattatatataaatatagattgtatattttgaaattatgtttcagtgtttcagaatttgtaacctaaaattagctttaagaagtgattaaagagaaattcaagaatatatatttttttttgacaaatcaatcttggtatgatggacttataaaatttcttattaaaggaaattataaggtaacttatttttgtagtagtacggattcttatagcttttcagggaaaaacaaaatgtttcaaaccttataactatctaaccatttctttggcacctgggtgacagttgtgccatcaaagacaataaacattcccattcttcctagggagctggaattaattctcactttatcacttgcctttactaaatgctagcaaatctcagtttaacttctgttttttttttttttttttttttttgagatggagtttcactgttgttgcccaggctggagtgcaatggcacgatcctggctcactgcaacctctgtctcctgtgttccagtgattctcatgcctcagcctcccaagtagctgggattacaggtgcccgtcaccatgcctggctaacagggtttcatcatgttggccagggtggtctcgaactcctgacctcaggtgatccatctgcctcggcctcccaaagtgctgggattacaggcgtgagcaaccgctcatttttctcaataaaaactgaacacaactctagctttcttcctcctccatcatttttttttttcacataacttttaggtcaatgatttgggggcagagctccgtcatgtccatcttctgtttagtcatctactacactgcactctcaatctcctttcctacccagtacactccagtcccatgttttcatctcccattttcctcctcaacccaccagaataagctgttcccccccatcaactccatagaacttctctgtcaaatgttaagaatgacccctcaattgccaaatatagttgattcttttaaatcttgatttcaagaatttacttgccatatgtaggtgatggccaccatattggacaacaaagatacagaacatcgccatcattgtagcaagttccattagacagtgctactctacagttagagacattgaaactttagtcaaatcacaaaaatggggcagtagcagggaatcaaatcagggactcaaaaatactcatgagtttttctcaggatgtagttattcatgtgcctcttagtcaaagttcatgaacattaagtttaggatctttagcaaattctcttttaattcttcagtcaccaaaagaaattagaaggttgttctactttcagcaacatttctttatggtggggctataaatctatgctatgaaaatgacaagtccaatcactaaattatttttgactttcttagcatccaccaatcacactgcataaggtgtttaaataacaataatcaataaataaagttgtttagttaatgactttctagaatgatcaaagacccaaatgcagtatttttagaatagctgttctttgcctgtcaagaaatgtctaatgcagggtgtctttattgatctcttaaatcatggaatggaaaaagtcacctaatgttttatgcactaatagctgaaagtggaagtttctttgaccacggggagaatatcttaggtactgaacttcttcagctgtgataaactgttaggatgcccaaatagaatgaaaagcagtgttttgtatttaattattcattagaagtaaaacagctatttaccaaaaacatctcaaaaatatctgtactgatggctctgtctctccaaactctgcatttaaaatttcttgtagttttttaaacttaatacgatatcttattcatttagcaagctttccttcatattatatattgtagaaaatgttaggaaaatatatttaaggaccacagggaactggcttattcttaatataaacttgagttggataatgttatttattctcttccttcatccagtccaagactaaaaaaatcaagatgatactgttgattggggaaacttgtttttgctctataattagctaaattagattcttctccacaatttatgtgaccttaaatatttaaaatagaatcactgtataatagaatgacagcaagatcttacaaacttacacatagaaaaacatgtactttagtttgcttttaatatttagccttttataacataaatagcatggtagcatgaaactgtacataattttcttggaataacaatgctacctctctgcttctataaaagctttgagtcaatttgatatcaatttacaagtaaacccaatgcatgtcttctctgcatgattatgataatggttattgtgctaaataccagatttattattcctctgtcagtgttggaacaaagctttatttagcttatcatatagaaacacgggtgactataactgatcagataatggatgatgtgcttcttccaactttaacttcctctctcacattaatgaaatggcagtggaagaaaattctatagtacactaaaaaatccctctaccctaatcctccatttaaacatattctgtctaccgcaataaaatttcttgcatacaacttaagtaaattttcatgtttttagcttatgaagaaagctttctggattcttcagactatgtggactattgattcaaaaaatattacatcactgaccaataagacatcatcttatatgtgcaagctgtgtattttaataaattatatcttaaggttaagatatagtttagcattatatatttaacagctaccatgattacaatgaattttctgtcaccgattttttcctctttatttttgaaacccaattcccctttgaaacatctgttgtcaagctacagagaaagagaaggaatttaagtaaccaggtatttatttgttaaagtatcgagcaggatttggtgatatcataaattataaatgtaattcacttgagatgtgttcatgtaggttttagaattatgtgtatttgtaaaagagtgcaaaataatttatacagtaatttgtactgcctttggtcaaaaattttatagctatgagagaaggagcctattcttcatttttaaggatgctaacccagagctccttcaagtaagaagaaaagttgatgtgaacaaaacttttttgtatgctcttacttctctccagatgcatatatctgtataaatataaagctgatgaatacctactgtcttccttcaactttcacactgatagcagttggtgttcattagtgtaaagtaaatagcacacttactgtgtcaggcactgttctaaataccttccatatattactttatttaattctcacaataactcctatgaggtaggtagcttgttcccatagctgataggagactttctcaagacttaccctatactacctctagcaggaatcatgcaggagataaaaggttgagttaaaaaaacatggttagatccacaccatttatatttttacttcagagtcatctgaaattcacatttgaaagcgagtgttccaatgcatttatgtttgatttcacagtaccgaagcaacaatgaaccctctctatggaagagaacttggagagctgtctggcctaatcttccctgctttgctccagtcctttctgttcactgaatcctggaatcaggcttggcagggacctggggggtttctagtttctagtctaaacgttccctaactacccacaaagcttcaacttctcttttgaagtgtggtgtctcactgggttgacaccatccccagagaggtagggaggatattaaatgctttaaatggtctttcccagcagctgagtctgagcagggggtgcggctggggttggggtggcacctctgtcctactcttttagctcccactgtggtacagaccaagtgttgcaggagagctatctgaagaagaacgtgccagaagcggagatgaaaggaaaacagttagcagctgtcctgtgtccttttgtaatcacaagctgtgaagctgaaaaaaaaaaaaaaaaaaaacttccttgggtaggctgtacataatcttggcagatatctgagtgttgttcttctgtctaatatgctgaacgtttcccagtgcctcacaagagaaaagtgagacagggttaggtgagtttggacaccttgctccgaacaggcagggaacatggcgcccttgtacgttcatcaagctcttgcaaatgccctgtcactgtagatgctgatgcagagctccaaaaggaagggctcctctgcaggagaagcaaaaagaatttgctcctgggtattcccaacacagccacatataatgacgcagaaagaagtacctaaaaagattaccagccattacattcactgtgtagcaggtacttcacccaccttatttataaaccttacagcactcttgtaacataggtggtattattttcatcttatagaggaggaaactgagtctcagagatgtgacactatggagtcaagttcacaagataagtataggatggatctgggatctgtgttttatttggtcagactctgatgctgatgcttccttcactacataaaaagaaccaaatgtttagtaggggacattttctggatggagattccggtccatagatatgtaacgttaccaagaagttactcccatgaccctattttcacacacacaagcttacatctatatttacagaccatagggagtgactgccagagtttctccaacacattgaatttcacataaattatttatcttctgaaaggtcaactggttagttctccttctaaactaccttagtgtattccagaaccaaacatgttaatcaaagtgacccaaggtgtttgtggctaaagcactaactaacttgccatgtttcctgctgtgaggcaggaagtatcagcatggcattaggttgttgtgagagattcagctcttctgcagtgccttgtcaaacgacctgactggtcaactgggaaaatgaagttctcagggccaacatcgtatttgggtgtttttcttttaggtctgtatcaaagccagatttaagaaggagggtgtctacaaatgaacgaaagcagaggatgtctggggacaagctaaggacatttgtgtcccacactgcatgtattctgaatccagagaaaagagagtgagttgcagtctcctgagaaggctatccaggctaaggagcctgtgatggtgaaggtggataatttagccctctgagaagtgtagacctgtcaaaaaggagattcgttaattcttcaaagatatggttgtcttcaaagaacagacatccccagatttaaggatgatggggtctcttgacactgagaactacattcagaaatagccaaacaagaggaaaggagcaaagaggaagagaaagggagggaggaaatgagaggaagtgtttattcttaagggtgaaggtagtggtgaagggagtagaatttcctgataaaatacagaaattcaaatttaagtggcatcatgtatttttattcacttaatctggctgccttagacaggaggtcactgaaatctggaaatgagctggcagagtccagtccagagctaccactgaggcaggcattgtcattcattcatgtagtcagcatttgtttgttcaataaatattttttgagcatttattatgtgccaggcactgggctgtggttgtgagatacaatgagatcaggacagacaaggtccctctacctttagaatttacagtctagtggagaaaaagggaaacagtggaataaaaaaatagataaataattatttagcaaagttttactatataccaagtatttactgtattagtagggactattaagcactttgtcttgtttgttgttcatgataaattctgatgttagtatatacaattattatccttatttacagataatagactaagaattgaaggcacagaaaagctgataattagtctaaggtcacacaggtagtaaaactgacataaagggaatcaatggagttctaaaataaaaaataaacaaataaataacaacggagatctatgttagaaagactggtgaggaaagtctctctgagaaagtgacatgtaattaagacctgaggggattagaaggagcagcctaactgtgagaagagctgttacaaggacattccaggcagaaataacagcaggtgcaaaggcactgaggtgaggaaaaaggtgaggcatgttttaggaacaaacagaagcctactaagaataaaatttagtgactgagggggacgaagacctgggaaagaaacgcaggaaataagacaatacagagacttgcagactctgataaggactttgattgtattccaagtgcaatgggaaacattgaaggaaatatactaatttgcatcttcaaatatactctggattcggtgtggagaatggatggagaaattgggaggtatggaagttgagctcgacaatcaaaattgaaataacagcctagaaacataaataatctaaaggaaatgtgatgaaatatgaccttttgggagactatgggaatgggtctcactggggggggggtcaagtctccaagccaaatgcatcttttatttgaatcaaagagaaaagccatatgacaaggatgaaatcagaatagtctttgataaaggttctatgtggatacaactatgaataaagatttagcagtacctacgaaaatgaaaatgttcagactccatggacccagcaattctgtttcttggtcgtggcagacattgctgggaggctgagtcctttccctctcactacctcccactgcagaggctggataagctaaagttctcagcttccctttaaagcaatggttgaacatgtgacagaagttgtcattggggaacttctggaaaagcttttgctttcctaatgaaaagggaaaaattcacctgctacccttctgtgcccataagaaaggactctcctcaggatgagtggctaaacagttcagagaaggtgacagcgatgggcccacagtccttggacctccaatgatagatatctccattggatacctggaggcaggcaaggataggccatggaagggttagttctgcataaaaaacgttatttaaagctctctccatcttttgcatctaagttgctctgactagtgtttatctgtcagtgaaaataatgatggggatgtgtactgtggcatgtaattaatagaggttataatggaggcaacaggatatttactatttattttaggcagacaggggtatgataacataaagaatagcagagaagggatactaggaagaatgaaagttatcagatccaagttggggtgtgtgtgtttgtgtgtcaattatagcattgcctcttctcattttgacttaacgttgtgaatttctcataaaaagatgacttgaaggaatttctttactctggattttggtttctattaaaaactaaaacggatgcaaaattgccaaagtgctcatgggactaacaggttctaaatctgggagtgggtttcagcttataattgaagatgacaggtgtccagagattgtatgaagttatggttctaaaggaagtacagttttacataaacctggtattctacaggaaaaaatgttactcttgaaatccaaacacattataatcataacagggcagaaacaataagaacatttaggggtatgttaggttgaccttagtgtgtagctcttccaggaactcttgagaagtcagagtttttatttaggtcctttgtaatctggaatgcctttggtgggcagtgaatggcgattattgaaagagttgactgatagaatattcctgacttttccccacatttatttttagttttggttttggtcttgaagacatttttcttaagatgtcttcaggaaaaaaaaaaatttttccacattgaaaactttgttttggctttttcgagtttaaaattcggtgatgggaaaacttgctcacatcacaacaatgggattaagtgtgaggagatgatcgctgtgggcagacaggcaggaggctaaccccacgaagggctaaactaaaagctgagtaagagctccactaagaagagctctttgaactgttctgggactggctagggccactaattgtccttgggttgtatatgaagggaaaatttgtatcagggacacaaatatccttgtcctttgtatagcatctatatcatgaaggatattctcattttttaactccattttcttcactgaataatattactcaacctgaaagaaatacaggggaaagaaacggagggacatgcattctcacagtgaatgtaattaaatgtcctcctgtctagtttttcaagttaaaggttctgagttttgtttccagaatattcaactggtactaaaagcatcatgaagtccctcatatttaattaaatggtgcattattaaaagggggcacactctatctaggttaaagaggtgataaacagctatagaatttcatgtttctttctacttggtattatatgtcttgtttcctttactggacagcaaacttcttgggagaaaggatcatgcctgaagcatctttgcatctcccctaacatctgtttgctaagtgttgaataaaataaaagcttgaaagaatgaatctgtaagtaaaaacatgagttttttagatttattaaaaaacatttagtctaaagatcactaagtaagtttataggaaaagcactgaaattttgagctggaaattctaatatgcaggatgcctgatgtgtttttcccccctaattgaaagaaagataaagatggaattgctggtacaccataacaccaaaatgttcttaatttttttttcagttttgcaaattctcatgatttgattttcatccaggactgtcagttgagacatctgataatctaaaagcattcagagaattaggatcccatatggctcgaaaatatttcctatccggcaggaaaaagagaacataccatgaaaataatactggtatatccttcaatttatgtgtacaaggagcataaataaatttaaatcattattcaaagtataataattataatgatcataaggttgattataacaaccaaaataaaaagaatatacagttcttcataatcatgtgacattataaaaaatcagaagtatacttcaaatcaatgatagtaatagagttgtgtttgtctaacagaagcaacagtcattagaaatgagcacgggattaggagtcctggcttatcactaattaactgtataaatctgaaaaggtaatttaactcccttaggtcttaattttctcaactgagccatgaaagggctagaccagatgttcccttttaacacggcatctgttctggaggttctaacaaggagtacatctactcatacactcctattgcctgaagaataattaattcttcttgctttgggggaaatgtcattttcttcagataagtgttcagtattgagaggtgcacttacataatggtgagggagcaaggagacctgggcttagtcatctaatttcaccaacaaaattattactaacaataacaataacggctattcattgagagttaactgcaggccagacactgtgcttttatcctctgaacaattctataaaatagatatcgctattatcatccccattttacagatgagaaaatggaagcataaagattactaggaacttggctgagatcacacagtaagtggcagagctgctttggaaatgaagatgggtgttggaatcaaattcccctcaccccactggcttcccatagctttgacaagtgtcttctgcatggaattgcctcagagatctgatggatggagtctttctctgccagcccagtcgtctccatgaacctcctttcctacaatttctacccagggattgaggattattaataaaaagaaaaggaattgagtgctcctgggttcaccttacagctctgcactttaatagcagtgtgactcaggatcagcaatcctctttctttgtccgtacaatggggataacactaatgcttatcttttaaggatatggtgacataatgtttatgaagttgctttataaactctaaagtaaaattgctaaaaataaagcatgcctgctaggaactactttttttttttttttttttttttttttttttttttttttttagaacatagcactgtaaatcttctagtttcatgttgtttttgctggaaatagtctattctgaaagaggcagcatgtgtgatggcagaaaaattcagggttcccccccccacccccagctctgccatttacttagctttgtggccttgggaaagtcacttgatctggcatcccacagggtcccatactctacaggccctgcatttggggtttaatttctgtggttgctgttttgaagttcttcctaatttttttctttgagtttgtgtgttataagtgaagtctgaagggacaacggagcatgcgctgggcttggcaccttagatcatgggaggtcttgcttcctgctgcatctccaggatgggttctgccagagaccctcttcattggtctctctatctttagtcctgcccaacctccctttctctgttgagtcctaaaattgctgccatccttcactcctagcaggagtctgggtgccggcagagggagggcttgggtgggtcactcaaacccatggcaccttggggccgagcatggcatcgcccatccctgccctaacaggtagcagcattccaaatcaaatgggtgaccagccagaagctatcccaatccagatatcaagcatgtcctgatgaagagatttaaaaatcctttgcggggtgggggtcccctgtctgctatggatggaggtaatgtggcactggataaaagagatgcctggttagattttctgggaccctgctctatccaggacactgtggtagtcaggagagtgttgggggcctggcagtggggcacctgtgccctgcataggaggcacggtccagggtgcttgcatggggctgcactctcactacaagtgtcttgtgccttggaatgctcctttggctagctccatgcctggagcattctccctccttctaaccgtcctgggtttggcctgtatttgtcttttttgaccagatcaaggcatcctttggataaaaacacaaaatataaactggggaatttggtattccttcataggagttaaatgctttaatattttcatctaaaagtaacattgcacaatataaaaatgaatgacaaaattcatgctaataacataaaattttaatgtttctttacacagaacattaaatagtaaacaaaaaacaccatgacaagtctaaagagagaccacaaaaggaaggaaaaaggtttgtacgtatttttaatggcactctttcccctgccttttgaatagggggccccacattttcattttggactgagctccacagattatgtagctggctgcgctcccaggatgtaaggtttgcataatcacctggtccttgcttcacttcacaggtatatttgcagcagctctgcttgtagttggtaagctcagttaagcaacatagttggactgacttaagaatagcttaccatccaatgatctgtggctttatctttacctttccaagtgggtagaaaaggagtaatgggagccattcccttggaaactactgaggtcatttaaccctaacaaggatgatgcttcactagatgttaattagagatcatttccatttttagttttagttctagaggttgccttaaaaattatgagggcaacaggaaacactgaacttgcctagacttctggggcttctttattcattgacttattcattcacccattcaatcattccctccttcactcacactatcatttcacaacatttactgaagtgctatcatgctgcccacactttaagtatggagaattcaaaagtgattgaggcagtctctctcctaaagaagctcaaagtcactgggggaggggtaaggtggaggtgggatcagaaggcatataaagagattatttttattattgttttgagacagagtcttgctatgtcacccaggctggagtgcagtggcatgatcttggctcattgcaacctccaccctccaggttccagtgattctcctgcttcagcctcctgaatagctgggattacaggcacatgccatcacgcccagctaagttttgtatttttagtaaagattgggttttgccatgttggccacgctggtctcaaactcctgacctcaaatgatccacccgcctcagactcctaaagtgctgggattacaggcgtcagccactgtgcctggtcaaagagactatttttttgatgcagcacatacaatgattatggctgtacagagaaaagattcctgaagtacacagctttggatcaggaaagacattttgggaagcggaacatctctgctacctgctaaatgatgaggaaaagttaaccagaatacaggcaatgcttgaagcaagagagagaaggcactgcgtggatcggttgcagcatgaacaagggcaatgagaaaagaaacggtatagtgagagtgaaaaccagaaagcagtttacagttaaccaggtggaagaaacagggagggagagaccaggtagccagccttgtaagcgatgatgtgaagtgggcttcatcctgtggttctgggcagttggcaagttgttttatgcctggaagggagatggctggatttacaatgtagagagcaaactccagtggctatctgaagtgtggatttgaagggctaaaactggaggttggaagcccatttaaagagctcttgcagccataatacaagagacaatgaagatctggactaggacagcagcagcaggaatggtgatgtattaaagaaatactatagagccaaaactgactgaacttgattattgattaaatataggtattggtagaagacaagtgttaagaataactgtcagcgctcttgtttgggtaactgatggttaaggagtcaggtgagaaatagactttcagaggaggtagagggtttggaggtacagtgttttgttcttgtttttgagacagagtctcactctattacccaggctggagtgcaatggcatgatctcggctcactgcaacctccacctcccgggttcaagcaattattgtgcctcagcctactgaatagctgggattatggatgtgagccaccatgcccagctaatttttgtatttttagtaaagacagggtttcaccatgttgtccaggctggtcttgaactcctgatctcaggtgatccacccacctcagcctcccaaggtgctgggattacaggtatgagcccctgcgctcagccttgaggggctgtgttctgtttgggacatgcttaggggcctgtggaactggaaggaggggatgttagcagacagtgagaggaggctgaagtttggggagaggttcaggctaatgttgtagatttggggatgatcagggctgaggtggtagctgtatgaaatggataaatgcagcactgagaagaaaggggaaatgccatgagagaaagaaggaaaagatgaagttaatgaggaaaagagggagagtgtgtcgtgtcagatgccaagagggtaacgagtttcatgaataaggatatgaaccaactgttaaatatggcagagaagtcttaatggaagtggaaaaggccctttggtttggtaaaatacagcagctcatgaggaccccaggaggagttttccattatgggtacaaaagccagattagaggattgtgagacaaaaggggtggagacaatgaatgtagacgattgttttgagaaatctgaatgagtaagggaggagaaaatgtgcagcacagctggagaaggaacaggatcacaggaagttgctttattttcttcttcttcttcttcttctttttttcactcgtaagaataggaggtgactgggtgcactgggtcatgcccgtaatcccagctttttgggaggctaagataggcagattgcttgagcccatgagttcgagaacagcctaggcaacataggaaaaccccatctctacaaaaaataaaaaagttagctgggcatggtggcatgcacctgtagtcccggctactccgggggctgatgtgggaacatcatttgatcctgggaggcagaggttgcagtaaactgtgatcataccactgcactccaggttgggtgacagagtaagatcctgtctcaaaaaataaaaaactaaaaagaataggagactcttagctgggcatggtggttcacactgtagtggtggccacctgggaggctgagatgggagggaaaattttttgaggtcaggaggttgaagctgcagtgagctatgatcacatcactgcaccccaacctaggcgaccgatagatatgtgttttgaaaacataacgctcagagcaggttgaaaccctgtctcttaaaacaataattgaaaaaaaaaaggagacacttaagcaagtttgcaggcagcaggtaaagcactagtggagagggaagttggatccacaggagagggaaaggaaaactgctggaggtaggaggggtaggcctggggtgagataaagggcctggaagagggaagcaaggatgggtgaggtgtagaatccttactcctgaagcccttcactgctgatacttctgctatccttggcatgtgacaattcctcaagctgaggtcaatgccactgtgtcaattgcatagcaattctctttcttggggattcctataaaaactccctcataacaattccccaagtctctagtcttaccttgacgcccctcagtcttacacaattccttgctattttgactagtttgaggttacccatcatgaactccttcgacatctctcctatcttgatttatatactcttcttggtctcattttttcctgcaatattaaaaattctactgatctttcaaggtccaactcaattgatatcccttatctatgtctcactttcatcttacatatacatttttaaattacttgatgtcttttatgttatcttataagctaatttaaatacttcttaaaacaaggaagggattcaatcaacctatcaatcgtcatgataccctttcctatctcatcttcttttcatcttcttcaactttttgactcatttttatatcattcctctatgaaactattaaaccccttaagggcaagtaaatgttttttgcacctgctctagtatgacaatacattatacataatacctacctactacaattaataaattgtaagctcctggaggacaagaatttaggagttagctagctagatagagatgaatacacatgcagagatatatttacattctctcaagtataccaatttaatctaatacttactatatacttgctagcaattagagatatataaagataaataaaacaaaacacagtctctgtcttccaagggtgccaatccagtgtggcaatcagagaatgagagggcttgaatgacatgctgataaaattggactgtattctgctaggtttcttgcagaacttagggcagaggatattaatagatatgtgttttgaaaagataatgctcagagaaggatgaaggatgaatttgaaaagaatgagattgagggtaggcagatctatgagggggcttttgcaatagtgtagatgacagataataaagatcaagtgagggcaagttggttacagatgagatattgagtgtatatgcgtgtatgtgtatgttgggggagtgaggttgtggtgcacaagaataagtgtccagaagttatttgctaatcttactttttaaaagacattaaatggtaaatagtagtaataactatagcttattacatatcgtgtaacacattcctctagactggccttaggcaatattgagatctgttccatttcaccacttaggatcctctaggcccgattttggcactttattctatatgatcggctatttgttcttctcttattacttcaggtctcaagttttgatcatcctatgagcccatatatccttcagagcaagacaatgtgaataggcatcgttgcacttggtagagggttaggcaaatagtggatgccaaataaatccttgtggaattgaatggtattacctggagttccctgaaggttgtacatcctcttactccttggcctttggaacgtccttctctatacctggaattcttcctctctctctttacctcctctgactactgtctctttacctcactttgaccttcctagttctgtttatcacttcctctaagagttgttgcttgatgcccctgcactgggttagcagattttgctaagtggtccacagaatcacctacttatgtgtttctctgccagctctataaagacagaccagactaccttgcggtaatttgttcagtattttatccccaggttgagcacagcacctggcatacagtagacattcagtaaatatttgttaaatgaacatggttttgtggggttttatttgtaaatctgaacattttgaaatttgaatcttcaaatagctggacataaagtgctagatccatccagacgaaagaaataatgggagaccatctagaaaagtattttgttctttatgctattaaattcagtagaaattagttattatattttttgaggactgttatgcaattaacactctggacaacatgaagacagttcagatttcacctttctatcctgccccccaaggacatgcaaaatatctgcttgggtacccgttttttcatgtgtacacactagcatcttcagttgataagttcctgtggggcaggaacagtaaacttctcagaattagaaagcaaaagtgacagcaaaaacacgacaacatcagaaagccagattctatgtcagaaagtcttaggagttgtagctttagtgttctgcagacaacccaatgtcacaggaaatactaattcccttgctctggggcatttattaaaaacaaaattttttgggaggccgaggcgggcggatcacaaggtcaggagattgagaccatcctggctaatatggtgaaaccccatctctactaaaaaatacaaaaaattagccaggcgttgtggcgggtgcctgtagtcccagctactcggtaggctgaggcaggagaatagcgtgaactcgggaggcagggcttgcagtgagccgagatcatgccattgcactccagcctgggcaacaaagtgagactctgtctcaaaaaaaaaaaaaaaaaaaaactaaaactaaaacaaaattttacttcctactgcctggtaccatattatgcagtagagacagaggggttaaggaaatcaggcatagtccttgttctcatgtagtttgtagttaaggagtgagagaactggcagtgacctgattttgaagaggctgattcaggtcaagacccaattttgaagctggtctccaacaagaagagtggtttctaggaatatagctctgcacaagcaaatacatatcccttagacagtctgtgacatggagtgaaaaaccctccctgacagatcctttactagggatctctgcaagggctcagatctctacttcaatagaaatgctcattggtactatctgaggacgatttttccaagaggcacaaggagatcaattactactggcagcctaatttgcaagataaagaaatttcccattattctagtatcttcgcaaccacagtctacttcagcatcatcagccgacatcatggcatagtggaaaaaaatttggaatagctaaaaagtcacagattagaagttctcatagctgagatgctgctatgtgcttcttgttaaaatccagggttaggacaagggtcagaggattcttgtccttctacacttgagtggcctacagccatgtattcttctaaatcatgttttgaatttcgtcttgaaagataatgttttaagagtgctaagcttatatactcatacaacagaaataatatgtgtgataaagttgggcaagaagtgcttttaaagttgtcggtttctaaaggtgtctttttttaaatgggtacttaatagttatacctatttatgggatatatgtgatatcttgatacaagcatacaaagtgtaatgatcaaatcagtatccatcatctcaagcatttatcatttctttgtgtaaggaacactccaattctactcttttcatcattttggaatacacaagaaattgttaatcatagttgccttattgtgcttcaaaaaagttgtcttttaggttgtcttaaaatttggttacgaattgataacactagtcagaatcatgatttatattctgtagatcatttttttccatttagctttcagttataatacctcacagaataataaagcttgataggttaagtgtcttggtcctgactatcttgagaataatggttggagcaagaactatggtccagacgtctgctctagctgcaatgtttcccctccctactccattacaccacaatgatggatgaatgacggatgctgcagcagaagtaattacagtaaactcaagatataaaaacaattaatatagtgaaaatatataaattaataataaatataaaatacatgcatctttaatattaagatgtaatataatttataaattaatatagcaaatacagtaatatctaatggacagtgaccccatcaccccacttttacacgtgcctctaagagccatttcttatttttgaaggggagcagctacaccctcactctttgggttgcggtgccgtgtagaagtgatgagaatgggaaactgatacactcctgcacagagaagccaatctgaatgccagatgattaagtagaaacctccaccatgctgcctcagacttacaaatgaagtgcaaattaaaatgttagatagacatactcaacagcctgtaacatcacaaggactgtctttggggtatccatttctataaaaagaaaatctggcattcctttttggaacattaggccaaagtagaggataatgagaacagaaatgccttatgcagtcttaataatctttctactcagaggattcagtggaaactagtaactaaaaaagattagccttgcatcaagaccgagctatccagaaatcgcccggcctgggatgcagattcagtcacttaagtgagttgtaacacaggctcacttgtaggtttgccacaattttcttgcaattcagttccttcctctgtcaggctgcaataatgagatgaattcctgcaagaagtactcccagaaagacacagggaggtctgagtagataactaacacagatatctagagaacagaagtgctagacgaagagagaaataaacacacacaataattaaaacaaagatttttttaaaccatagcgacattacacttatctcaatctttaaaatccaggatatctatatctttgtgtatttctcactgaaactttccctgggcctcccaggaagaacataaagaataaagaataggttcattttcttacagattaagagatgtgaggctcaaatgaccttatcctggtaacatagctacattactgcaagagcagcatctttaatccctatgattcctactccagtcactctttaccagtgaaccatcaaagtaggtgatgatgctgaaagaggtacagaagattcagcttgtgaagataagccgaatgacagaaaatgcactttgtgcaaacctccatgcagtgatcacaatgcattttagccagtggttcagttctctctctgtccaactagactatgtaccttgaggatagaaaccatctgtccacctaatgtccccagtagtcagcacagtaactaacacatagtagtcaattaatatttgaagaacgtataaatgaatgaatgaaagcatgaatggatctggaaaagttgccatcaggaattggggccctgaagaaagaatggggttcataaataacattcagcaatcatagtcactgaattgggtactaatattagtgaaaataatagagacagtaaaaccaattataaatagataaagaaggtagtgcttgttctgttttgtttcataaaagattgacaattttatttatgaacacaggatttgagctaaaaagagaacagataagaaggtaggtgactaaagaaatggttgccgagaaaaagtatgaaacagagtttagaacagagaagaggatacagagataattgtaaaggtgtttgacagaaaaagggaaaaggagaaaagaaaaagctttcagtaggacactttatgggcataatagggttcttctttagggcatttcggaagttgagagagcaaagatgagaactcgagagacatggaatggacaaaagagaaagggaggtgagatacatggtactgatcactcacagggaatgaggaagggaagtaaatggcctcaaagaagtcatagctgtcatcgagcagcaaatgccttctgtcatgcaggtggaattaaagcttaaatgtgaactgatggtccatcttcagcttctttctcttctcgctctgatacctgccctcaaggttgctccctggctggtcagggaactcacactgagctgtagaatgttcccaggctctggacctttctgtactgttattcaaccatcagcacttgctagcttctgtcctattctctcaggatgcctgtttttattaaatgacaaaggaagttaattggttcatcaagtagagcaattcctattgtgggcttagctggctactagttaccttgcctattacatataacagcagtgaaataaacataaaggaatgaatgggtgggctttcattacgtgccaggccctgagctagatgcagcagagtatggcagaacaggacatgggctttggagacagacacacccaagacagaggtctggtccataatttcctagctataagcttgaggaagttatctcctagggttcttggattcttcatctgtaagatatgaagaataatttcttcaccctcaatttcctcctctatgaaatggagataatgttgcctacttcgcagggttcaaaatacatataagtgataataatgttatttactatttattcatttatccccactttaaaaaggaaaagctgaggcacagagaagtaaggtgtgactaaggtcacctagctgggaaattctagagctggcatttaaatctagcatttgtctttatgcacttacccaacatactatgtcatcttaaccaatacactaaagcatcattagatgtttccatctacagcctcttacagtggggaaacagtttgatattcaccaatctcatttaaccctcacagcacctctgtgcagtactaacatcttgctttaagatgaggaaaggaaagctcagagaaggtaaccgtggccaaaactcaacataggcccagagaagggaacaccagccaaaactcaaagagctaattagtgacagaacttgaaattagatgtagggtttatgaccacaaatataaatataagaaagagagccaactctgggcccagagtagatgcccacatctttactagttatctaggtggtatttctacattgcttttaaagttctctgatagcaaagctgaaacctggctaggtgttgtaagatagatgagaaactgcaagtcaaggtgtgagttcaatgagtggattttaactcctaacttcaggagtactggtcaattatcctttactgagtggtgctatcagcccacggtaaaataaattagatttttaagaaggtgcagaattgccactataaaatcagataagcctactgcagttgggaataaattctatcatagaaatacatcttgcctgatatcaaaggaagccaagaaaccatgccaagagttggatgaaaactgacattttctgctgtggagacagaagtggtagcactgattggagaattatattttgaagagttctaaaatatttatcatcattctaggtcatttattcatttacccttttaatgctcatttcttttgtgccactaggtcgagcttaaaagcaaagaatgaaaattcactgtgtttttatatattaatatgaagcaggaagtttctctattgcttggtttgaaaaataaaagcgtttctgagaaatattagaacactaaatgttctttcagaaacatggcttttgtcattaataaggatgctgggtgtatctaagcgtgttatgaatttgtacttttttttgtttgataacttcctgtaacttgaagtatttcaagaagggaaaaagctgataaaaactactaaaattgccattgcttcactgtattgattgccccattatgtttctttctagacttgactcaggcatctccttctccaggatgccttttctgctctccattctaattaagatggccttcctctgtgctccaggagcatttacacaaaccactatccatcactgcccttatcacactgcatcgaagctatctgcccgcacatctgtgccccctggaaggcaatcaggacaataaccatggcttatattccacctggtgtcctcagcacctggcatggagccagaactcagcaaatttttaccaaagaacaatgaattttaaaacctgactatagaatggcagaatgctccttctgcctccacgaaatttactttcaagttgaacaattttattaaaaattccattttctaatggtatcagagacctgcaaagctaaagaaaaagcaagtcttatttccaggtcagaacttatttcccaggtcctcactatttggcttatataatattaaaaggtatttttaagagtataatttctatttctcaggcttgaaggatacttttgttagtgtcctcatagctttctattttggctttgcatccagagaaatgaaagaggcttgactcagctgccgcttaatactgcacaagcctgagagagaagactattatataagctaatgtgtattttaaggtgtttttttttttcatagccaatacctaaatgccaccttccaacctcatgaaagtgctgaaccccagtgtgtgggaaagcgaggtcccctacacggctctgtattccttataagtataaaaaataaaagcagttgattaagggttagcaattttcttttctttctttacacgtacttgtaattcatttaatgcaggaagtgggctgagttttcttgttctttccaattcaactctcagggagctttcttgccagcctgctatggttaccatggcaacaaggcgatggtggcagtaatatgatctcatatgccttgtgtcaatagcatcagatcatcacgcttgaggataattttgacaataagcttcagatatagattcaggatatattaccatttgattgatttaccagaaatactgagcaattacagccttaaacttctaataaaagcatgttcacaaaggttagcgtttttccctagatgacatattatatggcattctgaaatttgtaaattgctttcatatatctgcttcaattctcattaggcaggacagatataatcatccccattttatagaagaggaagtaaaggcccgtgcaatgtgctgtgtaaggtggcaaaagcaactccacagtgaagctgaaacttcaacttgaggcttctggcatcagaatcacactttcctcatgcctgtgttaagaattcatgggtattatcaaaatgttcttagatgcataggttagaccctggaatgtctgaattaaaataatgtaaatgtatctgtgataaataactactagtttgagaatattagtattttatatttgggtgatgcttcatacattttatatctcccattacaccttcctttcctaaggcttttctgatactagatgcacaaatagatgcttatctctttctcccactgatcaacatcttgtcttttttgttgttgttgttattagtgacatttatttttccattgtgagttccttgaaagtagggatcatgttattcattcttggaaggtccctgatcctggcacagtatgtatggatctgttatgtatcaggtactgtacataatatgtaccaggtacataacagatacaccataaatgcttgttgcttgttaaactgaactcatctgacacccacaaaccccatgaggtaagtacagctggcattatgatccactattttaataaagtggaaatagaggtcatggatatatcatgggcaatttaattctttccactcccagccatgtgctctttccatgtcgtcctgtttgctttattctttcattgtttctctttcattcattaattcatcaaacatttattagttgctctttctatatcaagcattgctacagataatgggttacaaagataaataagacacaatcctcagcaccaaagggctcacagataatgcagataattttctgcctaggcaagtagtaaaataaaaccttatatggaacttcgagtatgcattatattatttcccaactttattggctctttaaaatgtatcttgagaatatgtttcaagtccctctttaatgcagtgttttagaactggataagccttgagccattgccaatatagggtgatactaattctgcatcttcgttttttttcttgggcataaaatcagcatttccaacatcccacagaatccctaaacttaacgtgtcctcaatgaaactcagtatctgacctgaacgaatgggaagtggcagaaagaggcagatggtcagggtgagatgccagactctgccgtttgatatgacttagggtcagttacaccatctaggggtttcttcattagtatctggcacgaaacacagtgttcaaaatacttcttaaatgtattaattaatgaatgagttgtcaaagaggatgaaaaatgatgacataaaatagggatacctgaagcagtgttagcattagcaggtactcaataaacatcttttaaagagtggactaaatatatacgattcaattccccttcctgaaacatattaaattgccaagacaaaacttctaagttatctttatgtctctttccacatcatagagtcaggtttatttcacctctgcaatgtcttggacttgtgcctttctcttcatccaatagcatgatttgatccaacccccaccctttcactagtagactctcagagaaggcccttgactgaacttcctctctttccagggtctcccattccaccttactggtgaaactcttatttttaaaggataactaggagtgtataactcttctggccagagattttgtattgatttgtatattctaattaagaaactttttagaatggtaatcaagatcctctaaaaggtgatctttagttatacctatagtcattcctttccatatactctaggttttagcttcccctacacacacttttggacttttaagctttcttcctgtattcctagttagtggagtaataacagctttgtaatacttttgcacaacactttgcaatttgtaaggaactcatatatgtttataatgaaactttgtgataacctcagagtaggtggatatgatcattttcatttcaccaattaggaaattgaaaatcagagagttaaatcatacagattctcataacctttatgagaattctattggaaaatatttgtgtctatgatgattgtttaaccatggaatacttgaatcaaactctttaaattaacaactgtgacttcaaaatgctaacgattgacatttgttcagctcgttagcccagaggctaatcatgatgcttttcttctgcatagcaaaagaaactatcaacagagtaaatagacaactacagaatggaagaaaatatttgcaaactatgcatctgacagaagtctaatatacagcatctataaagaatttaaacagggtgggcatggtggctcatgcctgtaatctgagcactttgggaggcggaggctggtgcatcacttgaggtcagaagtttgagaccagcttggccaacatattgaagccccatctctactaaaaatacaaaaattagctgggcgtggtggcatgggcctgcaatcccagctactcaggaggctgaggcagaagaattgcttgaacctgggagatggaggttgcagtgagccgagaccgtaccactgtactccagccttggtgacagagcgagactctgtctcaaaaaaaaaaagaacttaaattcacaagaaataaacaaataactccattaaaaagtggcaaaggatataaaccgatacttttctaaagaagacatacatggagccaagaatcatatgaaaaaaagctcattatcactgatcattagagaaaatgcaaatcaaaaccacaataagataccatctcacaccaatcaaaatggctattattaaaaagtaaaaaaataacagacgctggtgaggttgcagagaaaaggcagcacttacacacgatgggatcataaatttgttcaaccattgtggaaagcagtacggtaattccttaaagagctaaaagcagaactaccatttgactcagcaatcctgttactgggtatatacccagaggaatataaatcatcctcccataaagacacatgcatgcgatgtttactgcagcagtattcacaatagcaaaaacagaatcaacttaaatgcccatcaatgacagatggaatgaagaaaatgtggtaaatttacaccatggaataccatgcagccacaaaaaagaacaagatcatgtcttttgtgggaacatgatggagctggaggccattatccttagcaaactaatgcaggaacagaaaaccaaataccacatgttctcatttgtaagtgggagctaaattatgagaactcatgaacacaaagaagagaataacagatacttgggcctccttgagggtgatggttgggagaagggagaagagcagaaaaaataactattgggtactaggcttagtacctgggtgacaaaataatctgtacaacaaaccctcgtgacactagtttacctatgtaacaaacctgcatatgtaccccacaacctaaaataaaagttaaaaaaaaaatgatgttcttggctgggtgcagtggctcacacctgtaatcccagcactttgggaggctgaggtgggtggatcacttgaggtgaggagtttgagaccagcctgactaacatggtgaaactctgtctctacttaaaaaatacaaaattagccagctgtggtggcgcatgcctgtaatcccagctacttgggaggctgaggcaggagaatcacttgaacccaggaggcagaggttgcagtgagccgagattgcaccattgcactccagcctaggcaacaagagcgagactccgtctcaaaaaaaaaaaaaaaaaaaaaagatgctcttaagctggattgcctgtgtggaatcctggctctactatttcctagctgtgtggtcttggatagattacttaatctctctgtccttcaatttcctcatcattaaactggggataccaatagtttctattgtgtaggattgctgcaaggattagtgaattttatgtgcgtaaagtgctaggataatatctgacacatagcaagcactcctaaatgttgctacccttaaagacacaacctaagaacttctttggctagtccctggtctgagaaggaaaatcaattccttcctcattggtgctaccttgtttgggtcttctatactggggacactatagctgcctcagggtgttggctcaggatagattcagaatatctgaatctacttattgggagcagtcactgagtttctctaagcctcattcaccatctgaaaacacctggataataacagcattttacatcataggattgtggtgatcattttattaactagtacatataaggcatctagtgcttggcatggagtaactaatcagtaaaatttagtgactattactgttacataaatgttttgcccatgatattttgaccttcttgggttaggacctgtctttttcgttatctttatgcctatctttgttgcttcttcacagtagatttaaaaaaaataaacatttaaataaaaaagattttgcttatgagtgtcttggctatatgggctcttttttttgttccatatgaaatttaaagtagtttttttctaattctgtgaagaaagtcaatagtagcttaatggggatagcattgaatccataaattactttgagccatatagtcattttcactatattgattcttcctctccatgaacatggaatgcttttccatttgtttgtgtcctctctgatttccttgagcagtggtttgtagttctccttgaagaggtccttcacatcccttgtaacttatattcctagatattttattctgtttgtagcaattgtgaatgggagttcactcatgatttggctctctgtttgtctattattggtgtataggaatgcttgtgatatttgcacattgattttgtatcctgagactttgctgaagttgcttatcagtgtaaagagattttgggctgagatgatggggttttctaaatatataatcatgtcatctgcaaacagacagtttgacttcctctcttcctatctgaatacgctttatttctttgtcttgcctgattgccctggccagaacttccaacactatgttgaataggagtggtgagagagggcatccttgtcttgtgcccattttctaagggaatgcttccagtttttgcccattcagtatgatatgggctgtgggtttgtcataaatagctcttattattttgagataagttccatcaatacctagcttattgagtttttagcatgaagggctgttgaattttgttgaaggccttttctgtacctactgagataatcatatggtttttgtcattggttctgtttatgtgatggattatgtttattgatttgtgtatgttgaaccaaccttgcatcctagggaggaagctgatttgattgtggtggataagctttttgatgtgctgctggattcagtttgcctgtattttattgaggattttagcctcgatattcatcaggaatattggcctgaaattttattttcttgttgggtctctgccagattttggtatcaggatgaggctggcctcataaaatgagttagggaggagtccctctttttctattgtttgaaatagtttcagaaggaatggtaccagcttctctttgcacatctggtagaattcggctgtgaatctgtctggtcctgggcttgtgttggttgctaggctattaattactgcctcaatttcagaaattgttattggtctattcagggattcaacttcttcctggtttagtcttgggagggtttatgtgtccagggatttatccatttcttctagattttctagtttatatgcatagaggtatttatagcattttctgatggtagcttgtatttctgtgggatcagtggtgatatcccctttatcatttatttaaatacaaaagatttttcaataaaaatgattaaagtagcaggatagaacaatctttgcagagaaaatcccaaactctaagtggatggatgctgagactgtatgcaaaaacgctaaattctagaaagagttaaatttgaaaatatctattcttattacaaaatattgatctagtggttgttgggaaaatataaatgtaccatataataaattgggtttggattattaaaattctattaccttgtccacaatggaagcaagaatataaatgactttataaaactaaaaagttttaaattttcttctgtacattggcatatctcacaaaggaatggaattggttacactgcatatgagaacattttgatgcagtataatcttttattgtgcagctttatatagcaccctttcctgaaagagtgactgtacagcgcctggtgttctaaatccagtcgctaactcaaaccttttcactttcataaagaggttttgggaatgaagttaatattccatttaccaaactaaaatataatattatgtgctgcaatgctgtgagcccacccacccaccagactgcagataatcttctattcatatgctcaaatcaagtactatgcatatttctagctcactatcaaaagtaactgcacatatacacaaagaaaggatagaagaaaatgaatgagcagtcaaaaatgactgcaggcgactttaacaatacaagatcagccatttttgacaaatatttgatttgaaattcactgatcttctattaggactcaagggctggcaggagtaacgaatttcctgagcttctcttatgtatgttcagaagtattggatcagtttttggtctcggggtaacaacaatagcagcaaaacagtaacagcaaccaacatgcactgagtttacttcacaccagcactcaggcagaacttctgcttcagcagggtgaataagagcccccaaaggtatcagatcctaatccctggaacctgtaaattatgccttattaggagacaggaacttgcagttgtgattaacttaaggatcctgagatggggagattaccatggattatctggatgggccctaaatacaaacacatgtatcttataaaatagatggaaagggagctttgacagacaaaagaggaggaggcattgtgaccacagaggcagaaattggagtgatgtgggcacaaatcagggtatgctgacagccgccagatgctagaagaggtaaggaacatattaccctctagagcttctggagggaatgagcccctgctgacaccttgattttgcccaagtgatacttattttgaattcctgttctccaaaacttggagagaagataaatgttttttttagccagcaagttcatggtaatttgttacagcagccatgggaaactaaattaagcatccaaccattgaactaatatactaatatattgctgaactttggttcattccttcataagcctcccaaattcttgatttctttgttctgtgggggctgctgctggtaagagtagagctattaaagcatccttccatgtgaagcatcacctgctgacatttttgcagaatcccttccattgtcagccctacctacttacaagttgaaattgacacacaggtgcagtgagtcaaggtctgacttgaatgctttgcttttctctcagtagattttcttaaattcagcaagtcctcacttaatgtcatggataagatcttggagattgcaactgtaattgaaactatgtataaagaaaccaatttgaccacagtcaaatcaatataaacaagagttcagttcctatggtatatttctggtcaaagaaagtaatcaccaaacttctaaataaagaagcaaatacttctaatattaaacatcaaaataaatgggagctatacatacatttaagaaatattaatgaaaaggaagatgatgatttacccaattattccagttcaaggtcgcctgtcccggcaactcagggcaccaggtgggaacgcaccctggacgggacaccctcccatcgcagggcatactcacacccacattcgcactcactcagactgggaccatgtagacttgccaattcacctagcattaagcacatccttgggccgtggaaggaaaccggagtgcctggagaaaacccatgcagtcatggggagaacaagcaaactccacgcagacagtgacccgggctgggagtcaattttttttcttatcaacatcataaggaaacagcattacaggaaatggtgtaacttgaggacttgctctatagaactacacatgccattatttcagtatgtttcttttcttgtttgatctcattcatttgcacacttgaatccaccaataattaaaaacatctgtgaatataatcaatacataagtaatgaatttattgtttctttgggccagaaaactgttaagaacttgttatatgcaaggcattggtttagaaaccagatattcaatgataaattcttgacctcacttaaattcttattgagatgaaaagaaatattatcaagtcacaaacagtacaaagctgggtgtgaaaatgccataaggagaagatggagacaacgctgacattcagatttctggcttaaatgactgaaaaaatagtgatgccatttactgacatgggaactgcaggagaagcagcagatttgggaagagcagtggatttgaggtccctggggggcatccacgtggaaaaacaggcctgatgttaaggagagagaacttagaggttttgaaattatctgggcattggtgataattaaaatcctaggaatggaactcattgctcctggacattgcataatgggagaagaaaagagaggcttagaaaaagtacagggctagtaaagcgtatcgcatattaagagaatgatgactaacctaatttgagatttaaagggatctgataggagataaattaaaaatcagttgggtctatccaaagaggataaccctatatgccagcctccaaaatttagactttttttttttttggtcatatgtattgagtcatagttagaggttttaatttggggactagtaggattatagctatgcttataaggtaaatccagggtagtgtgtaggatggacattagagagaaaagacagaggctgaagagttgagttggaatgttaatgtgatgatctagaattagaggtaatgaaggcctgaagaactgttttaacagtgtgtgtatgtaggtatgtgtgtgtgtgtgtgtgtgtgtgtgtgtgtgtgtgtattttccccccaaatatactaaataaaattggtatcaacatttcttatcaacactatagggaaacagcattaaaggaaattatgttacttaaggtacttgaggtttgatgttcactcaaacacttttgagtatttatttctgcattaaaggtcttgcatttcatacatacaggtgaaaaaagaggaaggcaagatgtcaagagaaaaaaatgtggcatatggcctgacccagtttatttgttgagaactttgtggaagcaggatcagtaggatgcgctgcgatgtatcctggcagtggagaggaaagttaataataaccatagccacgggatgaacagtggctgctcactgagtgttgctaagggccatcaagaggtgaatgaaaagaattatccttttgttcccttcatggagatgctggcaaatgaactgaatttaactcaatgaaccacaaagcctaagggtaactgttttcctttgtggtttgcttattgaaagtcactgctgagctgatacgggtgttggggacaatgtctttgaccttggagttcttaaaaccatcctcagactcaatgaacagttggtaaggttttaggaatgtcctagcaaaagcactctggattctgcaggcaagtgggataattcctgaagtattattttaaaaattgtgtgaaacagtggaaatacactatttggagtcagatagatgagggtttgagtgccatttctatcacttggtgatcctgagaaaatcagtctccttaagccttaggcaaaatggggataatgatcgattttgtgaaaatgttaataaaataatatatggaaaaataatatatttgaatttatagatgagacttaatagataaatgtgactgccctcccatacttaaggtcactaaaaatattaattaagagtatgttgaatagaagaatttggaaaagaaaatcaagctagagagaatgggagaaatttccttaagaaacaaaacataaaattttattaggactatttgatttgcttaactgaaactctatcaaaagccattttctggtttttacatgaatcttcaaatatttctaatcagcagtttttctcttaactgccactcagcttttggttggatgatgcagagatgtaggtgtttcgagtaactaatacaattcccttctagggtatgttgcagggtgccttaacttactgtgtatgcaaggtaaataactcctaatatgagacaacaaacaaaatacatgtctaatcaattcagaaaaatgtttaggaagctccataaacatgttttcataaacgcttgctggcagccaacttgcctggctttcagagttgctataacaaccagcagtcctctcagcagccttggcactctgcattcttacatcttttaataagaaatatcattatcttgtctgggctcattagctcaattatttaaagcatggtactagtaaagccaaggtagagggttcaaaagtatgcattagcaagaaaattctatccatgtgtcctttgccaaggcgacttgttcattcattcattcatttaaaaatatttattgaatgtctgccatgtgccaggttctgttctaggagctagaaataaatcagtaaaattaaaaaaaaaatatatatatatatataaacatgtatataaaccaacaaaacaacaacaacaaaaaaccaacaaaaaaaccccaaaaaaacaaaaataattaagatgccagttttagtgatgtctatagtctggtttgaggggcaagaagggagacagatgctgactaagcaacaaattaatatacatgtagaaatacatgtagagtgagaacaatgaagacaaagcagggaaaggagacaggtgctgtgttagggtgaggagaaagtgcctcttgatatggtgacattagagcagagatttcgatgaattgaataagaaaagctgtagctaagtcatggaagaacgttttaaacagaaggttagcagggcacaagctctgaggtgagagtgtgcttggccggatcaggaccagccaggagacctgtatgactggggtattagtcagggttctctaaagggacagaactaagtggatagatgaatatatgaaggggagtttattaaggagtattgactcacaagatcataaggtgaagtcccacaataggccacctgcaagctgaggagccaggaaaccagtccaagtccccaaacctcaaaagtaggaaggtagatagtgcagctttcagtctgtggcctaaggcccgagagcccctggcaaatcactggtataagtgcaagagtccaaaagccgacgaatctggagtctgatgtatgagggcaggaagcatagtacaggagaaagatggaggccagaagactcagccagtctagtcctttcacgttcccctgcctgcttttatcccagccacactggaagttgattagatggtgcccacccagattgagggtgggtctgcctctcccaacccactgactttggcaacaccctcacaaacacacccaggaacaatacattgcatccttcaacccaatgaagttgacactcaattgtaaccatcacaattggagtggagtgctcaagggaagaacagaaggtgatgaaatcagacaggaagagatgatctgtccatgcagggtcttggaaaccactgtaagggattttagattttattctgagtgagacaggaaacgaatgcagagttctgagtaaaggggtaatataatctgacatctactttaggaaaaattgctttggatccagagactctacgtaggggctcaagaaggaaaggggatctgttaggaggttattgcaattaaacagaggagaggtgatgacagcttagagcaggtgccaaggatttaagaaataatcagactctggatgtttttagaggtagtgccagtgggatttgctgatgaaataaatgtgaagtttttctcttgagcactagaaaaatgaagacagcatttccgccctggggaagactgaaaaataaaagcatgcacaaacttatttgtgtgcatgtgtgtgtgtgtgtgtatgtgtgtaaggcagaatggagttgtggatgccttaatgttgagatttctgtgagacatctaagtggatactttcatctaggcaactaaatgtaaataataaaatctctttatagatttcagagttcaggagagatgtctgggctaaagatacaactgtaagagtcatcagtttatagatgtaatgtaagccacgggtctgaataaggacacctaggaagtaaaaatgatagagaatagaacacaaagaactgagcctttgggtaatacaatgttagacttgggaaagataggggaggggcatccaaaaggagagaatgagaaggaatggcctgcaagatggaaaaaccaagagataatgggggtattggaagaaaattaattcaatatgaaggaatttatcagttaagtcaaatgctgatgataggtcatataaaatgagggctgagaattgacaaattcggcaatgggaaagtcactgatgactgtagttagatcacttttagtagggtggaaaagagaaaaatttcctgttaaagagagaatagaggtgaagatggtgattacaagatcttttgggaggttttgctataaagtgagctgaaaaattggacagtaactgggggtaatgtagggtaaacagaattttaaaaattcaaatgaggacttattgtgacatgtttgcatgctgatgaggataatcgacagagaggggaaaattgatgatgtgcgtgagagcaggggtagtgaagcctttgagtagacaagaggggccacatagtttaaatgtgggaaatttcattcattcattccaaaaagttaagcaaacatctaccatgtgccaaatacacagctaagtactaggaacacagaaatgaataaaacatggttcccattatcaaagaagtcatttctttgggagggagaataagcattttctctaattaataattcacgttcaatgcagtgatggtaatgtcagagaaatgtacccagggctcttttctgggatcttttcattacagcatgctgaatcttgggctgccatgtcattagaagcctagattcaagaccttcatttccatcatgcattgacatgttctgggctgtactactgatgagactgatttaggcaagagttctgggcatgaattggtgctgtggctgcacagataaagtcgaggtgatagatttgagaactgtgtgctaggtaaatcagcaatcctggtgattggttgacttgaagtaaggtaaagaagagggaggctcaaggataactcctaggtttcccatatttagttttatcctggaagcgaggatgctgataaacagattcctaacaggtagcgtgggtggataagaagaagaatctgggcccttttcttaaaaaaaattaaggtctgataaatacctgatactttcaaaaatatttgaaagcagccagatatttctgtctataaaaagaaaaaaaaaatagacctgatctctataggatgtcacaaacgctcaaaaaataaaagataggaaagactaataatacaatgctagaacactttttgatactacctaagagacttaagaaaaaaaacaccaaacccccaaaacacagagttcttggtatgatgtatttgtttttccatagaatggtttgagaaattcagtgaaaattaattggaacatgtggttgtcattcacatggttccagactttatgggcttaataaaaacattatgaatagtttttggagttttgggagaagcgaacatggctggtctaggtatctgcttttaggttaatccctctacgcaggaagtttcacagtgtcatacagtgcttttcaatttttcccactcaaatgctcccactatcagagggatgagaatgagcttccctggatggcagaggaagaaagggggtagggtagtctgagggtgtaacttgaagtttcaagttgcaaacataaagtttcctttaagtctagtatttcaatttaacagtttagcaaattttctgtgcaattccgtaaaatattcatttctttcatatagaaataatagagtctccccctccccccaccttaccctgctctgaatcactgagtaaaacctatgcatggcgaagatatgtcatgttttatctcatgactttgattgcatccttgtatcctgtcacaaagcaggggaaggggaaagacacagaaccaagtttcaggaggcctggactcttctacgccagttcgacatttattttttaattttctttgcactctacttatttccaagaggagttttggagttgctgtaagacttttagaaaatataaatgatctgtgccttgatttccttatttctaaaaacaaagaagttactctacatgatctctatattcccttcttatcgattaagagtctacccacttttggtccaagcaaaatgttaacagggctagtggatggtggtaccaaatgtatactggtaaccgatcaattaacattttggaaaaaatggaatattcagctaagatttgagtcatgatggaaaccttgaatttaaaaaaaactaaccttgggagattattagaacttagaatccacatatttgacatgtgctgtaaaaagaggttatttcttgagaagtagaattgcaactttctgctgaaaaaatatcaatcctccaaggcatcctcagtaagcccacaggcaaactcccacctcagcagactgaataatttgcctataaaatatcacgttgaatttgggaggctgaatatggtgggaaaagtttcatgtaggagaggacctgccctggagatgctcgctgaggtggcaaaggcaactggactctcaaagtagtcctccgtttaacaacatccctttctcaggtacttctctcatctgcccgattacttttttttttaaagcctgacaggaatgatgcttccagattctgagatggtaacaatgatctaaatagactgtcatcatttatcagcattcacaaagagaaaacagctatgaatttccagtgggaaaaaaaactttagaatcaaaaaagcaaaaggtacataatgctgtatccagtgaaaacttataaaagtgtaatgttcgctttaaacacaatacaccaccctgagagggttgccttcagtaaggaattgttttcctctgggaaggaaatcactggcaataccaaatctataaggagtgccttagaaacttggctgcaccaagggccgtgtagttttgggaaaactcagcctgttttctttgtctctagacattttttagacttgataatccctcacatgggtgttggggtgtcttcaaggtctccaactctgtgctgtacttcgatcagcaaatgcttggggagaatttctgttttgattgcatctgccatttgcctccacaaattagacttttttaaataaaatgtaatccttttttgctgagacaaggatgaacacaatttattttgaaaagatacataaaatgtattataaaagacacaatgtgcaaaccagaaattgaaaactaaaaacgaacatcacctacacagaaaattctaagttcttaaaccagttggttgaacgaccttgggcaagttgtttaacttctttgaatcaatttcttctttatctgtaaaataaatacttataatcgtttcaagaaagtttattgactagaatccctggagccattcaaacagattcatattagccctcagcgtggctaatggcttcatctcaattctaagtgcggcacatactttcttgaaagtattgttaagtatttattttatagatgaaaactggttaaaaactacacagtagctgcatactgtaatggattctgaaaaggcctagttcaaactctgaccttctataaataacattgtggcctgccatatgaaaagacagtattgctagtgtcctgttgctgcatgggtgatgaaattaggacacggaccatgaatgagttgcctgattctgaatcagactatcaggcagtacagaaggatgccttcctctaagagttcattatttcctattagaatgctgtgtgtgctgcacatagaattgaggtggagcccttagccacactgatggctaatttgaacctgtttgaatggctccagggattccagccaataaacagaaacttgtctgttcatctgtacattcctctcaaattggttgaaataaatcctcaacacttgatgtttctgacctggttcacagatactcaggagcagcctgtggtatagcattatgagaaattttccagtctgttgagtagaagtaatccaatcctgtcactgtttgtggtagaaaggagagagaatatagagatgagatccaagaaaacaagaaaagttctgaggcctagaagaagtggaattctgtggcaaaaagtctggagaaactgaatttgagtttatggaaaaagccaaaagacagaacatcctggagaatagagccactctttgactggaagcttggaggatgattgtgagtagaatggcctatgtctaattctacatgcaggaggatggagcaggtggggccgtttcagggccaggaaagggtctcccttctactggactgggatgaaacaagagccaaggaacaaattgagttgcagtagcagatagaggaggtccagtctgagggtaaagcatggtgtccaagtagcattcagcaatggcagagcataaagtagatagttccaactggtagcccaagataaagaagcattcaaatgtatgcctgtggatggtgttcccttcccacaaggcacagaggattctgggtcaggcatcactcagagttccagagggaagggtatacatctgtcaatgcatagcaggtctcagttattcagcccaaagcaaaccattggctaaaacctttgataaaaagaaatgtgacatgtagcatggagggtggggcaagactgaggctcaggaatgggacagggcctgtcagaattaccagaagtgaggcagcaccacaagactagatcagcagcaagagttatttgaggtgcagtcacaaaaggtgagttagaatttaaatacatgccactttgggtctgatttggtcttaagtgtgtaggccaaggctcagtcttgaggtagagcatgatctcatttgtggtaagttgagagtatgctgaaattcagcatgaaaatggagatcagagatcctccaccttgctgtcagtctagacagagactgaaaaactgggttaaaactttaaagtctttatatcttggatatggagataaacaaggtaatactgcctggataaataggggaagaagctatcaaaatggtattgatctttccatttaagactatctattaccattcatctcttcaacatttgaaaagatgttcagtataacattgggattttaagtgatgattgtatcaaaaaatgataagtttaaaacattttaaacttatcagtgcacaagaacgggatgaatgcttatccagtatttctttctgtatttattatttgagtaaatcatgagtaataggttggtcccttatttaaaattttagttatggtcaattttaagaggaacacaataatctttttttttgtcttctgtacagttatatcaattttagcagtttggtgtctagttttaccaatgctattttatgatctttgccatttgccatggtacaatgtgtttaaatggcacatcaaggtatactgatggttgccatttgcttaataacttaaaagtaatccagcaatttcttccacttttatttcttaacatatgattttgttttgtgaaacatgaaagatgagtcttatatttaggaaccatttggttgggaagctgggagagtaaaatttaattgattttttttcttctgcagctcttgaagaaatagcatgtgaatccagattaggtggcatcatgtatatttttgtaaaaggaatttttacttgcttaggctgaattcatccttataagcctccctcagccatccttaattcctccctttctctcactcctgaagtcaaggattactatgttttattcctttttctgctgcaatatcccggactcttctctgtccatcactatagccacatcagctaataagctcctcttcctgtgtccttcttccctctctactcatcctctatagtgccatcaaagtcagagtattaataaacaaatcctgacatgtcagtgtgcttactccccacattttgaacggattaagttcaaatgcctcacaggatggcatttgaggtgctgatcctaatttatctttctaaccttgtttcttgcctctttcttccattcctcacatgcaaacactgaactccagtaacaccactttgtcttctcaacatactctgcactattgtgtcttcatgccccttggtacatgctatttcctctgcccagatattcttcctgggcttctgtacctgttgaccccttcaactcatcctttaaggactggttcaaagaccacttctgtgacatcatccctgattcccacagagttaaacaagacttctatgacacgccacagcatctgaaatacatctgtgctggaaacttctactatattgccttgtaatgatttgttagtgaacctctctcttccacttggtctgtagctccagaaaaccagtggctgtttgttgcctactcgtctttgctttattcttccttctgcctgtccacctgctctcccaacatccaggggccaggacagtccctggcacacaatgaacacccaacaaacacttggtttaagcaatgaattattatcttgcacgagatttcatgagtctctttagttttgctttcttaacttacttaatgcttattaagatgacttttcactttcagttcttcctgtttgattccagttcttagtcatgtcttccccttggcacaaaactgattgagcaatatatgctgaagcctcactcttcaaatttcatgacaaagtctgagggtcccaggactttggccaagcacaaatagtaagtgtctgggaggcatcaactaaattatctgccagtgaaaatgctctgtcttctttgtctcagttgtttatgcagaacaaccaaccgttcctgtaaagttatttttcctaatttttagcctaaacttttcaatagatacaggccatttctccctgtctcctcctatctcctcatcttctgagactgtaaattatcctgtaacttcatttataatgggaacatatttattttctgtgatgatggctcccctgagcctttctttttcttagctacataaagttaacttcctctgtggcaaattaaggacagattacaagcagcctgggaaccgggctccgtcaccacagggggccgcctactcagcctccttctgttcagccatgggaaagatgcagctgctaagccagccgggtgctgggctgctctccccctgcctctcctgatccctcggagggagttgagaagtccctttctccatcagtctctggttggtgtctgatgctctgttttctagcctctcttcttctgctcctcccctcccccagctgcctaccaactccttcccacccccaggccagcagtgactgcctccaagactccccctccttccagcaccgcctcatggtttccatggcaacagaaaatgttggtgggaagcaaaaatgctgaactgcaactcgtgttggggctgggaggaggaggtgaaatgtgggcctctctggaggctgtagaaaggtggggagaaagaagccaggtgagaagccctgagaagaaaggaccacgaggctcgaaaggaaggtgcattggcaagcggggatcactttgatcagaaaaatcagctaggaggaagaaataggaaagagttataaaaagtaatagagaatcctgggccgggtgaagtggctcacacctgtaatcccagaactttgggaggctgagatgagaggactgcttgagcccaggagtttgagaccggcttagacaacatagcgagaccttgtccccgccttcaaaaaaaaaaaaaagtaatgaagaatcctatatatagtggttgattgagggattacgttaggtataaaactgggaataggtgactttatattgaaggtgagtagtgaaagtcaacaaacatagtggccaaaaaaaggggggcttgagagtttaacaataatatacatacatgaaaaacaaaagtaatattaacagatctgggcttgtaaattaactattgtccttacttatcagccaagtgttacttatcttctctgagccttagtcttctttttgcttgtctattaatatagtgttatcaatatccacctcaaaaagttgttgtgaggatcaagtttaaataaagcacataaagtggccactcatatagcaggtaaggtaggaatttttcttttaaccattgtatgaggttgaggaatggtacttcaaatgggtcttggagctggaaacttaaaattcattgaaaactgtgccttgtcatatatttgatttttgtatttatttcaattttccatatctcttaagtatatggcaacatggtttttttttttcttttttttctttttctttctttctttttttttttttgagacagagtattgctctgtcgcccaggctggagtacagtggtgcgatctcggctcactgcaacctctgcctcccaggttcaagcaattcttccgcctcagcctcccaagtagctgggattacaggaacatgccaccacgcccagctatttttttgtatttttagtagagacagggtttcaccatgttggtcaggctggtctcaaactcctgacctcaggtgatccacctgcctcggcctcccaaagtgctgggattacaggcgtgagccaccatgcccagccagcatcatgtgactacgtccctaagtacatagtaccatggcaatatttagtgttaaccccttcataaaaaataagaagaaccatcctttccttttaaataacctccctgtctgtgcttttcaagaagcctgtggtgttgactcattctctctcctttacagccacaatattgttggcatcataacttctcatttcttttctctctcttcagtgaaaggggttgctgcagaaattatgttctaaacccacaatcatgtttataatggtccacgaatattttttgactgaatgtctgtgtcatcacttccttcagaagtccaaggcaagaaaagctaagaagttgtggcccaactagagatgcccataagcctatttactccgggctgtctctttgcaatcttagaagatgtcaagttactgcagaggctctacttcatgcctccttttcctgaaattgggacaataatagcaacgatgataactagcgcctgaacttgttgttccaaagtgcctgacatgaatggaatcatataaacttcaactcaacccaatggaattagcatgttgttaccgtgacggtttccacatgtggaaactgaagcacagagacattaagtaattttcttaaggtaatatacctcgtaagtttcagggctggaatttgaatctaggcagaatctacctccttaatcatctccactgtgctaccctctagggaagaaatatctggaactgtggcttgatgatattactactgctttttatagacaacgatttttttcctcacttggtatcatctaatgaataaagaaggaacgtgttactgtacttctatttcaagatgtgtactgagcccattggtttatcttttttctcctcttagatcccagtaaaaaaagctaaaaaaagaattcatgatctaacaataatgaggataattggagaaaagctatatggatctgggagatttcaataaatttccagaagtcagaaagagcgtggaaagatgatgcagtggggcagaggtagctttgggctagtgtgtttgcagagggtcctgaatcaaaaaaagagcccaagttgcccatcagaacctcggaagtttcagtctgagagaatggagatgggatggaggaggagatagagaagtgagtagaaaatgaggatgaatttaaaggtctgtgtattgaacagctgcccacctgcctgtaacacacatatccccaccccaatctctctttctctctctgtttctctctgtctctatccctttctgtctctctctctctctctcacacacacacacacacacacacacacacacacacacacacacacacacacacaccaggcatttaccctccattctcaggtcaaaaaggaagtaaggctaactctctaaagacattttaaaaagcctttctggggagagctggagcaactagtacagtggtgtttgggacaccctgatcattatagggacattctgctcaccacaacacaaaacctggaaattaaaaaaaaatgcacacagaatttccagtttgcttttccattgcctcttcctgaaatatgaacagaaaatcacaaactacagtcattagaggatagcttttagcacgagcgacaaagatcaaatgggaaataatgcacagcagaaaaactaactcaaaagacaattccaataatctcaatataaaaataactaacctctaactggtgtttctaacaggttcaaaacaatacatcagaggaaaaagaaaagggtgccaaaaaaggaatagagaaaaagagccttgagaaattgaaaatattattgccaaaattttaaaaatctatttaaacattgaaagcaatctcctagagtgtaagatgaaaatacaaagagttggtaaatgtgagcacaaggataaaagacatggaggaatgatggaagaaatccaacacctgcctaggaagatttcacaaaaaaggcaattgaaacgaagagatagatagaaatgatcaaagaaataatagaagggaatttcccaaaatgtacctttatatttaaagtgcctaccaagtgtggaacaggatgaaaaagacacccactcagtcacatcttagtgacacatcaggacactgaggataaagagaagatcctgaaacttccagagagggagaaaggtcaccgataaaagaaacaacgtcagactcctcatcaaacacatcaaacactgtaagacaagagagcattgtcttccatactcagaaaaattacatccggccttgaatgacatactaagccacgctattaatcaaccacaggggcagaatatgggcatttttagattcacaaagggttagaaattaatctttcatgtatttctcagctgtttcttttataaacagttatttgaatgtgtgctctggcaatatgaaaaatgacacagggaggaaagcatccaagaaacagtggattcaatggaggactgcaatgaagagagtcccaaaatgatgaatgtgtggcagtctcagagaacaggtccagcttcggacaggaagactaaggattaatgtgtggcagtctcagagaacagcccagcttcggacaggaagactaaggagatgggtcccaggaaaaatgtagatcagaaaaacagatagtatgatggagactatgaaaatcttaaggataaagtaaagataggaaatgcaagatgaaggaaaagtaatcagagatgacaggaaagattaaacagggttaaagattaaacaagattaaaaaaggtaagttctaggataactctaatgttcccagtaactgtgcaaatgggtgtaaccatcattatcatgggtgccctgcctctcaggacccaggtatggggttttcattcttgatacggcttcccacaccccacgagttggcatagaagcagagaaatactttcaggtcccaatgcaagcttggatgctgaggacttcagcagggaccaccatacagtacagatttccctgtgtgcctggcagcactaaggtctctagtattatggggtgacaacaggagaagccaatccagatggcaatggaatttcatgctggctttgccatggagtaaaaactaagttgacttgaaacacacacacaaaaaaattatattttgtcgcacttgaatttgtgggctaagattcagtttgcaactgtagtgtgggtagaggaattaggagagagaagagatgatagtattgacaatgtaaatcctcatctctcacatcagaatgtcagtaaataatatctaaagttgataaagccaaaattaagggcatttgcatgttatatggagataaccaccagaaggactaagcacagaaatattgaaagtatttgcttttggagagtggggctgggaacagggagaagaatgcaggaaatggtttgtattaaagttttatttgtatatttgtttgaatgcttgaaaattatatatgtattatttcattttttttaaagtgtgctcctttctgtcaattttactctccttgctacagtgtagttaagttgtccttggcatcattgttcctgtgtctatgtagaccacctgttttggaagaaggtgaggttatcaatcaaacggctaaccagtcacaggcatctactcattcacttgctaagctccttcctcattctcgtttccaagagtgctttcaaggacacaagagaagaccctatttagtgctgtcattgtcttggttgtgcggtaacaggaagcagagaagccttaatttttagcatctagacttcagctccaaatactgccattgaaatgggaagctctgattacagcttctaaagtgcactgttttctctgtgctacagaactgtcttctgaattagtatcaataaaacgctttctaacaggatctttgacaccagaagtcaccactgatgccaatgtaattaccatccctggacgctaggccttgtcaggcagcacagataatcacctacaaccaggggccaacgattacccagtcagtcaacgacattgactgctcactgggaggttctgcacgagtaagagagaggagaactgcaatgtcctttcctcaaagtacttcaaactaaacagggctgagggtgtggaggggaaggaaagcagagattcacacacatcaaaagacagaaataaacaaacctatccattctcagttacacagagagggctgtggagatctgagttggcgcagaataaaaatggacttttgcatcgcctggcccctgtttggtaaaaacctccttggttttatgtatttcctcttttcattttttttaaatggtgttatgtatttcctcttttcatttcttcccctgcccactaactgggctcaactactgaataacccctgtgtgccatgctttttctgtgcttccatactaattatatgctgttccgcttgcctgaaagctgttcctatcactcagccctttcagcttgcaaatttttctaatctatcaagaggtaaacctgacctcttctgtggagccttgcctgattcactccattttaattccaatcagttacagtgctgtgagctttgtgagaggagggacagagtatattatcatttgaaaataattaaaattgttaatagatgtaaaacacttagaatagtggtgcctgaaatgtaagcaaatgtgtttattattattattattagcatcattactatgatcaatgtttgtatttagaagccctagcataacatctggcatatgaaagtggaaactaagcaaatgtttctttgtttgaattcttggaacatttcagacaaactgagttttattgatgagaaggttgatgggttttcttggcagtggtcattattccaaggtgaaagtgaggattattgctttagctattgcaactgagaacacagaatatcttttaagaagcagaagctctaataggtgaataaatcattttggaggataggaggatattccagatgatatgaaactattgaaaacagatttgctgttggttttcagaaaatgtactagccctcaggaagatgggcttgtttggagagatacctaatgtaacacaaataacttcattttcttcagcattatctggaatagatggttaattagtctcagacagctgtttccatactcacccgcctttgctgtctgtgtgatgtgcacgtgtgtgctgtcatctgggtgagcctatctgggcacagtgacgggtcattaagctgtcttctcatatggtgcatgtatagtgtctgaagcacagtttcaggagacaggtaacacttccactcagagaggcattacatgacccctagggttgtcaatagatccgtagctcttttgctcttcaaacactacatgcattttgacatctcaccatctttgttcattgttccattcactgttatgtccttcaccccgttctttactgcttacataaatacactcaagcccacttcctccagagatttcaccatcactccagctcatagatatctcttccatctccatcatattcagcttgctttcttctttctttgtctctccctttctccctttctctctttctttttctttctctctcttttttctttttctctctgtctccctccctccctccctcaacctctctctctctatttttctgaaacagagtttcactcagtttcccaggctagaatgcagtggtgtgctcagagttcactgaagccttgaactcttgagcttaagcaatccttgcgcctcagcctctcaagctgctgggactataggccaccatgcccagctaatcaatctttctttctttctttctttttctctttgtttttctttccttccttccttctctttctttccttccttccttctctctttctttcttcttcctctctttcctttcctttcttccttctttcttctctttctctctctctccttctccccttctctcctttctctctttccctaccttccctccctccctccctccctccctccctccctccctcctttctttctttctttctttctttctttctttctttctttctttctttctttctttctttttctttctttctttctttcaagataggagtctcactgtgttgctcagactggtcttcaactcctggtctcaggcaatgctcctgattcagccttccaaactggctgggattacaggtgcaagccactgtgcgcagccagtcatagatttctaacactaatttctccaatagttacattttatattgtgaaaacacttacattgttggcttttattaacatttgaatgtgatttgctatttgctgttaagtatgctagtcttagctccctgagtagactgttggatctttaagcagatgctgtactatggctctttgtagtttctaccacatttagcacagttagatgagtatataggtacttaataggtgttcccttaggaatgaatggataaccctcctgggatccattcaaaaggattctcctgagaactccttaacaaaggcttatctactttctagtttagactgtcaacacatgctaaaggataaaagatgcagatttgaaacacatagatttacattttaaaatgctgtggcatatttgttaatatacttcacagtctgaatgcaagtttaggttagttacccttgaggacaaagctactagactctcgaggattcaaatagtctcataaaaatcatcacaatgttatcattggtagttaagggaacattttataataagtgggtgtctttgagcatgtttcctagggaaagtgctaagtgcaatctagtccatggaagtcccacagtactctgcgaacaacctgcactacttcatggccacttcacctgaatggctcagttctttgagtgtccatgtagtcaactaatcagtctgtggtgagtaagagtaaattaaggtgactaactttccaaagtcctttaaagttatttgatttaaggtcgctgagctaggtggtttatggatatttcagtattcctggaataattcatgtaagctttttccttgtatccaatatattatgagggtaagagcaatgaagccctgtgccaatttctccatttcactggctaatcagtaattctaacattgtttgccagctaaatggaacaggcactcttgtcaccatcatgattcattgcctactgaaagcacagagctggccttaatctaattcttaataaaaccttgcgaactaggtatactgtctcaatttgcacacggaaaacagatgttcacgaaggttgagggactggcccacgatctcacaccaagtaggtaaagaaccatggaagcaattctgtgccttaaagtgcaattgtctttctaattcctgtggagcatgattgtcttttccatgctgaatctaatgattacaaatatcaaatgagccctaagcatggccctgtaatcctactccattctcctagtaaactctccttcccactctctgaaacaactttttaatatcttctctatccttatatcttctacatccttacagcattattcactagaaaacagaaaccatcagaagaaacatatttccatattctcaatgcctcatataccagtcatgatggtacccactctctctgtcttccctcctgttatcacaggaatgtccccattagcaaccaactctccacttggctctggatcccaacctctctcatctttattctttccatccttctttcttttccaatatcaatacctctttttctacctaatcattcctttcagtagccaaacatgactccagtctctcctgttttaaaaaattcttccctttgccccacaagtcaccctttagctattagtgtatttccgtactcccattatcagaaaaacttcttttgacagttgtctactacttcttctatccaatgcaacatggcttccgtggctctcatttcacagaatgtgctcttgttaagttctccaggagcctctgtgttgccaaattcagtggctacttctctagtctcatttctttttttttttttcaccttcaacttttattttaagttcctagggtatatgtataggatgtgcaggtttgttacataggtaaatgtatgtcttggtggtttgctgcacagatcaaccaatcacccaggtattaagcccagcataccttaactattcttcctgatgctctccctcccccaacccccacccctgataggccccagtgtgtgttgttccccaccatgtgtccatgtgttctcatcattcagctcccatttataaatgagaacgggcagtgtttggttttctgttcctgtgttagtttgctgaggataatggcttccagctcaatccacatccctgcggagaacatgttatcataccttttcatggctgcatagtattctatggagtatatgtactacattttctttttccagtctatcattgataggcatttcggttgattctcatttgatctctcatcagcattctacctaactgataactttcccatggagcaagtttttcccatggagcaagctttcccatggagcaagcttttggtagcattctacctgataactttcccatggagcaagctttctaaacactttgagtttgaggggtcagtagaatatataggaggtagaaaactttgcttctgttgagtatcggtgaagtaacctaaggtgaaagtgcagagtgagaagagaagagactcaagggctaagcctgagggtacaggcggaagcagggagggctacaaggaagactgagaaggtaggaggagataacagagacaaggttagaagtcaaggacaaaaagagttgtcataaaaaaaaaaaagtggtcagaatcaaaggccagagaaagatcgggtaaacagggactagtaaaagtatattgtctttggcaattgagagtttattggttgccatttataaataatttcaggatgatgacagaggctgatggtattaaggcctgattgtatttttctgaagagcaaaccagcaagtgtaggcattattttgggaggcttggttatgaagggaagaagagtaagtggatagtgtctagagcagaataagaattgaggaaggttttgaaaaaaaatcaggttatatctgagtttgctcagagagggtagagaagaaggcttccctaatatcacagcattatgcaagaactaaaaatagaatctatttcttctgcctccaagataattgagataatacatgtgtaagagtttaaaaaactataaagtacaataagaatttgatatagtgttcttctttccactatattacaattaattaccaggaagtcaatggattgcatttttaactatataacacaccctttaccccactccctgcaacaagaacctcactgctatttattcagcagttcttaaatgattgatttgttgtggatgatcttttgcttgcttccttttgaaacagtgagggatttctggatgtttgccagcctgaatattcctgtttacttgtcttaggctaacagataactggatgggccatattgttatacaggcctgatgaatgccaaatgttcagctctatctctacaggattacacctttctgaaaaaagaatgtataatataacttctgtcaaataaacttgagatacatttgtttctagtcctcagatttcaagatctcccttaagactttggaaggacaagcctaattctctttgccaggcatgaaaccagacattagcttataaactcaagatgttccataattctttcaatatgaattctaattatctttgctccttctaagagaaggtaaaagtataacaatgtgaaatctaattctatggactcaaggggcagaaatcagtgacctgatattcagaggcctatattaattatccattttatttttctcacctctgtaatttgtaagtagagttgcaagggctcttgttcttcagttactattttagatcatacactctcaaatgaatggatagttctcaatgcctgcgatgcgcttgattcacacagactagcctaggttgtctgaaatgaagtcagggagacgcatgcaatgacctgtaaggtgttgtttctgtgtctttgtagcctgagttttcttgtggataaaaatctatagccttttattatgacagctcattacaccacagaaaaaactaaactgaaagatagatcatgtcttccatgatcactgctactgtttgatgtggtgtctcctgcatgaatgaaatgactgccactcagaaggtctcatggtctgagaacaaacttgacctggaaattcatctgtatttttacaaccctgtgtatggtgagaaagtttccttagtctagactgcttaatatctgtataaggccatttttttcttctctctcacctctcttgttgatactcctctgaatcatcatccacccaagatcaaggaatgctcacgctacttttgtttgtccagggctcagatctttctcagctcactcagatatgttgccccagtatctcttattgaaaacttttccctatggactcagattgacctcagtttaaatcttcagtgctttggaccatatatttagtctttctataactaagttttgcccttgtaaaactggaataatactacatactgtgtaacatttgtgagggggtaaagataatgtatgtgataatcatataacaagttcttgataaacaatagttatattattaaattggctatattttttttctttctataaaacattacttgcctaatcatcaatttccttggagtgcttctatcaggtagttatcaagtgtaaggatggaacccaaataaatatttcttgtaagtgtgatttatttaggtactggaagaggctgcaaaataaaatggaaagagtgtagggctagaaaggtgacaagttcctggttctggtgttgccagttctcatattaaatagcagtgttatctgtatatgattacccatctatgaaaaactctaagttattagaaagattgaattcatcattgatgaaagagatccttcaggcatctggaatcttatgtaaacctcacgtagactgagtttaattcaattaaataactatttattgaatgatcattatggactgtgcttggcaatgtgggggataataaacaaaggctacacatatacacacatttattgagaactgttatgagttgaattgtgtcaccccaaatttatatgttggagttctaacccctagtagatatgtggatatagatacacatcctagtagatatagtaggatgtggccttatttggagatagggtctttacagacataatcaagttaaaatgaggtcattagggtgggccctaatcaaatatgactggtgcatattcgacatgcacagaggaagagatttgaaacacaaggagaaggtgaccaaggagataggtccagaatggctccttcccttatagccctcagaggaaccaaccctgctggcactttggtctcagacttctggcctccagaactgtgagacaataaatttctcttgtttcagccacctagtttgtggttctttgttgtggcagccatagcaaactgatatgaagacctactatgtgctagtaactgggaaactaacactgaacagggcactgttatttgtttcaggggaagaagtttggaaaagaagcagatacttcagtcccatgtaataaacctgctccaagagaagtatgtacaaggtgtcatgggaggacagtgaaggacagttgagtattaccaaaggcttgtttaaggctcctcagcagggacttctaagccaggcctttgaagtaagagtgcaagaatgagtgcaagaagcaagagttctgggcagaaaacagtgtttatatgaggcagtgtatgcaaaggcacagatatctgagcaggtgtggcactgttgtagaactgtaagtaatccaacatggccagagcttaagagcagtgaaagataaggctggagaggtgagcaagttccaggtcagtagcggaaggctccctggagcaaggggagcacctagaaccttgaggtaggtcttccttgattagcaatcgcgaggacataggctatgttaggtaggagggaaactgtaaacaaaagtgaatgcgtatatttatttggcagtgagcattctggtctggttaaagcagacatcctcttgacaagcagagcaagcaagtgagaagctaagaggtaagataaagtctctcaaaggaccagaagtatgacaaacggagtgctttgagggcagggctagtatcttgtttagtgcttgcagtatagcagtggctcaagaaacaatcactgaataagtgaagggagaagtggtgaaattctgtccttttactgaattaagcagggacttttaggttacagaggtttggttttgaaatctaggctctgctggcaatttttttaaccttgttgagtttcatcctctttatttctaattgtgagtatactaatattgaccgtattggtgagaattatatgggataatttatatggaactatatagaattatgggtatactaatacttagcatgggataatttatatggaattttatagaatatatggaactatatagaattatatgaaactatatagaattatgggtatactaatgcttacagtatatggtgagaattatatgggataatttacatggaaatatatagaacttaaaaattccatttgatcaatatttattaagaagctactatatgccaagccctgtggtaggctttaggactagaaagatgaacaagacccaatctctgcctctaaggaatttactttctgttagggggatggggaagcagacatctgaatagataaaagaactgtgatgcaatagaataaggactagcttagggctaagaacagagcaccgtgggtgcacagaggagggacagttacgccagccagacggcaggatagtgttggggaatacttcctgggggaagtgatgcttaagctgattcatgaacaatgatacgcaattaggtgaagaaggaagaaaaaggaattccaaacagagggaacaacaggcttcctttgcagctgtgtttttctagttcctgtgcctgtgcaattccttgctgaaaatatactctagtcggcttggttaaagcaaaaacaccctctctagctctcgtcagactcctgaaggttggatcgtgctctgaacagcctcagctattggctggcttctctttaaactaaacaggccttcagaaacccttcatgtagccacctgcctgatctcctcactccctttctcctgctttctttcttttcttcctgtccttcctcggtatctgctttcttcctcctctcattaaacatttcctatgtctacatgtgtaaactatgggctgtgcctggagatacaggggataaaagcatacatctaactcatgaggagctcgaaactgaaagtagggtcagcgagctatggcccattgaccagatccgcctgtttttgtaaataaagttttattggaacatgcccacgcccatttatctatgtactggctatggctgctttcatgctacaatagctgtgttgtgtagttgcaatagagaccatgtggcttgcaaagcctaaaatatttaccatctggccctttacagaaaaagtttgctggcccctgttctagtgtttatatatggcagaagtggtggggatagatggacaagtaaagaggtaatgtacccctgtaagataagtttttcaaaagggtactatagaaggagagttcctaacccatacttggagattgagaaaagaactgagagctaaaaaaagtgacaagtacgcttagagctaaaggataaaaaggagttaagagggaaaggaagatcattcttggcagagacagtagcatgtgcaaagccaggcaatgaaagaaaaacatgcagttctctattgcaaaaagaggaagcggtgaaagataaggcaggaaaatcagtttgggccaggtcattaaggatcctaaatatgaaaaccatattaaggattttagaaatgccctataatctctcccataggtaactgagaacctttgaaggattttaagcagagtagtgctaaagcaaatgtgtgctctagaaagatcactctggctgtaggatagttaacatttactgggcatttattctatgccaggtctgtgctaaacgctctttgcatttggaaatatctattgagtagctggacagcactgggaaccaggtagaaagaggtgaaacatggagaacagatatggatctatgagaaccagggatctccctaagggatgaaaaggtgtagagcaccacccttatttggaggcatgaggagaagtagaagaacaggggtgattgcaaaggggagtatactgtcatggaacacaaacggggagtaaataacaaggaggagtggatagtgaaaatcagatattgtaaagagagctaagagaagaaaagtggaagaacaagcagggggcagggaactggtaagaagcagatcagagctgacttaaaagagagcaatttcagcagaaaagttgagaaacaagctggattatagggttaaggaagtggttggaagtgagaaaatggaggtcactgccactgaacacttgtttgagagatttgtctttttaaagaagagtagaaatatgactgtggctggatttcttaaaattaggctgtaattcagcagctttggtaacttttctgattcatgaggtaaatttctcatctcaaatatctggtcatttgaagtaatactggagatcaaattacgcaaatatgctgcatgactaaattaaaggcctattcatgtgagcattagttagtaatgggagttgtattatatactgcattattagaaaatggggcagcatattttaatgcttaaaaatttaatcagagcaacttccagaaggaggaaaaggctcctttttaacacaagatttgaatcatggcaatttttttttttttctgaaagccattcttctaagatggtcatccctgcacatgccctcatttctgactttctgctgcacaagcaatcagtattcgtgcaaggctaatgggatatacaagaacaattagtagctctgccagcgccaatattgtacttgcctctttaaagagctcaaaatattaaataacaattggaaagaacatttcttctagactactcattagattgattttacagatgagtaaactgaatcatagagaaacaagatagtggaaatgagaagtcttactttggttctatctcacaccactgtaaggctgtgcctattatatctgtaattaagctgttgtccagataaacaataattcctgcttggctttgacttttagataccaacagatatttaaatgccggcagttgaaaaggttatttttttttctttcaaaagtgggtttgtaactattggcttaaattattttagaaaactatagctgtactttcaacataaggccacccactcaactctgagcctagactgtttgagaaataagaaggtataggaaatttggcaggtatttttctcttgtatctttaaatctcagtaagttcacaaaattttcctaaccaatattggaacaagaaattatcacggggggaggggggtgactaatctcaccttttaaggacaattaatttttctacttcacaagtttaacttcttatttggatcacaatatgctactaagatacttaaaaggtcattttttcaggccaactgcaaatgatgttttcattatagaaaagttatgtaaaagtggaaaagagatgtaagtccattaacgtgtaaaatgcaccatagcaatgggaaaaaagttttaatgaaatacgtatgagctctatcatgcgcaaatgttttgttgaaatggatgactccaagagctctgtggttccacttcagtgtctaataggcactactcactttaaccttcagcaagccctttatgaatgctatccacccaagtgtatgaaaatgccaattcatgtagggctatcagtattattgttatttcttattctgtaaaggctgcattttgaacattttaataagggtcaaagcattccaagtcaatctagatggcaattgttagaaatgcaggaggtgctttaaaaaatgagttggtaataatttcattcttctcccattttgattagtttataaatataactgtcagctagttatcatggtgaggttattggtcagtcctcctccaagtaatataaactccttaatacagtcttcagactatgaatctaccataacattgccagtgttttgatatcatcagtatcttcatcttcctttatttcaagctatgatagattttacctcttctattatctactgtaatttgctgctgacacaccaattgctagtaaatacatatgttgagcgatggtgattatgtgaagaatgaggggcaagatccctgtggtgtagtgtgtgtgcacccatgtgtgcatgaagaaacgtgtgtatgtgtgatgtgcatgcaaataatataggtctgagggaaatactgtactccccttgaaggtaagggtcatgtcttattcactgttacatccctagtacttaacactgtctctggcacagaaatgatatctaaggagtgcttgctgcatgaatgagtgaagggtactaatggtccatgttcccattggcaaaataaggcttccagtttaaaaatgagactggaggtccacctacaacaatctgttgtgctttcagtttttacaggctgatttctacgcacacagcattatgctgggacttgtgaggaaagcaaggaaactgaatacacagaacttggacttgagaagctttcagtctaattggggagacaagatacatacaagtgaaaacttaactcctaattctagagagagaatcatggcatgccaaatgtatttttttcatgtcaaatgtaaccactgcgtgagttcaggagaaaagagcctgttctgtactgcagccattaaagaaagctacctaaactaggcaagaattgagttatacctttgaggataaaagacagcagggaaggaaaggaaatgtctgtccaggaggagcgggtagagaatacagatgagcaaagttattaagataagaatagattctttgggacttaaaatttaggaagcagtcattagactttgaaaaataaatatgatggtagagacaaatataacaaggaaataaataagcatgcacattttgtatagtaatcacttcatacctaaactccttggtgaaaaaaaatgtcgaaacttagacacattctctatgttgcaaactcaggggaagtgagtgaaatgtcagaaggcatggcagcattcccagaggttagtgagtatcaggtaggctttgccaagcaggagggaggtgatgatatttgacttctgaggggataaacaggtaaggtgggatctgggcagattttcagacaaaagattctgttgtgaaggggcttctggttttaacatagatgtgactctccttaagtcttaggtgacctgatgtacttctgaaactattcattgattgtacaaatttctatttattttacatttttaagggcacagaaggatctaaactatgtgcacaactattctacaaaccaaactgaaaatcaaaatgaaatacacaaaggaaaagttgtttgaaattttgtctttaagatacagggaaaaaatcacacatcagtaaaatcaaggataaatatcagcctgaaggaggagcaataattgacaaatatttaaaaacaattgggggccaggtgtggtggctcatgcctgtaatctcagcactttgggaggccaaggcaggcggatcatttaagatcaggagttctagaccagcctggtcgacatggtgaaaccctgtctctactaaaattacaaaaattagccgggtgtggtggtgcacacctgtaatcccagctacttgggaggctgaagcaggagaatcgcttgaactggaaagatggaggctgcagggggctgagatcacaccactgcattccagcctgggtaacaaagtgagactcccactcaaaaaaaaaaaaaaccaaaaacaaaaaacaactggggtctttcttttctaaccatatctagacattggtgaaaatagtccttattaaagataataatagctatggagataaatcatccaagtgttgcatttatgtgtgagagtatgtatgtagaacagatttagcaaataatttttaaagctttcaataaatactttaagtgacttatatggacactttaaatgcacattcattaatggattcttgattgaataaaaaattaactcctgaaaatatttcctaaataaagtacatctatgcatggatgcactatgatgtttcaaccaacattaattatacccttttgatttctactgtcttgttcaaaaacactaataagacatgcactacatcatagttaataggagtgtggtgcttgttgcttaggcaacaggaggaataaatgcaggtcagaatgtgcttcaagaaaaacaaaagctagaatatgatactgagtggagactaagcaagtctaacagatttttcaccacattaaagaaatatgtttcttagagcaagccaatcatattcatgtgtttaactaagtttgcaattacataaattagattatgtagatcaataaataatttttataaaggtagaaattaatcgcttatgatactagtagcaaataaatggtgtataacagcatgtaaagcactaattgattataccacttcatgatttgcttcattttcataattaattaactcctctaaatggcaattcaaagtttttttaaaagataattctgtctcatgaagaaagtatttgattggcccatctaagttaataatattttcttattttctagaaaattataccaaatactttgaattaaacaagtaaagaatataatctatgattagaccttggttacatcatgtatatccaggattttgccttccatataaattttgaagtgcttatacatgattcattcatgaataatttttacgatctctctttgaatgcttatttgaaacctgtttgattaacctttcagttcgaggctttcaaaaaggtattatatttgctcataagtgtttaacattcagaggaaaaataagctgaattaaagtctttcagcttggccaaatgatccaggaaatccaaagacctaacttctcatgggaccagaataaatttggacaagggtttcagggttgggaatgagaaacccttatttcaagtagacatagggagaaataattaagatattgaaatgtacagtaaacataaataataaaaaaagacttcaattctgtttgatagttcttctaattcttaatgccatctgtttagtgtcctaagtctgtcctaaatctgcccagtgttctaagactttcatagcaattgaagaactttcacttttttccatttcaatacccaaatatcttgtctatataaccagtgacagtacttgataaacacaagaaaaataacagtagctgcatatatcagtataaaaaaaccaacaaatcactcataaagcattctgtgcatgcaattacttagagctcatatatcttactatatttatgtcttttttatttttaaaaactcttgggcatacatacttttggagaaggagcagaagttgaataatgttaataatcttcaaatctataatattcaagtcaacctcagagaaaaataatctaagatagaaattaaaaaatctaatcagctgtcactattgtgttatcatttctggtactagtaagctgcaggtgtcagccctattactgtatttaggcagggctattacttatttccacaagtcatttgtgtgttacatgcctgtgttatgtaggtctctctaaacttagggatcagtgatatgtgtgatgggtacttaaaagcaaggaaaggtaatagagctgtgacgtagcttaacaaggggaactgatgagcactgggggaggtatgggaatgattagaaagctgaattgtcggtttgcacagttccccatcctccttcctcacctatatgcaaaacggtggaaagttagcacatgccaggtttagattgcatgtagaccagaattcagaagtacatgactatacttactccaccaacctttctttctaaatattgacagctaaatgaccaaagtgtttattttccacctaaagtaataaacaatacttcatcgctcttcaatcagcaagtggaagtaaacgctctccataattgaccatctgaagcagtttgctaatgaactgaaggttgtccacatgatttaaactgcttattgaacaattatcaggaaaagaaatgatcttcacaccataaacacaacaaattgtctcattaaccactaaatgctgatgctcaagtgaaataatataagaatcaagaattagctgaagagtgatataatccgagtattctaagattacaaatttatttaaaaaatcataccaagaatgacagggagaatatcaatattaatcttctttcactgcctataaatagcactctcaccagttcattcatataacacatatgtatatggatacatacagatctcattttttagcaagagtctatatgtacacagcaagttcagtcctaagggcatccaattttccaatgcagttacatatataaatctgaccagttttggtgcaaatcaggctgcctctgagccatgtaagacacataagaagcaaagacagacaaaaggcagctccgtggacacagagagcttcttaccataaactgcacattgtcaaatccattagccatcaggtggttctcgtactgaggtagcccaatgctttccaaccattgtcccactgtttggacagggcatctgggtcctgtaagaggatgaagagggaagcgtttaagcagggagtagccgtccacggggtaatagcggtagtcctgggctgagaggtggcattgccacatcatgcccctgggaaagttgctatcaaaggagcccgccagcttgacagattaatgttctcagcgagagagcaaagtcagaagtaaaacatagtttgccaggcaggctgtggagtatgacttgatcctagctccacatttcttacatattaatctttactaccgaccagtacgtcatacagcccccaaaaccaggcagcagaagaaggcatatcaagctgtcagcttgggctggtctgcgttctatgtgattgttggagtactccacaatgagcaatgcacggccggcagccagaattcttttttatcaagt

SEQ ID NO: 1477 - DNA, 410826 bp, Homo sapiens; identical to SEQ ID NO: 1470

SEQ ID NO: 1478 - DNA, 42836 bp, Homo sapiens
agttccggcccatgttgtttcggccgaggagccgtcgccgccatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacaggtaccggtgtcccgttctaccttggcagatgcccccttggggtctcgcgccgtcctctaccttgtatcactccttccctcccttccctcgaaccatccccattacatcagtgacattgctaagcttttcgtggtctactggcatctgatcacatcgggttttccgctgttgtccgcttcccgaacatttcctcctcctcccttgcttgctttttgctgcctttcttgctttgtttttatttcgtaaatgttctagcattccactctctccaggcgcttttatcacacgtgcgcgcttagaatgtcgtggaatggactgcattggaatccctgccctttcactcctttgcagcggttttctcccctaattccagctcatcgcctctcctttttcccctccatctcctccttcatctccccccccagtcttttccccttagccagatttggtccttctctgccaatctagggcgggggtgccgttccgatgtaatcatatcctcactttgcatcacccgaggacgatcaaaagctcgtcgatggtgccacaagtcacctcgagaagaggggacattgagcagcaccctgctaggcagtgcctttctggtgttctttcggttgagcggtcccggtttagattggaaatttccaggggtttcctttgccatcgcccaattccaccgctgccctcagcctggatttcccaccctgtccgcggggaaccacacccttcccttcgcgaggttgccagccctgttcacttcctatccttgggggagaaaccaccccgatgctgctgctttggcgttgaccaccctgcccgcccaattctcgctttgtgttactttctcgatgtattcctccgccgccgcctctgggtctgccatccccattcttcagcccagtatctctttattcacagggtgtaatattcttttaagtttccatccctgcttgaagagtttgtaaagcaactggagtgtagctgcacaagtacaaggcggttgcccttttagacacttcagtcgcgagcatttggtactgaaaatacgaaaacaaccaaattgtaggagtgtccttcagctgcctttccatattgaggcgatttgggcggaagggggtggggaattgggctgcgcttctgaggtttcccgcgaggttattttttggttgtttctcagttgagatgtgtggagggttttagctactgttcctggaagttgtgctgtaagtagtaggtgaatcgtcaatagtgtcttatccgtaattgtagggagtgggattaataattagtccgtgctcctctccccacgtctccaccgtgattttcaaaggtttaagattctgtactggattctgtactagcttgccctttttaatgtgttatttatttgagaaagctgtcgtttcaagtgttaaaatagcagataagcggcattgaaaagtgacaaagtaatgtgtgaaaacaaggagctaggaagttctagagacttagctaaaatgtaattttagtttctattaaagatataacctctcccagatgtggatgcaagtctcaatgctctttgtgttggtggtcagctgtgcattctgtcaggaaatttactttgctttcctcagtatccggaacgctcatcagctctgatgattggggagctgggctcaaatttgaactagtcaccttaaccttggtagaattaaataatttgtccatggtttcccatttcaaccagctagtgaagtgctacggtcgaattcccagtttaagtatttacagttgtgacaagcagttttttttttttttttttccctctctgggctttagctatatcctttaaagatctttatgtatctggattaagtcacttgcagcgaagtgcttttatttattcattatgttgcgctttatcaaatatattttagcgtccatcctccctccctcccaacgttttgaccattgcagttgcaggtaactgcctggcttatataggcttgtttgcaatgtcttaatcctttagtcaataccagagctgtttggaaaatgttagtgctaaaccaacgtgggtgggatttagccaatttagtctccttttgagtttgggatggtagaggagcagtgtaatcttgggtctttatttaaaatgtttgatgacccctttaactattttggctgttgtcaaatgacaaacatcttgtttatcagctgttttaaaaatagcactttgactttttggtttttcccttaggctcgtttctacttgtccttttaaagaattaaattctgaaatatacaaaaattgatataatttaaagaattaacacatctggtgtcctcactgaggttaagattgatagattgttaccagtactccacctcaacaaatccaacctgaaatatggcacaaaatattacgtttcccaatatgttattctgatattattaagtctttgtgaccttgcaaatcacacgtttaatattttgtttctgtatgttaactaaggtataaggaataatgttcagtgaatccttagatgctacctatgatttataatttaaaagtacaaagtatttttggtcataaaatgtaatctcatatggaagtaaatattcctttctagtttgggaaagaaagtattaatgggtgaattctaaaaatgccaattctgcacttgatgttaacttgaagatatacataacgtgcagaacactctagtgctttacatagtttcaagcatttccatttttaagttaaatataccatatttttacatttttttggtttacatttctaactttttgttttcccccctccttccctcaaatgttttgatgattctccagaaccaacgaaacgtatgctttccttccaagggttagctgagttggcacatcgagaatatcaggcaggagattttgaggcagctgagagacactgcatgcagctctggagacaagagccagacaatactggtgtgcttttattactttcatctatacacttccagtgtcgaaggctggacaggtaggagatgttggggtacctgctcgtgattgctgcctctgggtgctgagcttgaaaaatgatacttaaatatttgaacttgaaatttttccagtaccgggtttcaactgagccgccaacgcacatctgctctcttgcccacttgtgacatgcccagctgccagtttttctccttccttttgtggtggtggttatattatcagtatgactagggaccttttctagatttttctatctgggtctgctgctttctagactctgttcaggtaataaattattatcaatgtatatctgagcatccagtctccctttcatgagacctgtcagtttgagggactgaaatgctcagaaatgatggttatgtatgctgtggcaggagatgcatacctggagtttcattaagttgttatggtgtgttgcttttagttaatcagttgaattaatcaaaagggaagaatttgtgttcctgtccttttaataattgttattctggcatatttagacacttaaagatgtgcatcattaaatcttaaatggaaaatgagactcgtgcacatagctttccattttttatcttaatgatcatgatttccaatgtggtgggtttttttttttttttttttttttgagacggagtttcgctcttgttgcctaggctggagtgcagcggcgccatctcggctcactgcaactctgcctcctgggttcaagcgattcttctgcctcagcctcctgagtagctgggattacaggcatgtgccaccacgcccagctaatttttgtatttttagtagaaacggggtttctccatgttggtcaggctggtctcaaactcccgacctcaggtgatctgctcgcattggcttcccaaagtgctgggattacagacatcagccaccgcgcccggccaatgtggtagttttgtaacaagactctagttagaatttttttcttttttttgaggtggagttttgctcttgtcacccaggctggagtgcagtggcgcaatctcagctcactgcaacctccgcctcccgggttcaagcgattctcctgcctcagcctcctgagtagttgagattacaggcgcctgccatcatgcgtggctaaatttttgtatttttagtggagacggggtttcaccatattggccaggctggtctcgaacacctgacctcaggtgatcctcccgcctcagcctcccaaagtgctgggattacaggcgtgagccactgcgcccagccaataattttatttaataagaaaaagcttttcattttgaaatctagaatacctccacttttgaaaatctttgatttcccaaatttttcttgctatgcactagttaaaagataaggtattatataatgagcaatagcacagatctcaaactgtttgagttgcatatgggccataccttcttttctgtaacgtgcatacccatgcattaacacttgtcgccttttccagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgtgagtaaaattttaatggttactttcccttcctagaaacccagaaagaaacatagtgtgatatttcagacactaaagtaggttttcacatggaataaagtcaaaagtttagaaatgcgtatgtacttaaaatggtgaaattgcttttagctggtctgcgttatgctaaaatatttgttttatttagcaagttatattaaaaagcataaaaattcttattgcaagaaactacatcaattttaaaataacacgtataaagtacagagcacatgacttttttctgttgtgattaactttggataaattctgataagtgtttgcaagttaattgattttcaaggaatggtggataatgggtcttaatctgtaaaatctgtaatataaaatagtttgaaacaagatgccactatatggaatgatgtgaaaattaggctacaaaatttcttcctcaatatcctattctcttctctttcaatgtaattagaagtcatagaatttagatgatactacttatactgggcttttgattagtttaaaaattttttttgtctaagttgcagatgtgttctgggaacaagtaaggctcagctggcagaccttaaattcatactgtgtttaggatctccgaaagatacaaaaacataagactttccctcagaacttatgatgtagttagagaaagtagatgtaaacttaagaggtaaatgatagtggggttatagaaatctagaaaaagttcccaagttacattgtcaacattcagttttgtaaccaacctggaaatggctaatagtttattttagctaccgtttactgaaagtctgtgtggtcagacactctactgacagctttaaatgattggtcttagttaatcctcacaataattcttcaaaatagatgatattatttctgatttttatcaattaaaaaaaaaccatggactcagggttatgtggctttcatggggacaaagctagtaatgaagtattaatagatattaaaacctgagtctgaatatcctcaaagcaaatgttgaagtgaaaagaaataaaagtgggatgatgtgcccagagggcactcacccatcaaagcagcccttgagcacagttaaaaaaccattgatcatattttgctgtcccttattttttggttaggaaactgaaactaaatttagtagtttgttcaaagatccgaagtcacttctcatgatgatatctattaacaatttttgtagttaattttgagagtttaaacgtgtcctttttagaaaatccattgctttaaaaaacatttttttttaagagatggagtcttgctatgttgcccaggctgtactcatactcctgggctcaagcagtcctcctgcctcagcctccagagtagctgggactataggtgtgtgccaccacacccagcttctaaatttattggtttttgaatggatacagtgaatacctccagttagcactcttggaggtagcaaatgaaactaatttcttgtctatcttttctgagacactcagtgtatatatatgtacatttgagtgactttttgtaagttttattgcaatactaatctagctagttacccacataaagttttagggagcctggtatgtactgccactgggccttggaccccatttttcccagggctcagggctcacctctgtacccagttgtcacagtaagttctttacctttattaatcaggttgattctactcttattgatagtgtaccctcttacacagctgtggttcttgccatctttaactctaatgcccttggctcaggtttccagttgcctatgtgtgtagcagagcagtcattgctactgatagtgtacccaagcagtaggactatgctgagaaggaaaactaaagtgagagatggaaccttgctatttaatatctaacctgctgttagcaggaagcttattgttgtaccctaccaaggaagtgagatagtactaaaataaatcatgggattacctcttgaatgcattgaatggccatgtgttgtcatctggttctatgtttcttctagtggaaggtgctgctttacttatttattactgtttttaccaataagaatgaaaatgggattgtgcaagttcccttgatttcaactaaacatgccatagtgatcatattttaatttatttcaggatatctaaagtcttaactagatttaaacttactgtcaaatgcccgttgtcagttcagtactggtagaaccttgcgtctgttccttatgttcttgttgacagtgcttaaatgcatcattagtacattgtgtacctgaatcatagatgtagttggcattctatgaaaaatggttaaagaaactcaggttattttggttttgcagcagtgaaagagtagaatgttaaggtggtatctttggtaaccttggtaactgttttcaacagtgtttatctttttaagttaatagatatgtcaatttagaagttgttctctgtgacttgattatagaaattatctttgagacagctatctcatttttttcattctgaattatcttctataattataatgttgggtgttttcataattttggtaagattttagtctgtcattttttttttttttttggagacggagttttgcccttgtcacccaggctggagtgcagtggcgcgatctcggctcactgcaacctctgcctcctgggttcaaacgattcttctgcctcagcctccgaagtagctgggatcacaggtgcccaccaccatgcctggctaattttttgtatttttacaaaaacaggctttcaccatgttggccaggcttgtcttgaactcctggcctcaacagatccgcctgcttcagcctcccaaagtgctgggattacaggcgtgaaccactgtgcctggcagtctgttgtatttgaaggtgttattgcagatagcaccttgcagtgacagcacatgttctttgacatggtgactcactagagttgcctatacctggcaattccttttgcaaattatgtataaaattgtcctttctgtaacggctataaccctgagttgttttaaacaggtctgtttctgaatctataggttgttgaattgttgcttgtgctttgattgtggatgcacagaatggagagctgctggcatcctggccatcatgtgtgttcctgtcatgttatttgttacttgttactgctgagcctctcttatacagctgcactgtagaaaaccatatatttcgattcttctctgttctgctttctgttgtatatttcgattcttctctgttctgctttttgttaaggttgctgtgcaaatgtcacatttaaatatgtgagtgcttattgtgcatacaatgctttgttaggaaatggggagatgtgttgtgggggaagttgcgggttataatataagacaggacctgacccgtaaaggaaaaaatggtgtaagttccttggatgataattgttggagagtattaatcagaagatttcctcgagtgggtgcttatgacctaagcattctgtaggaaggtaaatagcaagtagacttccttggctgaagtggtgagtcaagtagtaacaagaagtgaatgtagtagaggagagtcaattggaagatttataaagaatagagaggctgaggagtttgaatttaatttgagaggcaattgagaattactgtaggtttttatcgacctgattttacttcatatgtatgtacgtgtctagatgttgtggctggtgggggtgggaggctctaggaggaaaggcaggaaactgatgcaatcttaggagaaatagttctacaggaaaatcttgctcatttctatctccttttattctcacgattttcccttgtatacagtgccctcctcctttgtctattaaaaccctactcatccttcaaggcccagcttaaacttctcttatgagctcatcatctagttctcttaaaattctttactactgagtgggcatttagtgtgtgccttgtcttttcacatagattgtaagccccttgatgataaggattctatatcttttccctatagttccaggcatgttattgaattgagtaacagtttgcctgaaatgtattaacctgggatggataaaatgggctagttttgagaaatataattgtcaaaaacattttgatttgacagatgaagcagaagtgatgtcttgggttttgaacttttgggagaatggtggtgcccgtgcgttttctagaaattagctgttcatgcacataggtttggatccccaaacaggagaattggatttcaccgttacatttaatatgatgttttagcttttcctaaaactgccttattgattatcttatagtaatcttgaagataatgtatttttaactatgagcattgtgttaacttgatatagtatactgtaatggatctagatgataacaaaatatagatatgctgtcaggacttaagtggcatccatccaagagttcatagaaactagagggtaataaaattacgcaacagctggctactatgtatggccattacagtcattgttggagaattattgcaagacttctgattattatgacttagaaaaggcataggaattggtaaaagtccaaacatgtataaccacaattatcaagtagtagaaggagcttgtatgcatggattggattatgcagtcatggtctgccaaaacaggggtaaccctttcagtttagaaaaaaacataaccatacaaagtagatagcaagattatataattcattacttctgagagtatagtgttaaaaagtgctcaggctaattagaggagaagtcaaataagattaatggtacctttgatgttttgaggattagtattagccttttgtgcttgaagtgatgggagacaaccttactctctagaacatcagtcattgcttgaaggacagtattgagtcagggagatgatggaactgacccagtatggctgaccgtaagattgttgtgtggcagcctgtactttgttggcagactttttggttcacctgatggatgatactatacaaccacaaaagctgtttatcagtagaattaagtgattttggaaaccataatatagttccagagcaaatcatatatatgatgatttttcggcacagttgacaaaatttcactttctaggacttaagtctctttcacccatggaacagtttggaataataagcatacttcctgttgtcattgtttctgcctgttgactggtagatgtgactgacaatggcaaaatagggcaaataaaaatttaagctcactgttgtgatgagtgtctcatccagatgaatggactgatgagtcagatgactagcagcacaattgagctgctaataaaaagcagagtcaactgcttttcattattcacccactcaactctaatggcacttaatactaatgagtaatctagtggcaggtgccaggattgaggctttggttggataattcttctgcccgatagtgaaatgaagtcagagtttctaaatatgcctgacagcctaagggtaggtttgctcataggtagtcatttgctaaatatgtttttttccactctggaaaattttcggtccttgatacagaagtgattcatcataaccttgaataacatagttggacaaatatttgagatgtgtgtgtgtgtgtgtgtgtgtgtgtgtgtgtatatatatatatatatatatatatatttccttttttttttgagacaagagtctctgtcgcccaggctggagtgcagtggcacgatctcggctaactgcagtcactgcctcctgggttcaaccgattctcctgcttaagcctcccaaatagctgggattacaggcacacgccaccatgcccagctaatttcatatttttagtagagatggggtttcgccatgttggccaggttgatctcgaactcctgacctcaggtgatcctcccacctcgccctcccaaagtgtggggattacaggcatgagccaccacgcccggcctgatatatatatttttaatgtgactgacatttggggaggagagaaagaagctctagtaaggtcccatagtattttatgtgaagctaatggggccaaatgcatttcaacattcagaatttttaggatattagaaagataataccatatataaaacacccagaaaagtctggagcagcaccttttagtaaaacacatttatatttctgcagcaaaagacagtattcatactaagtgagataattaaattctataaatagtttcatgtcacctcaagtcaggtttaaccctcaaatgagtttttggaactttttgggatttggaattgtggatgaggggttgtggtcctgcactgaagtttgtcaggcagtatctttagttgatagaataaaatggcagggagctagatgcttaaaagtgatttcaagatatttttaattgacaaagcagagtataattaatgacagcgtctctgggtttctaggatttgtactgtgttcgcagtgacctggggaacctgctcaaagccctgggtcgcttggaagaagccaaggtaggtgtttgatagaacacatttaaacatcagtattatgaaaacttgtactttttgccaagtcttcaactcttcattgagctatcttcacaaaacagtcctttgaaactgaggaaaactgacggcacgaatcgcctcagaatagagcagggccaggctttggcatatctgttctaaatctgggggtaaagcaagaacctgaacattttggagcctttctgctgagctagaccatctttataacactgggctccgtcatgatcttatgtgggaataaataacattccttcaaatctgaggcttgcctgctggtgacaagcagagcgcctgtgatttggctcaagactcctatatgatgcaggtgccattgaaaatgctgctcttctaagtcctttgtggcttgtaagtggagaagaatttcatccaaatgttaccctgtaatactggcatttaaaattcttatttaaccttcctcccttcatcttcctcaccctttttacagtggaagaaaggctgttaaaatgattacaaattaataattggaacatcctgtcccttgtccccactcccttcccaagttcctttttcctcttttccaatcctagttgtctaccttcttttcttcctcatttccttcttttattcctccccaccccaaccccttaaaaaaaaggtcagaaggacaaagctggtttgtttgggaaatggactgatcgaaagaaaacttgccaaagtggaaaggtggcttttagcattctgtgtttccaaataatgaatttgaacaccaggttgggttaattaaagcttttggtataatttaaaattaaatttataaatgcagttgtcttgttacaagccaccttacgcaaccgcgctgcaggggtgaggagtggggagaaaccagaatgcttctgaaactcccacctgttgctctgagccccacgcgcatgctaatgcgtggagtgtatgcgcagagtagctgtctgtttgactgcttcatccagggagggagaaggcttttcagcaccatctaatgttttaaaaggcactagttttaagtgcacagctcataaattctgctgacattttggattaaccttatgtaggttgccagctaatgaattgtaattgatttcaatcttagctgataaatctaattggtaatttatagaacaaatatttgataagctcctattaattgtcaccccaccaagcggacagctaacatgaattgcacttcactgcagctttagagatcggtttaggctgagacattgcgcctgccttaggttgctgacttctttatttcagagctctggagacacctagtttgaaaaatgttattctgtttttttgtgagaacttagtaaacaagaaaatactcttgagtgaaatgcaatgtatttcttttgtaatcagtgcatttgaaaattcaagccagcatattcctagtagatggaagcaaaattaagttgtctttgtagaaaatgaagagcctttcttccagcaaaaatccctgctgtatgcaatagccctgattaaccctctcccttctgcatgtttcccatattacagacttgagactgtcctcattcccatatgtaatagacatccaaagaatttcaattgctttgttgaacttttactaatgatcttgtttttattttctctcttgtttttggtttttcaccattgatattgtatttagaaggtttcaggtgggtgaaacctcctattccatgcgtaaggtgcctcgctgaagggagctcgaggcctggatctagggcagacacacaacctcctcctcctcttccagcaaggaacgcaccgaaaagtcacatgatgagaaatatggtaacgggtttgtaactgccacagcaaaacaatttgcctccatgcctgaatcttctgtcttgtggcttcagaaacagcttaaaataattttatttacaagcaagttatgtaagagaatgttttatactatagccacaattctgtcaaagataagtaaaagttaattgatattaaaaattattagagataatttacttagtaaaagcttctaactcttcttgttgttcattttttttccttttttcttctttgtttggattgcagcattctgctcttctgatgatgcgctgtgaccctgcagtagcgcaaaggctgcgcagcgttaatgcgcattgcgtgcgaatgaacccctgtgaacggttgactagatgagtaatctgattgactggctccctcagtcctattctgtagcctttttggataaaattgggttttaacatacctcgagtccaactaatctcattaaacaaatattctccatgggcctgtctagtagattaatggatctggttggccgtttgctgcgtctaggggtgttctatgtagcgcagcagttcgcagcgattgcgcagtgcgatgctgttaggttgcgcaagcgatgtttgcgctcgcattacagggacctcaacctaggtgcaatcctgtcatgtgaggtttcagcttcagtcctccttgggagacggggcattgtgagaatgtaacttaaagcctggctttatgatatcctacttggcagaaagacatttttctcctcagtagcatagttttgatgttagtgaggaacattgttgaagagcagcatttcccaaaatgtgtttcatagtattctaataaaatgcccaatgaaagaagagttccatggtcaactaagttcagggaaccctgttacactattaaaggcttagggaagtccagtaaagaaacctattttccgaatttatttgatcatgaactcctttttttttcagccatacctcttaacacctcatagaacacactttgggaaacagtgggggtaggaaaactcggcctcaagttgcgccctctaggtagcacttgaaaacatgacaagggcccgtagttgtttggataagagaactccagcatagagccttatagcaactgacttcccagttaagtcccagtgtaagggttggtctttggttggcagaactgaacatggtggtttgcacttgggttctggtggcgcaggcgcaggagcagccagctgtggcagcgcattagttttggcgcaagcgagcctatgctgcagggtcacttttggctggtcagagaaggaataatgatatcaccttcttccccccctccccccaatcttttttttttccctttacaaattttcccctttccctttacctcctttccctcccatcttctttcattaacccctcctaaggcatgttatttgaaagcaattgagacgcaaccgaactttgcagtagcttggagtaatcttggctgtgttttcaatgcacaaggggaaatttggcttgcaattcatcactttgaaaaggttagtcattaaattaataattggtatttttgaagtgcttacgcatgtagtgtttttactagaactaaataataggtcttagccagtgacattatatctttgtttctctggcggtataggcagtatgtgacttacagagaacaatgatttgacttaaatattttttcaacttgacaatggtgcaaaagacatacatattcaatagaaatcatacttcgagtacccatgcagccattctggttttccctttcagtacaagattcagtaaattacatgagatgcccaacacactattataaaataagaaggaggctgaggcaggaggatcacttgagcccaggagtttgaggctgcagtgagctgtgaccatgccactgtacttagcctgagtgacagagtgagaccctgtctctaagattaaaaaataaaaaggtaccataaagacacatgcatgcgtatgttcatcacttcacaatagcaaagacatggaatcaacctagatgcccatcaacggtgggctaaagaaaatgtacatatatgccatggaataccatgtagccatcaaaaatgaaatcatgtcctttgcagcaacatggatgcagctggagtttattatcttaagtgaattaatgcaggaacagaaaaccaaatattgcatgttctcacaagtgggagctaagcattgggtacacatggacacaaaggggaacaatagacagtggggcttacttgagggtggagggtgggaggagtgtgagggtacaaaaactacttaccaggtactatgttcactacctgagtgacaaaatcatttgtataccaaattgctgtgacacaatttacccatttaacaaacctgcatgtgtaccccaaacctaaaataaatgttggaattaaaataaaactcatattaaagttttaaaaaagggctttgtattaggtaattttacctaaacgtaggctaatgtgttctgagcatgtttaaaatgagactagccgggccaggtgtgatagctcacatctgtgatcccagtgctttgggaggccgaggcgggcagattgcttgagcttaggagttgaaaaccagcctggacaacataacgagaccctgtctctacaaaaatgagctgggtgtggcagtgtgctcctgtagtcccagccatttgtagggctgaggtgggaggattgcttgggcctgggagctggaggttgcagtgaaccaagattgcaccactgcactccagcctgggtgacaaagtgaggccctgtctcaaaaaaaaaaaaaaaaaaaaaaaaaaaattaggctaagctaggatgttcactaagtgttacagatgcattttgacttaagatattttcaacttatgatgggtgtatcgggacataaccccatcctaagttgagaaacatctttattgcagcatttgctggatagtacatggtatggcagtttccaattttgtgttgaaaatgtactttaggctgcgtgctgtggctcacacctgtaatccagcactttgcgaggctgaggtgggaggattgcttgagcctagtagtttgagaccagcctgggcaacatagtaagaccctgtctctacaaaaaatacaaaaagtagctatgcgtggtgacacacacacagctactggggaggctgagatgggagtttgagtctgcagtgagctgtgatcatgcaactgcactccagcctgggtgatggtgtgagaccctgtctcaaaaaaaatgtactttagtaattaaaaatgatttttataaatgggctttaaagaagcagggcttcttggtgaaaaggcagattccaggtctggggcaggaatttaaaaaaaatttttggaatgtcttgtcataccagaaagcaaggaagctttgacatattactttgcatcaaaaggactcaggaagcaacttgaggaggctcccactggctaaagatgcagacttgagcatcaataggaataataactgaaatatactaaaacttatcaagtatgtttaaatctatgagcttataattatgctaaaaaattcattggtcatctttggaagacttacaaggaacaattaatttggaaaactggttaaaaagagaagaataaagtttttgaggaacctctatactagttcccaaaatggctgtgccaatttatacttcccccatcagttacaaggcttccctttctttacatcctcactaacacttgttattattcgtccttttgatgatagctatactaacaagtgtgagatgctaactcatggttttattttgcatttccttgatgattagtgatgttgagcatattttttatatatctgcttgccatttgttttttttgttttgttttgttttgtttttttgagatgaggtcctgctctgttgcccaggctggagtgcagtggcgccataatagctcactgcaacctcgaactcctgggctcaagtgatcctcccaccttggtctccccaagtgataggattacagacatgagccactgtgtctggcctgtacctcttcttttgagaaatgtctgtttagatcctttgcccgtattttaatgggcgtatttgctactgagttgagcttcttaaccctttatcagttgtatagtttgcaaatgctttctcctaatccggggttgcctattcactctgtgtaattgtttcctttactgtgcagaagctttttagtttgatgcaatctcattgcatatttttgcttttgttatctgtgctttatgctaagtgaaataaaccaggcacagaaagtagatactgtattatgtcacctatttgtggaatctaaaaaagttgatttcatagaaacagagagtagaagggtggtgaggcttgggggggtggaggagggatggggaaaagggagatattgatcaaagtttcagttagactggaggaataagttttagtgatctgtagtactgcatggtgaccacagttgttaataatgtatatttcaaaattgcaaaaagaataggtttttaatgtcctcaaccacaaaaaaataagttagtgaggtgatggctatgttaattagcttggttgactctttctaaaatgtatacgtggatcaaaccatcacattgtatgccataaatatacacaattatatatcaactttaaatttaaaaattaaaagaataaagcatatgtcttccctctcctgtatgaactagaccatagagtaacccaatagttgatgggggaagcttttctttataaaagcattctagctaataagtgaagaaggaatgatagaatatcaccattaatagtgaaagcatttattaggccgggcttggtggctcacgcctgtaatcccagcacttcgggaggccatggcaggtggatcacctgaggtcaggagttcgagaccagcctggccaacatggcaaaaccccatctctactaaaaatacaaaaattagccaggcatggtagcaggagcctgtaatcccagctactcaggaggcggaggcaggagaatctcttgaacctgggaggtggaggttgcagtgagctgagattgcaccattgcattccagcctgggcgacagagcaagactccatctcaaaaaataaaaaaaaagttaaagcatttatcagtgacaaaaacgagatacaatcaggtattaagtaccttgtggtaaacaatttcaccagtgaagtagtcttgcacaaagagaaaagaacacaaacctaattaagcttctggttctacctaccaatttacaggagatatacacgggacaggaaacatgttaaaggacaccatagggatgcagtcagcaaaattcaaactttgggaagctgaccttcttacttcaacaaattgtaataaaaatggagatttaaattaaacttttaggccgggtgcggtagctcacccctgtaatctcagcactttgggaggctgaggcgagtggatcacttgaggtcaggagttcgagaccagcctggccaacatggtgcaaccccatctctactcaaaatacaaaagaaaaaaaaaacagctgggtgcggtgcggtggcgtgtgcctgtaatcccagctacttaggaggctgaggcaggagaattgcctgaacccgggaggaggaggaggttgcggtgagccaagatcgtgccactgcactccagcctgggcgacagagtgagtgacactccgtctccaaaaataaataatgagtgacactccgtctccaaaaataaataaataaacacacaaacttttaaaggattaaaagaaactcagagaggcacattgacaaattatatctgtcttatttggatcctgactcagttaatgagaaattggagcactgaatggatttttttttttttttttttgagacagggtctcacttgatcgcccaggctgaagtgcagtggtgtgatcttggctcactgcaaccttcacctcccaggctcaagggattcacttgcctcagcctccggagtaggtgggactacaggcgtgcgccatcatgcccggctagctttttgtatttttagtggagacagggctttgccatgttcccaggtcttgaactcctgagctcaggcagtctgcctgcctcggcctctcaaagtgctaggattacaggcatgagccaccacgcccagctgatatttaatatgaaggaattgctgtcttttttttttttttttctgttaggtatgataatggtattgtggttaggttgggaggaaaaagcattcttgtgttgtccctgagatacatattgaagtatttttgaatggaatatgtctgggctttgcttcaaaatgatctgcgaagagggggagtaagttggagtatagattaaataagatcaaacatgatatatgaattgttgaaaatggataatggagacttggacgtaatgttcctctgcttttgtatatgtttaaacatttctattataaagtttaaaagttcttggggtggacatctatcactatagacaatctaaattaaatgcatcatgccgtgtttactacagagttgtcatctaagtgaagatgaagtgttctttctttatttttttttgagacagagtctcgctctgtcgcccaggctggagtgcagtggcacgatctcagctcactgcagcttccgcctcccaggttcaagcaattctcctgcctcggcctcctgagtagctgggattacaggcgtgagccaccatgcccggctaattttttgtattttttagtagagacggggtttcgccatgttggccagggtggtcttgaactccgggcctcaagtgatctgcccgccttggcctcccaaagtgctgggattacaggcatgagccaccgcgcccagcagatgaagtgttctttatcagtctttaataaacatacaattactcagtgtcttaatcaaataccttttcggtgtgtgtgtttttttttgtttttgttttttgtttttggagacacagtcttgctctgttgcccaggctggagtgcagtggcgcaatcttggctcactgtaacctctgcctctcgggttcaagccattctcatgcctcagcctctcgagtagctgggactacagttgcacatcaccatgcccaggtaatttttgtatttttagtagagatggggtttcaccatgttggccaggctggtcttgaactcctgacctcaagtggtccgacctcggcctcccaaagtactgggattacatgtgtgagccactgcacctggccggtgttttgattgaagtttgcatttaccatgctgtaggagtatctttcttgatcagtgtttctcttccttggttatacatgaggagcttataaaagatctgaatatcctgaccctatcttcagagggtctgatttaactggcctgtgatagagcctcggtaccttttctaggaggtaaattcttaatatattgccaaggttgagaatcactgctctagacaacatgacagctatttggatgacaccgtgtaatggttagtatttccttgaagtattgtatcttactgtgtatacagctctaattgcatgtcttaataaggtcttgctgagcatgtagtttgtatgcatacaactgaggtatatatttaccttttcagtaagagtttgctgcctcttttgccactatttttcagaagagttagactggttaattgtgaataaaatagggccaatcattagaagtgttcagtttaatgaaattggagcaggcccaatatttaatttttctcttcaggacccattttgctcatgagaacatgaggcatgagaagttattttgataatgttgaggtttgtaaaaataatgagaagacactaaataaataattggtttattaaaatgaaatgtaattgaaagtctgcaaggaccttggagtaaaaaaattgtaattgggaagttgatctggtgaaatcctaacttgctctgagtaactaactgtcttgaaatttttaggctgtcacccttgacccaaactttctggatgcttatatcaatttaggaaatgtcttgaaagaggcacgcatttttgacaggtgagagaatgttctgtttaataaattttcttgaatctttgttgtattgacacttgacagtttggaccgaaatgatgacaatagtccattgaagcatatttgccttttctagcacgttgttctctgcccatgtcctgtgttgccttttatttatagatgttgttcgttgcctgactttttgttgttggctttcctcaaagccgttatccttctcattgggagtttagttgaaatttttttattgttaaaatggttgaaatgattctttcttagactaaattattcctttgacctgattttagaaagcaaagtaaatccagacttttaaattttttgttgttgtcaaaggaaagcctattttttatgtgggagtagaaaacttcccagtgtaaagacacattttataaaggtgtgattttggtttgaggttaaaatataatacagcatgaattatgtaattaattacaattacttgatatattttgatatagtacagcttgaatgagttgtaacaaaccatccattaagcatgagttacattttgtgtgtgtgtgtgtgtgtgtgtgtgtgtgtgtgtgtgtgtgtgtttatttacagagctgtggcagcttatcttcgtgccctaagtttgagtccaaatcacgcagtggtgcacggcaacctggcttgtgtatactatgagcaaggcctgatagatctggcaatagacacctacaggcgggctatcgaactacaaccacatttccctgatgcttactgcaacctagccaatgctctcaaagagaagggcagtgtaaggatttttactcattctatttgttatctggtaggattaagagtcttttctggccaggtgtggtggctcacacttgtaatgccagcacttcgggaggccgagatcagaggattgcttgagcttagggtttcgagaccagcctaggcaacatgacgaaaccctgtctctacaagaaatacaaaaattagccgggcatggtggcacacacctgtagtcccagctccttgggaggccgaggtgggaggatcgattgagtcctgggaggttgaggctgcagtgggccatgattgtgccacagcactccagcctgggcaacagagcacgagactctgtctcaaaaaaatcacaaaaaccaaaaaacagcaaaaaaggaaagtcttttgtacaagtattgagatggtatattggtttactttagagttttggttgagggtaagaataccaaaaaatatcaattttctgtagcattaccagccattaggcttaattaaacaattattagaacagtatcagtggaggctttatgattctgtacagtttttgaagactttgttttgttttctaggttgctgaagcagaagattgttataatacagctctccgtctgtgtcccacccatgcagactctctgaataacctagccaatatcaaacgagaacagggaaacattgaagaggcagttcgcttgtatcgtaaagcattagaagtatgtgagggtggtgtagctgggcatttagcatgatagtagagggaaagcagttaagtttaccatcatccacctcttttgtaaaaatagtggttgaatcatttacaagaggattattcattgaagtaacaattgagtacctaaggtatgatgtgaggccctatgtgacattccagaaaatccctgcattcagagttcattattctgtggataagatctgtacaaaaaaattaaacattaacccacagttcaagagaagttacttataagtatataatcttagtgcctgatggctgtatggtagtggttagtagatgtggtaggagtttagcagagagagatttcagtggtgttggagtggtcaggataaactaagaggagaagaggtgtacctcattatgtttgaaacaagaagaggtataaaatagaggaagaggtagaatttgagaatgaatagacttggaaaaagtagagacaaatttaggggtttaaatgtacttgagcaaagttcttaaggttgtggtgaattattactgctgctttagcaatttttttaacctcagttctgatcttgactctttataggtcttcccagagtttgctgctgcccattcaaatttagcaagtgtactgcagcagcagggaaaactgcaggaagctctgatgcattataaggaggctattcggtaagagacactaacagccttatttttaaaattatttttaattttaaaatgtttgacattcggcacattgcagatgctaaaatggctttaaataacaacggaataagttagcattacagtgggttaaagatttttgtattggagaaataaaacctttggcttctcttttagaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggtactactgtttattataatatgtgcagtttaacacctaaaatttaacttttggaaattttttaccatcctgctttatttattttccaggattcagggaatattccagaagccatagcttcttaccgcacggctctgaaacttaagcctgattttcctgatgcttattgtaacttggctcattgcctgcaggtaaagaataacaggccagtaattggctctcagtgttgtaatagctttttaattgttgtatgccataagaatccaagcctgactggaaatagtatttttaataggctatctgacattactttaggccaaagacatatcaaatattaaatcctgggataggactttctggataataacttgtttttgctttctctagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataaggtgtgattcttttgttttaatctttttgttgtaaactaaaacacaaatacagaaaactgtaaaaatcaaatctgtggcttaatgaacgattataaagtgaacaccacccaagtcgagaaataaaacttttgtgggccacttcagaaccccttccattgtgtcctgagtataaccccctgcacttcataagacggaatccttaactccttcacttaaacactaatgatagactgatggtacttttctttaagttgaaagccataatttttttttcttttatcttttttttcttttttttttgagacggggtcttgctctgtcgcccaggctggagtgcagcggtgtgatcatggcttactgcagccttgacctccccgagcttaggtgatcctcccacctcagcctcctgagtagctgggactacaggcgcatgccaccacacctaattttgtgttttttgtagagatggggttttgctatgttgcccaagctggtcttgaacctctgggctcaagtgatctgcccacctcgcccggccaaagtgctgggattacgggtgtgagccaccgcgcctggccagccatcatgtttaatggagtgcttggtattttgtattcacctttgagaattagagcagtacttgatcaaggattggatcaaaggttggataatagattggagtgctaggtgtactttttttttttttttgagacatagtgtctctgtcatccagactgcagtgcagtggtgccatctcagctcattgcaacctctgtctcccaggttaaagtgatgctcgtgccttagcttcccgaggagctaggattacaggcgtgtgccaccacgcctggctaatttttgtatttttagtagagatagggctttgccatgctaggctggtctcgaaatcctgacctcaggtgatccacctgcctcagcctcccaaagtgctgggattacaggcatgagccactgcccccagccataattttgtttttagaaaatgtttccctatagaattttctaaaatgcgggaggaaaccatgctctgtccatactgcttcatacctacaagtgttagatttgctcgtacttttttttttttttttttttttttttgagacagggtcttgctctgttgcccaggctggagtgcagtggcacaaccttggcttactgcaacctccacctcccaggtttgggcgattctcccacctcagcctcccaggtagctgggactacaagcatgtgccaccacgcccagctaattttttttttttttttttttttagtagagattggatttcactgtgttggccaggctggtctcgaactcctgacctcaagcgatccacctccttggcttcccagagcgctgggatttgctcatgctttatagatctcaggagcaggtcaaagtatgaagcatattacataaagtgctgaggttgcatctctctggcaatattaactaaatgctctgggcagacctttttcaacaggtgtgaggtataggtttggtgtgtttttcgtcagttttcctagatgaaaatttatgtagattttactaacaagcattggattctgttgatagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtaagactagtgtttctctagaatcactatttgtttaaaaaagaaaaaacccacaatgttggcttgtcaccatgaggcatggaaacctagtgtcttttggaaagatttgagccagaaagatttgagccaatgttattaaatatgccatgtgctgcctttcaggtgttctgttatgccctgagcccagacgatggcacaaacttccgagtgaaggtgatggcagaagccaatcatttcattgatctttctcaggtagatgaaactctcatactttaactttttattttgagcaagtttaaataaaactattagcatatagtttatttttgatgataagtattaaatgctgtagtaccacatataggcaattgtgttgatcttatttccttgatcatttgtgttaatcagcatggctttttccgaggttgcaaatgaaactgaaatgtgttatgcttgtgcttggacatacaacttttctggagattgagccagcacttgtgacagaagatacttaataaatattgacaaaatggtgacttgggagaagaataaataggtcttttaaagaaaatagggccgggtgtggtgactcatgcctgtaatcccagcactttgggaggtcgaggcgggcagatcatgaggtcaggagatgagaccatcttgactaacatggtgaaaccccgtctctactaaaatacaaaaaattagctgggtgtggtggtgcattcctgtaatccccgctacttgggaggctgaggcaggggaatcgcttgaacccgggaggcggaggttgcagtaagctgagatcgcaccactgcactccagcctggcaagagcaagactctgtctcaaaaaaaaaaaaaaaaaaagaaaaaatagatgaactatggttcatcagtttccatgggcctttgcctttggttatctttatttctgtacttgttctattgttgtatcctctaggagagtaagttttatgataaattaagattgaaacctatgggggaattaatttgctgagtatgtaggctacagtgttttctttgtagactctattagccactttgactaatagagataatatactctttatatgtgtgtgtacacacatgtatgtatgtacatacacatgcaggtatgatatgtatgcatatatgtataaatatacatgtgtatgtgtatatatatatgaatcactgaagtcctagcagaaaggttttgagacttctcatttaataaatagtatgtactaacaaattttgcagtatagctgttgcttcaaaagtatacctggccatttttgatacacagttggactctttgtgaccaagaagcatacctctttctacctctgagacctttagggactcactgctgattgattgcagtctaaactcttcagcatagcttttgtaacctttctctgtttgccacaactttgtcaatactttaactcaccattcaacatcttgtataccctatactaaatagaagtgaattactcaccctttttttttttgagatggagttttgctcttgtcgcccagggtggaatgcagtggcacgatctcggctcactgcaatctttgcctcccaggttcaagcgattctcttgcctcagcctcccgagtagctgggattacaggcgcctgccaccacacccggctaatttttgtatttttagtagagacggggtctcaccacattggccaggctggtctcgaactcctgacctcaggtgatccacctgcctcggcctcccaaagggctgggattacagatgtgagccaccatgcccggcctactcaccattttctaaactccctcacactttactctagttcttcattcatactgttctctactgagattgtattctgttaaactccttcaaactcctattcgtctttgaagacctattttcaaataccaattctaggctgggtgctgtggctcacgtgtataatcctttgggaggctgaggtggaaggattgcttgagaccatcatgggcaacatagtgagaccccatccctaccaaaaaaaaaaaaaagattacaaatttcaaataccaatttctctgtgatatgttgttattcatacattcaatccagaagtgaactctccttcctttgtgttctgtttctttaatgctttgggcccattttaatgacagtcaaccatatttgtgcccgaattaatgtagttaatttgtgttcttacctcttttccatctgggaatctgaattatgttaaatgccattaaaactaaatgccattaaaactaaatgtcattaaaactaattgatctgagattatacatagtgagttcttattttgtattctgtagattccatgcaatggaaaagcagctgatcgcatccatcaggatggaattcatatccttgtaaatatgaatggctatactaagggcgctcgaaatgagctttttgctctcaggccagctcctattcaggtaaacaaattaacagtcatcacttataacatgtatttggctaagaatacagtgaggtgctgcttttcctccctctggttaactgatatttgaaactgtagggcagacatacttttaatttttttaagttgttgaaatgcacaggacaaaaagagtgtagagcacagtgcttataggtacatgtatatagagacatgcaattcatggttggctatgaacagttactctgtcttgcaaatttgaagaacattttagcattttgaaagttagtctgaaatacaggccgggtatggtggctcacgcctgtaatcccagcactttgggatgcttaggcaggaggatctcttgaaaccaggagtttgagtcctgcctgggcaacaaagcaaaacaccctatctctacaaaaaattaaaaaattagccagagtggtggtgtgcctctgtgatcccagctatttgggaggctaaggtggaaggattgcttaagcttaggagtttgaggctgcagtgaactatcactatgccactgcactccagcccaggtgacagagtaagagtctctcttatagaactgcttcattgctttcggctaaagaagtcagccttgctgtgcgtgtggcaagtgcctgtaatcctggctactctggaggctgaggcagaaggattgcttgagcccaggagtttgaggctgtagtgatctacgattgcaccactgtattccagcctagggaacagagtgagatcctgtctctaaaaaagagttagacctccttgtttatttacttatttaattttggcacctttaggttctttttttaaaaaccactttattgaggtacagttgacatacaaaaagttgtacatatttaatgtatgtgacttgatgaatttagaggtaagtgtactgataaaagttcttaatcagtttttgatctgatttttttaaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaaggtaggtatgaaacagtgctatggacgaatttcaaagaactgtagctttttatttccttgctattgtctatgtaaatcctaaaagacatgtctgaaactattttttccattagaaaaaagcagtcatcgattttaagtccaatgggcacatttatgacaatcggatagttctgaatggcatcgacctcaaagcatttcttgatagtctaccagatgtgaaaattgtcaaggtcagaacctagtcagtattgtcattgaaataaagttaactgcattcacgatcttttccctaatgatgcatttttttttcagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcaggtgagaagataataatacaccattatatgtcccgccaagtatgcatttatttcccttaacctcatgataactctaggaggcaagtatcattatcaccatttttatggatgaggaaatgagtttagtggaaacgtgcatcttatataggtgtgtctgattttaaaagtctcctggattcagccagcagattattacttactgagaaactgctgtgttaatatcttgttattccctgcctgtggctttactctcttacatgatgaactatgtgtagattccatacagtttcttgcttctgtaaacccatcctttccctagctaaatcctactcaaacgttcagttcagacagctcttccaggaatccatttccgtacttaccgctaacgtctccatccctacttcattggtacctgtcttttatacctctgtaatgtttggaatatatcattacatacagcacaacagatgataattccctgtgtttgtatcctctactgaattgaattactgagcccatgtcttaatcacagtaatgtagtatgtactcaataaataatatattgcatgcttaaataagtagctctatcaagagagtgtaaggcaaagatctctgacctctagaggtcatagatgtccttgcacacctggaatagttatataacaatgtaaggcagtactcaaatgtgtgagaattacaagatgaaactaattatgtatgtagaagctcagaaacggtgaggatcaatgtgaagagagacactcttgggagaagagaccatttggaggagtaatttagccttgaagagtagatgtgatttagaaaaggacatttcattcatgaagaaaagagtgatcaaaagctgttggaacgttaataggattttgagaccttttttggttagagcaagaagtttcatagtgcagtctcccccaacttaagataatgctgcaacggtttgccttttcttaaacttcatatatcatgaatattttctcatggttcagtgacttttaatggttataccattttggatcttatggattgaaatattggactccttttgcctttaaatataaccatcatttttttcttgttctagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacgtgagtatgcaagtatgttagagactaataaagattttgtatctagagcttcttgctgaagatggtccttccactcccatttaggagctgttctgctcatttctttttaaaatttttttttggctgggtgcagtggctcacgcctgtaatcccagcactttgggaggctgatgcgggtggatcacctgaggtcaggagcttgagaccagcctgaccaacattgcaaaaccccgtctctattaaaaataccaaaaaattagccggacatggtggtaggcacctgtaatcccagctactcgggaggctgagacaggagaatcacttgaacccgggaggtggaggttgcagtgagccaagatcgtgccattgcactccagactgggcaacaagagcaaacctccatctcaaaaaaattttttttaaaaatactttttaaaaaatttattttatttatttacatgtgactcaactgggttatgccctttttttaaaaaacagaatctcactctgttgttcgggctgcagtgtagtggtgtgatcttggctcatggcaacctttgcatcccaggttcgagttattcttgtgcctcagccttccaagtagctgggattacaggcatgtgccaccatgtctgggtaatttttttttgtatttttagtagacggggtttcaccatgttggctaggctggcctccaactcctggcctcaagagatctgcccgccttggcctcccaaaatgctaggatgacatgtgtgagccaccgcacctggccttgtgctcatttataatcttcaagagatgtagatttttcaggcatttttggtttctccttccagtgtctaaatatgacattgtgaaccttttaaatttacatattcaaagcattcttctgtctaaagggtcagcaaactttttcttaaagggccagatggtaaatattttcagttttgtggtccatgctgtttcacgtctactcagctttgccgttgtagcacgaaaataaccataggcattttgtaaatgatgagtgtggctgtgttccaataaaattttatttatacgaactggcagtatgccagatttggctcacaggctgtgtagttcgccaactcctggtctaaactgatagcatatgctgtcatgtacatccacccatttttaacattcttgtagtattgtagagttataaccaagaaggagtcgatctgtacatatgattatctctcagttcatcagacaagtttgcataagtgggatatcggatagctataactggctcttaatccatagaactaaaataaaatggcatgttttacctttaggtaatctggagataattccttggttaattttttccccgatatctgttttgttttatgtttagaggagaggggaggatagaagagaagaggaagcagatgagtacaggtctactgtccttaatccttacttcctgatgttcacaaaaactctgaaaatcaaaagctttttcataagtgtgtggcaaatttgtttggcagcaaaactacctgaactaacattagggtatatattagtccgttttcatgctgctataaaggactgcccgagactgggtaatttataaaggaaagaggtttaattgactcacagttccgcgtggctatggaggcctcaggaaacttagagttacggcggaaaagggagcaaacatgtccttcttcgcgtgatggcaggaagaagggctgagccaaagcggggaaagccccttataaagccatccgatcttgtgagaactcactctctatcacaagaacagcagcattggaaataactgtccatgattcaattacctaccactgggtccctcccatgacacatggggcttatgggaactgcagttcaagaagagagatttgggtgggggacacagtcaaactatgtcagggtatttgtagtcttttatttatttcatttagtatgactgttcctgcatctcaatgcagaggtactaatatgtttataggaagttgctgctgagggtgttaatgtgatacatacacacacagtactacttttttaaaatctgaaatattctgaatttggaaattcatctgttctcatagctttcagagaaagggattttgaacttacatggtacatagagtagatgtaaatctaaatcaggagttggcaaactatgacctgtgggtcaaatccagcccactgcttgtttttgtaaataaaacttaatggacacatagctatgcctacttgtttacacattgtctgtggctgctttcaagctacagcagaagaactgagcagctatgacagtccatgtggccacagaaccaaaaatatttgctatctggccctttacagaaaagaccgatttatattaggcaaagaaagttaggcaagtgtgaggtaactttcttggttgtatcatagtgggggatttgaaatttggaatgcaaaattcctctctcagcaaaacccactgcctgtgtcaattcccgcaggaggtagctgcctcagattttgcctgtctttctttgaactcactttgaggacagctaagcagaagagggataattcaattgatctcattcatctctgtgaaggaaagacttaagtccacagcaggcttctatctggatggaaagaatagagtgtggtagaattattagagacctctgggagtctttgttgaaaaaggcagatctgctattaataattattcttattttccctattttagattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggtaagttgctgataaatcactggaatcttccttgttcctttgaaaatctccgtttgggggagaaacttccaggtgaaattatatgtactaggagcaacattaaaggaaaggtgatagaaagtgagacttgttctcacttcattctcttcatctgcgttgtgtggaggcttaacataaataacattaactctgtgctgttttacgttctcagatgtgcagttgttatcttttgtattacaggagagactcttgcttctcgagttgcagcatcccagctcacttgcttaggttgtcttgagcttattgctaaaaacagacaagaatatgaagacatagctgtgaagctgggaactgatctagaatagtaagtaaacttttccttgaacaaattatttggtaaagtagagagaatatagctgttataaaatgaaaccataaaataagtgtaatataaaataggtgaactagttgtatgccctctggatgggagaagtacttctaaactcttagaaatgaagtgatcaataggttttactatgtaaaaagtaaatggctgaataaaaaatattcaagaaaattaaaaagcaaacgaggggaaaaaatcttttgtctcagataacaaagtattaattacctggcaatgtaaagactgcagaacatttaaattttataatcccctaataggaaagtaaaaatggaaatgaccagacacctcactgaagtggaaatacaaaaggttaacaagaaagtgtttcaggctctgtagtagaaatgccaattaaaatggaattgaggctgggtgtggtggcttatgcctgtaatctcagcactttgggaggcttaggcgggcggatcacttgagatcaggagttcgagaccagcctggccaacatggtgaaaccctgtttctactaaaaatacaaaaattagttgggtgtggtggcatgtgcctgtagtcccagctactcaggaggctgaggcaggagaatcgcttgaacccgggaggcagaggttgcagtgagccgagatcgcaccattgcactccagcctgggtgacatagtgagactctatctcaaaaacaaaaacaaaaacaaaaacaaacaaacaaaaaaaaaaccaaacaaacaaaaaaaaccaaaaaaagaacctgaggtatatccattatttgcctatacaataaaaagattttttgtatcagtgaggtagcattgaggactagcctttttatgcattggtgaataaattggtacagcccttcctcagagtttttagagccttaaaagttagatctttgggccaggtgcggtggctcacgcctgtaatcccagcactttgggagggcgaggtgggcggatcacgaggtcaggagatggagaccatcctggctaacacggtgaaacccccctctactaaaaatacaaaaaattagccaggcatggtggcgggcgtctgtagtcccagctacttgggaggctgaggcaggagaatggcatgagcccaggagacggagcttgcagtgagctgagattgcgtcactgcactccagcctgggcaacagagcgagactctgtctcaaaagaaaaagttagatctttgaccctaatactgtcacttcttcactacggtcggtgtaagaaataaacaaagcataacttaaatgcctgaaaatgagtaggaattagaggggtgatgcttagatgaggaggatttatccatacaataaactagtatttctttcattcttttattttttttgagataggattttactctgttgcctaggttggaatgcagtggggtgatcttggctcactgcagcctccacgtcctgggctcaggtgatcctcccacctcagccacctgagtagcagggaccataggactataggtacatgccaccatgtcccatgcctggctaatttttaaatttttttgtagagattaagtttcaatatgttgcccaggctggatatttcttttttcttttccttttttttttctggacggagtctcgctctgtcgcccaggctggagtgcagtggcgcgatctcggctcactgcaacctccacctcccgggttcaagcaattctcctgcttcagcctcccgagtagctgggactacaggtgcacgccaccacgcccggctaatttttgtatttttagtagagacggggtttcaccatgttggccaggctggtcttgaactcctgacctcgtgatccacccaccttggcctcccaaagtgctgcgattacaggagtgagccactgtgcctggcgttttttttttttttttttttttttttggagacagcctcgcactgttgcccgggctgaagtgcaatggcacgatctcggctcactgcaacctctgcctcccgggttcaagcgattctcctgcctcagcctcctgagtagctgggattacaggcatccaccaccacatccagctaatttttgtatttttagtggaggctggatttcactatgctggccaggctggtctcgaactcctgacctcgtgatccacccaccttggcctcccaaagtgctgggattacaggcataagccaccgtgcctgacgggtatttcttaaatgaggtttttctttcggtataatgggtgatgttttttctttgtgtttttctgagaagtagcatattacataataattaaagaaacatactttttgagtcagactacctgagtgaacccaagctctcctacttatgagttttgagactttgggcaaataaatctctgtgttgtgccttggtttcttcttctgcaaaatggagcataatgctagtgcctactttgcagagatgatgtgaggattaaaaaaggcattccatgtaaagtacttagaatagttgttggtatctggtaaacattcagcagatgttagctacttattattttcagaatttcctccatagaacatcacatacgtctaagaaaagtgagaaatttgaacccaggcattaaaaaaaaaataagattcatgtccattagcccagagataactatagtaaaaaatgtagtgcgttttattttcagacagggtctcactctgttaactcaggctggagtgcagtggcatgatcacggctcactgcaacctctgcctcctgggatcgagtgatcctcccaccttagccttccagtagctgggactacaggcacatgccaccatgcctggcttttttttttttttaatttaatattttgtggagacagggtctcaccaatattgcccaggctggtaactcctgggcccaagcagtccacccacctcggcctcccaaagtggcgggattacaggcgcgtgagacactgcacccagcctgtggtgcattttaaaatttttattagactctttggtacttagtttggttcatacaatgcttttcctcaacatttttgttctcaaaatttttaattttataataaacacatctatacctactgcttagaatctaccattagcattttactattcttgctttattacatatctattcatccatttattccctttattcatctgccaatccatcttattggacacattttgaaataaattgcagacatcagtacacttctccttaaatacttaagattggctgtcattaactggagttcagtacacatatatttttttgaggtagggtctccctctgtttcccaggctggagtacagtgatacgatctccgctcactgcaacttccgcctcccgggctcaagcagtcttcccctcaaactcctgaatagctggaaatacaagcatgagccaccacacctagctaatttttgtatttttagtagaggcagggttttggcaggttgcccaggctggtctcaaactcctgacctcaagtgatccacctgccttggcctcctgaagtgttgggattacaggcgtgagccactgcgcctggccatttttttcttttgaggcggaagttatatacagtgaaatacacaaatattcagtgagttttgagaaataacccttttttttttcgttttgaaacggagtcttgctctgtcgcccaagttggagtgcagtggtgtgatcttggctcactgcagcctctgcctcctgggttcaagcgattctcctgcctcagcctcttgagtagctgggactacaggcacgtaccaccacacccggctaatttttcatatttttagtagagatggggtttcaccgtgttagccaggatggtcttgatctcctgaccttgtgatccacctgcctcggcctcccaaagtgctgggattacaggtgtgagccacagtgcccaaccgagaaatacctttgtaacccaaattcctatgaagacaaaaaacattatcactccagagagtttcttcatgctccttatcagtcagtctttttcaccaacccccagagacaaccactgttctggagggtttttttcccttccataaattagttttgcttttctagaattttatccaaatggaactatgtcaatatgcactctaaaggcttctttcatcaagtttatttcttttgctgagtagtatttcactgtatgaatgcactacagtttattttcctattggcatagaattttaaaaaaatagagtgcacaggtctttctctttggagggtagcattaatatggacatggttgtattgagaccaacagatatgcacaaccattttactgcttctgtcacaacaaacattaaaacaaagttgggcgtggtggcgcatgcctataatcccggcgctttaagaggctgagggaggaggattgcttgagcccaggagttcgagaccagcctggacaacatggcgagaccccatctctacaaaaaatacaaaaatagctgagtgtggtgatgcgtgcctgtagtctcagcttcccgggaggctggggcaggaggattgcttgagctaaggaggttcagtctgcagtgagccatcatcgttccattgcactccagcctgggcaacagagtgagactctatttcaaaaattaaaagaaaataaataaaaattattgcttttaaaaatgcacagaaatgttctggcttctggttctaaagtatttatcccttcatctaagaataatctcatgaaaaatatattcaaaagggaagtagaaatcttttcccctgtgtttcctgaagaatcaattacttcttttttatttttctgaacagaaccatactcttggtgatattagcaatttttaaaaatctgaactcagttcaggtacaagtggaaaattacgagagtagacttattgtatttcttttccccttgagtggttttctgtttcatcaaaatgaccataaatcgaatacttcatcttatgtttatgctttaacttttgtaaatgatgcttcaatgaatatctttgcatggtcctgtatgtttttgcatctgattatttctttttaatagattttaaagtgttactgttaggccagagggttatgaacatttaaggttaatacatacttgctaaattgcttaccaaaaaggtaagcaacagtacataggaatagtcatgtgccgttgtcaattcttgttattttaaaggtagaaacaagacgaaatggagaacgcgtggtatcccttggatatacttgtttaggaaagaactaagttttttcagagtatatggagttgagctcatttcagtgttagcattatgcaagatgtgacccttccctttttagcacgaagccaatcaagaaatgagatagcgtagagtttggtcatgcattttttgccacaaatgcgactaggtatttatagggtgtgtttctgagtttctgctctgatttgtaaactgggttcttgttttttattacccagcctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagtttttttttttttcctaattttgacctgtttcaccagtgttttacccttgactgccccttctatgctgcttccaaaagtgatagtgtgtgtaagatttttaccttcctttctaaagttttttttttttttttttaagtgagtcctgttcttcctatttctttcagcagaaatgaaatcccaggtaagtataagtattcaagtatttgatcagtaagtcacagttatctccagtgcattaaataaccttcatcaagaaataggttataggtaaaatctctgaaggatcatctatgtattcaagtaattattttttagataataactgtcttctggacttggtcttgaagtctgtacagattcagcctcagtagtagcgaactgcactgctgtttggtttggagtacaaattagacttatagtcctcctggaacttgagttattaaaatcataggaataaaattatgggatctcaacaaagggtcgagggtttgaggcttaaacaagccaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattctgaaccagaattacatgttaatgaacagtgtaccttttaacagtgtaaatcacggaatatccgtgaagggatttcttaatttattttttaccggttgattgaaatatcagttaaaggttgccagcatggttgcagataaactgatgtttgaaattcgctgaaatacttaatgtggaataggataatatacttccaatgccctcaaggctgtgaccttacagccattttacatagcacatcattcctcctatagggatgaactttttcctggcacgaaaagtagccgctctggttgaagctttgcttattgtaacaggcttttatttccaggtaatatgtcttggaagacttaattctgattagagatatagatattactggaaactaattgttttttttctattgtactctgctttatcaaagaagtaaaacatttaaatcgtactacagaaattaagatgttgtcttgcgatccttaataaatgaatgatttccctttaatacgg

SEQ ID NO: 1479 - DNA, 42836 bp, Homo sapiens; identical to SEQ ID NO: 1478

SEQ ID NO: 1480 - DNA, 310689 bp, Homo sapiens
gtgcactcggctccgggagaggcgagcagcgccggtgagccccgcagcagcgcacccggccgcggagccccgcgatggagtgagtatccccgagccgcgccgccagctgctctcctctcggcatgttgccatggtgaccgcggcggcaggcagatcccgctcgggtccgcgtccaggatgggtgtttaatttcagccccgtgtgtacgcctggtgtttctatagcagccgccgcggcggcaggaggcaaggggtgggagccccgggtggcgtggtttttgcggctgccccttggctagcagggcctggggggcgagtgaggggagtagatgatgttgctaaggacggaggcatattctaggctttcctatctctgccccaagcttccgcttatcggggagttggccgcaatagccatgacttccgattcctaaccatgtcagcattattggactgcagttaaaaaaagagggagggggtcactgcggatcggaagcaaacgcggttcagtgtgaagcgtgtaatggaaggatgagttagtgggtaatatgagccagggctgcaatgtcctggctactagaaaccatcagaagacccaaaagaattgatttgttcctggggtattggagaaataagacaaacatattggcggcagcccggagtggaattacaacgtttggcaccgtgaatacggcatggatgggtggggaagacaagagaggcattaaccagaaaagacattaaataaagggctccggttgtgggtctggtctaggattcctctcttctctgtgtttgcatccctacattgctttttggacactctctcgagctgctgccacagcaggaccactctgacaggcgacagccagccactccaaggaagggtcatttttggagccagctattagatcccgctcacttggtcagcttctcctcttccgttctcttcccacactactccttgacattgaggccgtctgaaatcatatttcaagttagagataaagtcatgttttcagacatcaggaccttcgtaccaaacccaagaaaccttagatgcagcctttatccctctgcgtatctgattgtgtagatgcaatttaatcctcagaaaggctgctaaagcagaagtgagagatggtgtagcattgtaggagtcacagtcatggatttcaggccccacctagcctgatactgctgttattgatttcctactccagcaattgaatgtctctgagcctcagtttccctatctctgcaatggaaacaaagatgttccttactcactttgaagcattattgagaggatcatgtaatatctgtatctcttccaaagggctttgtaaattgtaagatatgtacaaatttaaggaactagtgtcatgtttaagagctgggctctagagtcagattggctggtttgaggcttctgacactttgctgaatgatgttaatctccctgggcctcattttccccatctggaaaatgggaataataatagtaactatttcatgtactttttgtgaacattaaggaagttaatgatgtaaattgatacatacacatataaggttcttagaacagagcctggcataaaataagctcaataaatatcatctattatctatgaatattatctattattattaggttggtgcaacagtaattgcagtttttgccattactttcaacggcaaaaaccgcaaattactgttgcaccaacctaatactacagtctacagcatttattggggtttcggattggcaccaagctattcttcattttagacagggtctcactctgtcacccaggctggagtgcaatggcgctatcatggctcactgcagtattgacctcctgggctcaaacaatcctcccacctcagccttctgatgggactacaggcatgcacaaccatgcccagctaatttttaatttttcatacagacgggattgtcctatgttgctcaggctagtcttgaactcctgggctcaagcaatcctcctgccccggtcttgctgggattataggtgtgagccaccatgcccagtcttttttttttttttttaatttataaagaaatacatggtgtggtggttcatgactgcaatctcagtgctttgaggacagaggtggtaggaagtcttgatgagcccaggagtttgagaatgcgctgagctataattgcaccactgcactgggtgacagagcaaaacctcatctcaaaaaaagaaagaaaggaaggaaggaaggaagaagaaaaagagaaagaaagaaagagaaagaaagaaagaaagagggggagggagggagtgagggagggaaggaaggaaagaaagggaaagacaatgcctgaagggcaattgagagtaacataattcccaagataccactgttgatgtgagaactagcaagaagccacagcaggcttggatatacggaacagactcggcctgatgcacacttcattcttgttcctcactgtcattttcttagacatggagactgtcctttacaagagactgaacatagatctagtcctctcactgggtagcgctaaaggagagcctggtcatttgccagggcagcaactttcatctttatgctctcacatggataatctaatatttgatatgtttctcccagacttagcacttgggtgctcaataactggaacagcacacaggattggtaagtttacaaaggtcctcagctttttcccacattccctctgagtctcctggctaaggtttcctccaggtgtgctaagctcacacctggaactccttgtgaacaaagaccttcctcatcacattcttcttgctccacaggatccaaattactgcctcaattagcctccttctccctaatcaacttggcctcagctttcccattcccaagcaacattccaaagttctcacttcctggttaaccttcccaatttccaactctgttttctgccctacttcgtttgcttccttaatgtattaggctgttcctgcattgttataaagaaatacctgagacagggtaatttatgaagaaaagagctttaattggctgatgattctgcaggctgtatagaagtgtggtacaggagtcagctcagcttccggtgaggcctcaggaagctttcagtcatggagaaaggtgaagcagaaggctggcaagttgtatggtgggagcaggagcaagagcaaggggtggcgggggtgtcacagactttaaacaaccagatctcaggggaactcactcactattgcgagtgaacaccaaggccccatccccaggattcacccccaggaccaaaacacttcccaccaggccccatgtacaacactggggattacatctcaacatgatacctggagggggacatccaatctacatcacttaatatagtgagctttttctttcttttttcccttttagaatatcatcttttcctgtccctccttgggtctcacaacatttcccttgtgccaaatactgcccctacccttcaatctaaacactccccagatttcatctccggtagaaaagcccactttgaatatgagtgaaatagggactccattccccttacttactgtaaccaacttatatttataaacatttattaaaagagggaattaaattcacttcttttatgttttaatttaaccaacaaacgtttgttgagattagcactggtcaacaaaacagtcatgattctctttgtctgatgagagatagatgttaaatcagtaaatatgtgtgtatactgattgaatttctcctcagaaaaggggtttttcttttctatcacattgtcaggctgcaaattttctcaacttttatgctctgcttcccttataaaaccgaatgcctttaacagcacccaagtcacctcttgaatgctttgctgcttaggaatttcttccaccagatgccctaaatcatctctctcaagttcaaagttccacaaatctctagggcaagggaaaaatgctgccagtttctttgctaaaacataacaagagtcacctttgctccagttcccaacaaaattttcatttccatctgagacctcctcagcctggatttcattgtccatatcgttatcagcattttggtcaaggccattcagcaagtctctagggagttccgaactttcccacattttcctgtcttcttctgagccctccaaactgtttcaacctctgcctgttacccaattccaaagttggcttcacagttttgactattttttcagcaacacccaactctactggtaccaatgtactgtattagtctgttttcatgctgctgattaagacatacctgagactgggcaatttacaaaggaaagaggtttaatggtgaactcacagttccatgtggctggggaagcctcacaatcatggcagaaggcaaggaggagcaagtcacatcttatgtggagggcagcaggcaaaaagaaagcttgtgcagagaaacttcaattttaaaaaccaccagatctcatgagacccattcactatcatgagaccagcaagggaaaggcctgcccccatgattcaatcatctcccaccaggtgctttccaacacatgggaattgtgggagctacaagacgagatttgggtggggacacagagagaaaccatatcaccaaggtttccaatttaaaatgaaacctagtgaaaatgaggatacatagtcatttttttcacaagtattgttggttttagtaaaataagagcttcttagtttaagaaaaaaaaaaaaaccccagccataaaagagaataaaatcatgtcctttacagcaatgtggatggagctggatgccattatcctaaatgagctaactcagaaacagaaaaccaaatattgcatgttctcatttataagtgagagctaaatgatgtgtacacatggacataaagatgaaaataatagatactgggaacctcaaaacagggaagggtgggaaggcacaagggttgaaaaattacctattgagtacagtgttcactatttgggtaatgggtacattagaagcccagtccccaccagtatacaatatacccatgtaacaaacttgcgcatgtactcacctgaatctaaaataaaataaaatttacaaaaggtctatcttggaaaagaagaaaagtctaatttccaccttaagaggctagaagagcaaactaaatccaaagcaagcagaaaaagaaataaaagaaagaaagaaaaatctaggtaataaacaagaaaagagggtactaactgattgaagttaaaatttttcttagtgacatgctctgtactggatgtgtagaacagagaagacctactggaaaaccagaaggtagggttggtgtcatgttctgtaccatgtcagtgttcttgtgtggtacatgaaacatcaggcaatggcaggtacttgctgccctcctgggtgggttgggtatgagatccatgtgtttgtaggaatgcactttaacacctgcagttattaatttgatgccacacctatagattttgcctcacacttctctggaatggtcttcaaaacagtatgggatccaaaaggcacaaagaacataacacgagaactctaagttgttgcgatccctgtaagccctggggctctgacaatgtgggtggcagccttggaccagaagtggcattccccatcaccagtcagatgcctgttatcacatggacttaggcttatagcatccagtggtgatcatgaaacatctgaagtttgattctgcaaatgaataaatctaggttcatgaaagaataagtgcagtagggacattaagttacagataacttaaggttcttaacatatgccttcattcattcatccagtaactcatttagttagcaaatatttattgaatactttctatgtatgaagcactgtgataggtacttgcgataaatggtgattaaaaacatcccttaccctgtcttcaaggagcttacggcttagtctatgtgtgactatggatactttgtgagtttgaactatttttcttgctgaatcagtcttctgatgacacaaaatgtggcatttcgtgtgctcagcatatggtgggcattaaacaaatgtgtttagaaatgtgtaagacttttagaagttaatttctatgatgaaagtaatgtatgctttttaaaacaattcaaatattacggaagtttatgaagtaaatatccccattttccattctctcactcatatctcagttcctagaggtgattaccatgaacgcttgggaaacctctttccagatattttccatgcaaacatcatagagttggaaacacttatatatatatataggtttaaatatttcttttacataaatgaaatcataccacatatgttgttctgcagcttgctttttccacttcatattatattctacatactttttcttatcaatgtatgtcagcctgtgtagctcagtggtaaagcacatgctttgaatatcaatatatacacatctacttcattcacttttataaaactgcttagtatttacttttggaatatcattaaccagttcttcatgatgaagagttagacttgtttccactttttgctactattttcaatgctacaatgaacatccttgtccacactgcaaataagtctgcatacaattttctagaaatgaaattgctgggtgagtgaatatgcacattgtgaattttgttagatattgcccaggtgcctccggaagtattgtatccctttacattgccattcatcatgtttgagagcccctgtttccccaaatccttgacaaccctagccacattatatattcatatttgaatatttatgtttgactagtctaacttgatgtacatcatcactgtcagtggtcgtggtctgtgctcttgctctgtctacttgtcactttctcagagagccctagtaagccacaaggtgcaaatgttcagaagacagtgaaaatcacttacaaagacaaagcttaaaatatctcattgacttttaaaagtgatcaagtgattgttttacagttcatcaaatttagactttattgatagatttcttaccttaaagttgaggaaatgagcacatgtcacttagccccccttttaccatttgttgcagttatagtgtgatatagtttggctctgtgtccccacccaaatatcatctcaaactgtagtccccatgtgttcaggaagggacctggtaggaggtgactggattatggggatggtttcccccatgctgttctcatgatagtgagtgaattctcacaagatctgatagtttaaaagtggcagtttcccctgctctttctctctgtcctgctgccatgtaagacgtgcctgcttccccttccaccatgattgtaagtttcctgaggcctctccagccatgcagaactgtgagtcaataaaacctctttgtttacaaattatctagtctcaggtagtatctttataatagtgtgaaaatggactaatacttagtgttagttttatgttttcaaagtttttagcatttgcaaatttgaacataattctcttaattcattcaatcgacggattctttttgagtgcccttttcatcctaggcactgctccaagcactgagaatacagcagtaaattgtcaaagaggcaaaggagcttatattgtgttagaggagacagacaatacatatattacatatatactttgtcaggaagcaataaatgttaaaaaaattaagcacattaggagactggagagtgatgggagggttatttttgatagtgtcatcagggaacaggtttctgacttggtaagtttggatagagacttgaacaaggtgaggggatgagacatacagaagaaggaagagcagttgcaaaggtcctgaggcagggccatgctttgtgggctcagtgttagtcttggatctaaatgcagtcagaacaccaccagccctttcatcaatgacatcctcttttttgagcatcttataggttgatttagtgtttagttaaaagggtttgttttcaaacagggccaaagtgtattaaattctaaatgcctgttggttgtttctatgaacaaacaagttgaatgtgtataaaattatagaatcatgtttttagcccctcataattctccaagatgtcattccattgtgttctggcattgacccttgctctgggaaggtctgaggctagactatttcttctttgtagatggcttgcctactcccatccctcccactcctgcaatttttttttttggctttgatgctgatcaagttatttttaaacactgaaagtttggtaacttctctttgatatttcttactgtaagtcattgtgttgttgttttttttttctggaaaatggtagttcctttgttctgaagagtcatattttcctttatttttttgtaaagatattttccctgtggctttcaattgaagaatctatttgttctgttatctaccacagggacatctattacccattgctctccataactattaattctgaatttttctcatttttttcctgatgttcctatgagtttccttacatttaaaagtctgtcatgtagatagttgactctctttttaagcagcagtttctaagtagggctcacttctgaaatggttttatggttatcttcaatttattttctggcttggctagcacattttgcactttttaaaataaagagttcatgtatccaatttttttgaatgtatggagagtagtttatcagaaaattatctgtattttttgggctatttttctgaaatgtatttatctgccatttgctggtaactcatttttataaaaataataactctgcatatagaatctatgcatgttaatggctttgcatttattatccatttccaaatagaggtaattctatccaaacctactatttgcccaagaataggtagaggggatggagacagtgatttgggggagacattagctttggattggatattttgtctcataaaaaattcttacaactctgcaatatcttctgttcaaaaaagttgtgtagagagtgagcagatcattcagacagatcacatatcccagcttactgagtgtgtgtgagttgcgggagggtagacagatttttggtgctttaccactacttgatgacttggtttagcatttatgaagagagtggcagggcaaatcgactacaaaggtaattgctcttttccttctattttcctacatctcttgccttgagatgattcctccatgttaaggttttcagttttcgggttttgcagataataaacattaaggattcacacagtagtgccatcggtgtcactttctccatcagttcactctggtagggaaccagccccttcacacagatgtcccccacgttttgccagttctcaccaccaaacattgggcctttgtgtactctctccttacttagagagaaatttgaaagccagttaagatctgtagaggactatatcaccttttagggttgtccactgatttaataaaaattatactctgtttggcagataattcttatagcttgtgatttgagaattgtagctctttgctagtttcatagtagatcaatttattcatttatttatttgttttttagagatgaagacttgctctgtcacctaggctggagcatagtagcacaatcagagctcactgcagccttgaattcctgggctcaagagatcttcttgccgcagggcccaaagtagatgggactataggcatacaccatcatgcctggctaatttttaaattattttcatttttattagagataggctctcactaagttgtccaagttggtctcaaattcctggccttaagcaatcctcccacttcagcatcccaaagtgctgggattatagaggtgagccaccatacctagcctcacagtagacacaattttccttccaatttttccttcttttagttcatttcagcggctttgagggaagcacagagaagactttaccatatctttgagttaatgaatcaatgaatcttgtgtttctacgaaaataatattagtaactaccaaatgtcattgttattaacaaatctgttgttattatatatctttattctctctcaattcttaggaatgtgtatggcaaaaaaagagttcatgaatgagattataaatactttgcagtagaagtattttggaaagggtgtatctggtgatgttctccatctcatccttcaaatccattttctacccttccctgcctatgtgcctcatgaggctgtgctttgtgccctgtgaggctgacctctatggactccctcagcttgcctctcttactctttgacttcctgttgagttggctcaatggaaggcaccagcaggagaaccatggatgagagaaaattgaggtcagtgtacggtttaatctatggtttctcttcctacagggcagtgggttggccagggcatctttcctcttctgaaggccacagcagcccttcctactgctacagctacagctctctcccactgctggtagccacttccttcctttgctcctctgggacttgatgtggcgatggctcccttatcactttgttagcccctgggtgcttcaccattgctgtgggttactgtcagctctgcctttgcctttgtaaagcagtctctttattaagattatttcaattatccagttggagtatgccatctgcttccagctgggatcctagctcacacagcatgtgaggatagaagcactgaaagtcttatgagaacccttcttattgccgggatggaatctggtgatttctgtttgttcatacattctggtcattggacctcaaggttccaatatagggaagagatattgagtgttgttatgtgcacactcaaatatttaagaaggagacactcctattccacagatatcaaagtgctcatttacttcccactgaaagatgtcattttcttatatataacttataataaaaattccccaaatttgatgccttagagggaagaccaatctcagttatgagtaggcttaatcaaaattttattttatttaaagaaatgaaatctcatttctcttcattataggaaggaacattcctggtcgaaattctgtttttgtaaataggtctttatagtatttgatgtgctatttaaaaatgtgataatttaacctattaatagtacataaatggatgctacctaaattactgccaagtcaattaagtctataccatcatgtgtaatctttttcacagatagtacaaaagcataaaatatagtgtaatgaaaatgtgtgtttcacaagttctgaataaatgggttataaattaaatatatcacaatccactgacttttatatagtattttgatatagtttggatatttgtcctcccacccagatctcatgttgaaatgtgatccccagtgttggcagtggggcctagtgagaagtgtttgagtcatgagggtggatccctcatgaatggcttggtaccttccctgaagtaataaattagctcatgcaagagctgactgtttaacagagcctggcacctcctcccctctctcttgccatgtgacactcctgctccccttcaccttctgccgtgagtggaagcttcctgaggcctcaccagaagcagatgctggtgttatgcttcttgaacagtctgcagaactgtgagccaaataaatctgttttccttataaattacctagtctccagtatttctttatagcaatgcaaaaacagactaatacatatctcatacttgaaaagtcagttgttgtttagactgcttgccctacttttaatacttcaatttctctgtcaatcatgtttatttattaattcattcaactcataattattaagtacctggtatgtgccagacacttttatgggtatctgtggtacaaataggagtaagacattgtctttgccttcataggggtcacaatctaatgagaaacatagttggtcaggtaattataataaaacatggcaagtgtttattcaaaggaaaggtttgatggaatactatctgtcagaggcacatagccttggggcaggagcctaaatgaattttaggagtccagggattctaagatgaggtcaaaatccaagcctatttcatagcccttgaaattaatttagcataaaaaaatctttaatgtttggactagtcatcttacaactggttaagtcatttacttaaaaaattagcaacccaaatcctgtattaaaactagtttgaataaccgacttaaccttcaactcttttagtttgcactatgactaatgctgcctccgtgatcatgggtgaggcagcattgtggagaatgcctgcccccttgaggaatcagaaactcagctttcagatgatggtgcaaagtgggatcacaaacaaaatgaaacaaaaaacaaagaacaaaaaggaaacaacacaaaaaccaaaacagaacaaacaaaacgatatgaagatttggtgggcactgctaaaccctttgtagatacttggttttagtcacgtttgctgagatcacatcgaaagcctctgaacctctgaaaggcattaaaagttgtcccactgcacctatgagccatccagagaaacgttaaataagttggtccagaaacacttttgaagtcctccatcctttcaatacttttcttacttctttgcttctgagcgggaggtgcagcatttaaaatcaaagacattaataataaggtctcatttcctaagacagcatctttcccactgcaatgtgcatatgaatcatttggggtcatgttgaaaagcagatcctgattctgtagatagggggtgtagttggggggttcctgtgttcccaacaagcttcccaggaggtgatgctgatgctgctggtctgcagaccacactctgagtagcaacattctcagtgcaaatatagagcacagggctttatataacacaagatgtgggtgtggggttcctcatccttttacatttcccatcctaagacaatctcatagtaggcgagtctgatgatgaattggagttcaacaatctgtgtgtggaacaagtaaacacacagagcaaaacctggctcttcattttaattggcacaacttagcagttacatgtggataggcaaagtctctattttttgggaaatcagaatggggtaggggttagccaataagtgtatatgagatagataaatgcaatcttatcttttaaaatatgatttgaaaattttgtggtcataaataatttatatcctaaaaatattcttctttggtcagtcctttaatattttaaaagtagtgaatctaattgtttatggcctcatgtggctgtaagccataatatcttggtataaatctctagttatgattatatggatataatatgaatatgatgtgttaggcccaagaagctcgtggtattccattttctgaacaagatcaataaactctgggatccttactattaaaagcaagggaaaagcaacttgttttgtaaaagataattcaaacatgttagtaagttgtgttttcatttatgtgagatgagaattatctccaaaactctttcattgtaatgggagctaagctttataaagacaatgcatatttgttaattagactgcacagaacaaggttcagttatggattcttgattgcttggtaaaatgatggctcttcaaacctaattacatttgggtgagctaaagcacagttctgaaggactcaatatgttcactcccagccttcatcagctgtacaatttgctttcctgttagttttactttagatcttgaaattaaaagcattttgttatatcaggatggtgtgtctatgacttcagtgcaagtagaggaggagtgttctaccctggaataacacaaattagaggtgcctgtatgtatgtgtatggtgtgtgtgtgtgtgtgtgtgtgtgtgtatatgtattaaacttcatgctttttaaagcctccttctaaaatgccatctttcagatgtgcctatctgtgtcttattttggtagtttttcttttctttccccattcaaccgtctcttgggaattagaaaaggattcctaagatcaaaatccccaattttctggaaaagctttggcacttgttactctctccccacattttcctgcttcctaagattggtcaagggcaggggccgggcgcggtggctcacgcctgtaatcccagcactttgggaggccgaggcaggtggatcacgaggtcaggagattgagaccatcctggctgatggtctcagggtttcaccatgtctctactaaaagtacaaaaaaattagccgggtgtggtggcgggcgcctgtagtcccagctactcgggaggctgaggcaggagaatggcatgaacctgggaggtggagcttgcaccgcgtgagccgagatcggccactgcactccaggctgggcgacagagcgagactcggtctcaaaaaaaaaaaaaaaaaaaagattgctcaagggcagccataggccctctgggtgacaaggaacagagatttatatagtccatcttacaaaatatggataaagggtctctttctctctatatatatgtattttgtgtgtgtggtaaaatatacatagcataaaatttaccattgtaaccatttataagtgcataattcagtggcattaagtacattaaccatgttgtgcaatcatcaccatttccagaactttttcatcatcccagactgaaactctctacccataaaacatcatctccctattctccccaccccctaccccccattctacttttggtttctgtgaaactgcctactctaggtgccccatatatgtagaatcaaacactatttattcttttgtgtctggataatttcactttgtgtaatgctttgaaggtttatccctgttgtagcctgtgtcaaaattttattcctttttaaggctgaataatattccattgtatggctataccacgttttattattcattcatctattgatggacatttgggttgtttcccccttttgggtatcatgaatagtgctgccatgaacactggtgtacaagtatgtgtttgagctttatattcttttgggcataagggttaatagatatttattgaaagcctattatgagccagtacagtattttctagaagttgaggctattgaggaaatggacagcatcccagcccttgtataaacacaagaatgataaataagcaattctagataccaataaaatcctaccagaaaaagaaaatttaaaaatgggttagagtatctgacgttggggcaaaaagtgggtatgggcaacctcatgtaacataggaggaaggagagctccaggcaaaaggaatggccagtgcgaagcctgagctagaaagggcgccatggtggtggaaggggctcgagggtggtgactgggggagatgctgggggagaagaggtcagaggctaggtcagccagaccttctaggccacttaggtccaggtgtcacaaggctcaaagtttatgcaactttgaaggcccttgcagaggaagaataaaaacatatcttccttttgcaaactttacaaaaacatgcccatcccttgaaaacacattactaggtcccttccagagttttcaggggctccaagtgaggggccgtggctcttaagcttcagtgggtccacagtgatctgtctctgagtgctgtagcaagagtctggcttttgtttagatgatgaaaggaaactattgggggattttaagcagaggagttacacaatctgatatgtagtttaacaagatggttatggttgttgtgtgaagaacgggctgtagagggcaaagaggaattaggggatgagaggaggctggagacctgttgcaggtgagaactgaagggtgtgattgatggctgtgccagtccggatggtgagaagtggtcggatttcacaacagtctctgaggagagaattcaaaattggtactgctaatgatggcataatagacaaacacactgtgatattgatgaggaggattcttcctttcctttcatcttagcctcctcaagcctctggtctcaccattatattgtagcaatattgtcaatcatttgagtttaggagctaagaggtccctcccaactatattgaagctgtatgatgttcaccttggctacagtcaacacttatttctcaaatgaagttacattgccttgtggctaaaagctttgacactgaaaaatgtattctctgtaaaagagatgtcagtgtatcatattaaaggtcagagatgccccagggtcagaatctctgtggtcctagccaaacattttgtaagaaaaaaattctcaaccactgtgagattgtttcagattcaggagcaaagcaaccatttgtcatttgcaatttatgatattttgcttcttcaggcaccagcctgatggcctttcatctggaccatgaaatatcatgactgattggttttttgaggagggagaatgttcacacttttcaaaccagcacatctgggggctaagaaggaagctttgcttgggaggaatcagccagttgtttagtgtggtggctttatgttttctgagaacaaaagcaatatggtatttgtgtgtgtgtgtgtgtgtgtgtgtgtaaaatcaatggagggtcttgggagcaggggagacagagggagagaaatacagcggaagagaggatgacagagagagagagacagacagacagagacagaaagaacatacccatactgtgtaaacacatttctaggaaacagaaacggaaagacaggttgattgccttgagggagcgagttggtatagttaaatgatagggtttgggggtttgaatcctcagagaagctcaggtagaggcaatgatagttgggtgtttgctgatgagcagaaggctaggtaactgagtgctagaacctaagctctccctgctcatagcagtttttctttgggtctcaggatgtcaggcaagaagtgaggatggctgggagctagggagtggcatgtcatccctggggagatgagaaagggtcagacttggtgtaagttttggagattgagctcacagatttgtgtgtgtttgtgtgtgtgtgtgtgtgtgtgtgtgtgtgtgtgtgtcaggttgtatgtatattgtggcaaaaagagaggactcacagaggaggccaaagtattttggcttgagcagtaggtaaatgatgtgcaatttgctcaaatagggaacccttgtttgggggtgggaaagtaagatttggtttgggagcgtgttaagtttgaaatgcttattagacattcagatggaaatgctgagagggtggttggctgtatgagtcttgtgttcagggaggttcaggagttcaactggggaatcgttagtccatggatggtgtttaaggccatgggatgaatgatatcactttggtattgagtgtaggtagtatagacagagacaagattcaagttgataggcagaagtttctagtattctgtaatcaggttttcattccctgtatcaatatagccaattttataaatatcccttctgacctctccaaaaatcttataaagatataaagataaataaataatatgttcatgtctcaagggaatttaggaataatgagtttagcacatgagtgtccgtacataataaaaaactcttagcaaactagaaatagaagaaagttattttattagttcacttacatactgctgataaagacatacctgagactgggtaatttataaagtaaaagaggtttaatggactcacaattgcacacggctgaggaggcctcacaatcatggtggagggcaaaaggcacatcttacatggcagcaagcaagagggagaattagagccaagtgaaagggatttccccttgaaaaaccatcagttcgtgtgagactttaatatggttgctagatacatgatgaatataaaaaatcaatttcatttcaacagtcccataataagtagaaaatctaatttttaagaaaaaatacaatttcagtaataacaaaatccgaaaagtacttataaataaatatagcacaaacttgcaggacctttatgtgaaaaaataaagtttagtacatttacagattgtttaactccatgtatctctacagaaggttgcctttgagagtaaataaagcaaatatcttccaagcaaacatgaactatgaatggaaaagatattaatgctcaatctttcatcattatgtccacctccaaatacatatttcatatcctaaaaatggtaaaaatgctatgtaatgggatttttttgtgtgtgaaggagggattgcttcagagaataggttaaaccaaactaagcagaatttttaaacagcttttttgagagatgatttaaataccacacaatgaatccatttataaagtgtactgttcaatggcttttagtggtgtatccacaaagttgcccataaagtccatccacaaagccatgttgcccaggcatccttcatcaaaatcaattttagaacacttttttaagcccaagaatcccccctactcccttacccaccccctcccaataccctatctttccagccttaggcagtcactaatctactttctatctatatagatttttaaattctggacatttcgtataaatggaataacacaatacgtggtcctttgtgactggcttcttccacttagcataatgttttcaaggtccttctacaccatagtatattatcagtattccaggtcttttattgctgagtaatatttcaatgtatagtagaattttataaacatttaacactttgcaaagatgtgagtcagctctaagtaaaatgatgtatccataattataaattagattgttttctaactaaaattcatattgctccactaaaaaactttttatagaaaattcagataaaatgcttacacaaagcatacaactgtgcattaatacaaatacaataagtgcacttcgaaaaaactttttatttatttttttgagacagagtcttgctcagttgcccaggctggagtgcagtggtgtgatcatggtttacttcaccctttacctctcaggctcaagtgattcccctccctcagtatcccaagtagctggaactacaggcatgcactactgcactcagctaattttttgtagagatggtggtctcgccatgttgcccaggctggtctcaaactcctgggctcaaggagtcctcccatgttggccttccaaaatgctgggattataggtataagctactgcacctgacccaaaaacaactctttcagaaaaatgtgtggcttcttgagatacaaaccctagcaaagtatcttttttaaaattattattatactttaagttctagggtacatgtgcacaacgtgcaggtttgatacataggtatacatgtgccatgttggtttgctgcacccatcaactcatcatttacattaggtatttctcctaatgctatccctccccaacccccccaactcccgacaggccctggtgtgtgatattccccacccagtgtccaagtaatctcattgttcagttcccacctgtgagtgagaacatgctgtgtttggttttctgtccttgtgatagtttgctgagaatgatgctttccagcttcatccattttcctgcaaaggacatgaactcatccttttttatggctgcatagtattccatggtgtatatgtgccacattttcttaatccagtctatcattgatggacatttgggttgtttccaagtcttttctattgtgaatagtgccgcaataaatatacgtgtgcatgtgtctttatagtagcatgatttatgatccttgtcaaatggtaattctagttctagatccttgaggaaaccccacactgtcttccacaatggttgaaataatttacactgccatcaacagtgtaaaagcattcctatttctccatatcctctccagcatctgttgtttcctgactttttaatgattgccattctaactggcatgagatggtatctcattgtggttttgatttgcatttctctgatgaccagtgatgatgagcattttttcatgggtctgttggctgcatagatgtcttcctttgagaagtgtctattcatataccttgcccactttttgatagggttgtttttttcttgtaaacttgtttgagttctttgtagattctggatattagccctttgtcagatgggtagattgcaaaaattttctcccattctgtaggttgcctgttcattctgatggttgtttcttttgccatgcagaagctctttagtttaattagatcccatttgtctgttttggcttttgttgccattgtttttggtgctttagacatgaagtccttgcccatgcctatgtcctgaatggtattgcctaggttttcttctagggttttcatggttttaggtctaccatttaagtctttaatccatcttgaattaatttttgtgtaaggtgtaaggaagggatccagtttcagctttatacatttgactagccagttttcccagcaccatttatttaatagggaatcctttccccattgcttgtttttgtcaggtttgtcaaagatcagatggttgtagatgtgtggtgttatttctgaggcctctgttcttttacattggtctttatatctgttttggtaccagtaccatgctgttttggttactgcagccttgtagtatagtttgaagtcaggtagcgtgatgcctccagctttgtgctttttgcttaggattgtcttggcaatgtgggctcttttttggttccatatgaactttaaagtagtttttcccaattctgtgaagaaagtcattggtagcttgatggggatggcattttgaatctataaattactttgggcagcaaggcgattttcaagatattgatttttcctgtccatgagcatggaatattcttccatttgtttgtgtcctgttttattttgttgagcagtggtttgtaattctccttgaagaggtccttcacatcccttgtaagttggattcctaggtattttattctctttgaagcaattgtgaatgggagttcactcatgatttggctctctgtttgtctgttaatggtgtataagaatgcttgtgatttttgcacattgattttgtatcctgagactttgctgaagttgcttatcagcttaaggagattttgggctgagatgatggggttttctaaatatacaatcatgtcatctgcaaacagggacaatttgacttcctcttttcctaattgaataccctttatttctttctcctgcctgattgccctggccagaacttccaacactatgttgaataggagtggtgagagagggcatccctgtcttgtgccagttttcaaagggaatgcttccagtttttgcccattcaatatgatattggctgtggatttgtcacaaatagctcttattattttgaaatatgttccatcagtaccttgttttttgagagtttttagcctgaagcgctgttgaattttgtcaaaggccttttctgcatctattgagataatcatgtggtttttgtctttggttctgtttatgtgatggattacgtttattgatttgtgtatattgaaccagctttgcatcccagggatgaagccaacttgatcatggtggataagctttttgatgtgctgctggatttggtttgccagtattttattgaggatttttgcatcgatgttcatcagggatattggtctaaaattctcttttttttgttgtgtctctgccaggttttgatatcaggatgatgttggcctcataaaatgagttagggaggagtccctctttttctattgattggaatagtttcagaaggaatggtaccagctcctctttgtatctctggtagaattcagctgtgaatctgtctggtcctggactttttttggttggtaggctattaattattgcctcaatttcagagcctgttattggtctattcaaagattcagcttcttcctggtttagtcttgggagggtgtattgtccaggaatttatccatttcttctagattttcaagtttatttgcgtagaggtgtttatagtattctctgatgatagcttgtatttttgtgggattggtgctgatatcccctttatcatttttttattgcatctatttgattcttctctccttgtatttgattcttctctcctttcttctttattagtttggctagcggtctaccaattttgttgatcttttcaaaaacaagcttccggattcattgattttttgaaaggttttttgtgtctctatctctttcagttctgctctgatcttagttatttcttgccttctgctagcttttgaatgtgtttgcttgcttctctagttcttttaattgtgatgttagggtgttgattttagatctttcctgctttctcttgtgggcatttagtgctataaatttccctctacacactgctttaaatgtgtcccagagattctggtacactgtgtctttgttctcattggtttcaaagaacttctttatttctgccttcactttcttatttacccagtagtcattcaggagcaagttgttcagtttccatgtagttgtgtggttttgagtgagtttcttaatcctgagttctaatttgattgcactgtggtctgacagacagtttgttgtgatttctgttcttttacatttgctgaggagggctttacttctaattatgtggtcaattttataataagtgtgatgtggtgctaagaagaatgtatattctgttgatttggggtggagagttctgtagatgtctattaggtctgcttgttgcagagctgagttcaggtcctggatatccttgttaaccttccatctcattgatctgtctgatattgacagtggggtgttatagtctcccattattattgtgtgggagtctaagtctctttgtaggtctctaaggacttgctttatgactctgggtgctgctgtattgggtgcatatctatttaggatagttaggtcttcttgttgaattgatccctttaccattatgtaatggccttctttgtctcttttgatctttgttggtttaaagtctgttttatcagagactaggattgcaacccctgccttttttttgtttttcatttgcttggtagatcttcctccatccgtttattttgagcctgtgtgtgtctttgcacgtgagatgggtgtcctgaatacaacacactgatgggtcttgactctttctccaatttgccagtctgtgtcttttaattggggcatttagcccatttacatttaatgttaatattgttatgtgtgtatttgattctgtcattatgatatttgctggttattttgcccattaattgatgcagtttcttcatagcattgatggtctttacagttttgcctgtttttgcggtggctggtaccggttgtttctttccatgtttagtgcctccttcaggagctcttgtaaggcaggcctggtggtgacaaaatctctcagcatttgcttctctgtaaaggattttatttctcattcacttttgaagcttggtttgactggatatgaaattctgggttgaaaattcttttctttaagaatgttgaatattggtccccactctcttctggcttgtagagtttctgctaagagatctgctgttagtctgatgggcttccctttgtgggtaactcaacctttctctctggctgcccttaacactttttccttcatttcaaccttggtgaatctgacaattatgtgtgttggggttgctcttcttgaggagtatctttgtggtgttctctgtatttcctgaatttgagtgttggcctgccttgctatgttggggaagttctcctggataataccctgaagagtgttttacaacttggttccattctccccatcactttctggtacaccaatcaaatgtagtttggtcttttcacatagtcccatatttcttggaagctttgtttgttcctttttgctcttttttctctaactttatcacttcatttcattaatttgatcttcagtcactgataccctttcttccacttgattgaatcggctattgaagcttgtgcatgtgtcacaaagttctcgtgccaaggttttcagctccatcaggtcatttaagttcttctctacagtgtttgttctagttagtcgttcatctaatcttttttcaaagtttttggcttccttgcgatgggttcgaacctcctcctttagctctgagaagtttgttattaccgaccttctgaagcctccttctgtcaactcgtcaaagtcattctccgtccatctttgttccattgctggcaagtacccgcgctcctttggaggagaagaggcgttctgatttttagaattttcagcttttctcctctggtttctacccatcttgttggttttatctacctttggtctttgatattggtgacctacagatggggttttggtgtagatgacctttttgttgatgttgatgctattcctttctgtttgttagttttccttctaacagtcaggtcctttagatgcaggtctgttggagtttgctagagttgcactccggacactgtttgcctgggtatcgccagcggaggctgcagaacagcaaatattgctgcctgatccttcctctggaagctttgtcccagaggggcagccgcctatatgaggtgtctgtttacccctactgggaggtgtctcccagttaggctacgtggcggtcagggacccacttgaggaggcagtctgtccgttgttggagctcaaatgctgtgctgggagaaccactgctctcttcagagctgtcagactgggacgtttaaatctgcagaagttgtctgctgccttttgttcagctatgccctgcccacagaggtggagtctagagacagtaggccttgttgagctgcagtgggctccacccagttcgagcttccctgctgctttgtttacctactcaagcctcagcaatggcggatgcccctcccccagccaggctgctgtctcacagatcatctcagactgctgcgctagcagtgagcaaggctccatgggtgtgggaggtgcacagccaggtacgggagagaatcaccttgtctgccggttgctaagaccttgggaacagcacagtatttgggcgggagtgtcctgtttttccaggtagtctgtcatggcttcccttggctaggaaagggaaatcccctgactccttgagcttccctggtgaggtgatgccctgccctgcttcggctcaccctctgtgggctgcatccactctccaaccagccccagtgagatgaaccaggtacctcagttggaaatgcagaaatcacccatcttctgcattgatcatgctaggagctgcagatcggagctgttcctattcggccatcttggaaagccctcacaaagtatctttttaaatgcagttggaggtcttttgtgcctctttttgatgaatctcaatttggaaaaacaactcttaaatgctttctgtatttttcattaaatggaagggtataggaagggtataggcccaggtgaatgaatgaaaatgctcttatactgttattttacacagaaaccagagatgatatcacaaccagttaagcttatttcacatttgttgattgtagaaaatttcacttctctcccactctcagttctggtgggctgactccatgctttatgccgttgctcttggttctaaatgtccaggctcccacttgcaatttggatttgccattacaggtgtctgctccttatgggtctggcacccttgttagcagaagccttgggagtcagcagaaggctcccaatgaataaccaagctggattaccagaggaaaaaaacatagcaaaagctggacaaaggtggtgacccagagaagaatcaggcataagagccagcccaccaaagaagcacaacaggaacaaagcagttagatgtgttctgtgtgtgcaggcgacagaagcaagcaacagaaaccagctctgcataacttgtgcagaaaataaatgtttagaaaggatgttggggacctaacagcccccttcctaacagaaggaagtggtgaacatcagtctttggaaaagacagaagcgaaggcaactgcaggcatctaagtaccaggattcagtggacagttcttcaaggacccacagctggaatgaacaacctccaaccatgctcgtattctgagccactcaattgaagattcataggccctcctctggaatcagagggagagtggaggagagagagaaataggagaacaaggaaaatgtaagctatgttgctggaagaaaagagaatgatgacagatagataaaaagaacagctatcccctaaaggaagacacagacaccaccctactgacacccagagatgacctgaacgagtacctagctgtaggctaggccaagatgtttttcaaaaattacttttggatttttttctaatacagaaagacaggacagacctaggcccgaagatctacaccagaggtcatggttcaataattttattctaaaagcaaaacgaaggaaacaaacaagcaagaccttttaaacgaatgtaacccagctgggcgtggtggctcacgcctgtaatcccagcactttgggaggtcaaggcaggtgtatcacttgaggtcaggagttcgagaccagcctggccaacatggtgaaaccccatctctactaaaaaaaatacaaaaataagctgggcatggtggcacacacctgtaatcccagttactcaggaggctgaggtgagagaatcacttgacactgggaggcagaggttgcagtgagccaagatgttgccactgcactccagcctgggcattggagtgagaccctgtctcacacaaatagcaacaacaacaataaggtaaatataaccagaagcctatagctcaggataggttagttgtaaaatataaacaaatgaggtaatatgcatggaattattgggaatacctttgaaaatgatggctttggttttttttttttttttttttttttttgagacggagtctcgctctgtcgcccaggctggagtgcagtggcgggatctcggctcactgcaagctctgcctcccggattcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccggctttggttttaaagtaattgagctacatatccctctgccaacaactagagagaaaagatggaaactcactactaatctgtttataaaactgtcatttgcatatagaggaaaacttaatttgctgtttctttctagcaggagggcttacaattagctcatcccaaagagaaaggaacaaaacacattcttgttttatcccactggaaaatatcatgctctctgttagaagcctgtcaaagcataactcagacttttagtcagagcacagctgaagcttaatcatatgtattgggagattaattatgtatagattgtgtgtctgggcaaaggcaaagcagagtgcaggatacataaaaggaaaatccattgtctggggcacatagagtctgtctgtctctgtcttttttttatttggtctgtgggcaaactgattagccaaccaacactatcaagaaggtatatgattagggaaggcagttttagttatatgagggcttccagagagtgttgtgatttcaggttggagggtatacgatgttatttgtctgctctctttccattggtgcctccaccttggttagacaaggtctgcaccattttctgattgtgtcttaagacctgtccctagaccttgactttccaggtagcactaaggtgcagattccatgtgatcatcaacagctgggacctatcttgatactctcaaagcttaggtcatcactgattttcattcctaaaattctatggggtggaaaagtataaaccagagatcatgggtaatatcattgcctcaagtctgcttagcactggaatggaagatttggcttgcaatcgatgaagaaaactcacctatactttagggacgtagaggtaagcttaaacacaggtctacatttgtggagggtaaaagaactgcccttttcactattaagtaggattttagttgtaggtttttcataggtactctgtatcatcttcagaatgttctcatttattcctagtttcctgaaagtgttttttttgtttttcctttttttttcaatgaatacatgttacatttgtcatatacttttttctagatctaatgagacaatcacatggattccctttgctaatattctgtcaggcttctttatctatgttcgtgaacaaatattgttgtaattttttttcttataatgcctctatcaaattttggttcagagttatgttggcatcataaaactagctggaatggggtgtcttcctcttttattttctgaaagagtttaggttgaagtgctattgtttcttccttaaatgtttgatagaaatcactagtgaaatgatctggattgaatttttcttggttgaaaggtttctaattacaaattcaatttatttaatagatatagaactactcagatatttatatttctttttgtattctttcaataagtcgcatttttcaggaaatttttggtaatatcatctactttttaaaatttattgacataaagtttttcataatgtcctcttaatctttttaatgtgcataggaatctatactgatgccccctttcattcctgatatttgttttgtttcttttctattaattttaagagatttattaactattccaaagtaccaacttttgtttttattgacttttttattgtttatctttcattttcattcttttttttatttttcttctatgtattttgggtttaattttttctttagctagcatcttaaaaacttaggccattcaaacatctttttccttttctaatattaatatttcaagttatacatttccttttaagtacattagatgcatgccacaaattttgatttgttttattttagctgtcatttagcttgaaatattttatttttttaaaaaaacttttgatttcaggggtacatatgccagtttgttacataggtagacttgtgtcatgggagtttgttgtacagattatttcatcacccaggtattatgtctagtacccattagttgtttttcctgatcctctccctcctcttaccctctactatccaataggccccagtgcgtgttgttcccctctatgtgtccatgtgttctcatcatttagctcccacttataaatgagaacatgaggtatttggttgtctgttcctgtgttaatttgctatggataatggccttcagctccatccatgtccctgcaaatgacatgatcttgttcttttgtgtggctacataatatcccatggtgtatctgtaacacattttctttatccagtctaccattgatggatatttaggttgattccatttctttgctattgtgaatagtgctgaaatgaacatatgcatgcttatgtttttataatagaatgatttctattcctttgggcatatattcagtaatgggactgctgggtcaaatggtgtttctgtctttaggtctttgaggaattgccacactgtcttccacgatggttgaactaatttacacttccaccaacaatgtataaggattcctttttctccacaacctcaccagcatcttttattttttgactatttaataatagccattctgaatggtgtgagatggtatctcattatgtttttgatttgcacttctctaataatcagtgatgttgagcctttttcatataattgttggccacatgtatgtcttcttttgaaaaatgtctgttcatgtcctttgcccacttcttaatggggttgtttggtttcttttcttgcaaatttgtttaagttccttatttatgctggatattagacctttgtcagatgcatagtatgcagaaatttctctgattctttaggttgtctgtttactttgttgatagtttcctttgctatgcagaagctctttaggtttaattagatcccacatgtcatttttttgcttttgttgtcttcatcataaaatctttgcctgtgcctatgtcctgaacatattgccaggttgtcttctagagtttttatagctttgggttttacatttgtctttaatccatcttgagttaatttctgtatatagtataagaaagggatcaagttttaatcttctgcatatggctggccagttatcctagcaccatttattgaatagagatttctttccttattgcttgttttgtcaggtttgttgaagaacggatagttgtaggtgtacagtcttattcttgggttctgtattctattccattggtctatgtgtctgtttttgtaccagtaccatgttgttttggttactgtagccctgtagcatagttcgaagtcaggtagtgtgatgcctacagctttgttctttttgcttatgattgccttggcatttttggttccatatgaattttaaaatagttttttttctagttctgtggagaatatcaatgatagtttaataggaataacattgaatcggtaaattgttttggacagtgtggctattttaatgatattgattcttcttatccatgagcatggaatatttttccacatgtttgcatcatctctgatttctttgagcagtgttttgtagttctccttgtagagatttttcacctttaacacagttagctgtattcctaggaattttattatttttgtggcaattgtgaatgggagtgcatttctgatttggctctcagcttgactgttgttggtgtataaaactgctagtgatttttgcacattgattttgtatcttgagattttgctgaagttgtttatcagcatcagcttcagaagctttttggctgagactatgtggttttctagctataggatcatgttgtctgcaaacagggatagttcaacttcctgtcttcctatatggatgctctttatttctttctcttgcctgattaccctgcagggacttccactactacattaaacaggaacggtgaaagagggcatccttgtcttgtgccggttttcaaggggaatgcttccagcttttgcccattcagtatgatattggctgtgggtttgtcatagatggctcttatgattttgagttgtgttccttcaatacctattttactgagagtttttaacgtggatcaatgttgaattttatcaaaagcctttctgtatctattgagataataatgcggtttttgtctttaattctgtttctgtgatgaatcacatttattaatttgcatatgttgaaccaaccttgcatcctagggataaatcctacttgattatgatggataagctttttgatgtgctgctggatttggattgccagtatcgtgttgaggatttttgcattgattttcatcaagaatattggcttaaagttttctttttttgttgttgtatctctgtcaaattttggtatcaggatgatgctggcctcatagaaagagttagggagaagtctctcctgctcattttttgggaatagttttagtagaagtggtaccagctattctttgtacatctggtagaatttggctatgaatccttctggtcctgggcttttttggttggtaggctgtttattactgcctcaatttcagagctcattattagtctgttcagggattccatttcttcccggatcagtcttaggagggtatatgtgtccaggaatttatccatttcttctacattttctagtataggtgcatagaggtgttcataatattctcttggtggtttgtatttctgtgaggtcagtgatgatatcctccttggtgtttctgattgtgtttattaaatcttttctctcttctttattagtctagctagcagtctatctattaagtttttcaaaaaaccaactcctggatttgttgatcttttgaatgctttttgtgtacgtgtgtgtgtgtctcaatctctttcagttcagctctgatttttgttatttcttgtcttctgctagatttgggattcgtttgctcttacttctctagttcttttagttgtgatattaggttgttaacttgggatctctctaaatttttgatgtgggcatttaatgctataaatttcctcttaacaatgacttagctgtgtcccagagattctggcatgttgtatctttgttcccgttagtttcagagatcttgactactgccttaatttcattatttacccaaaagtcattcaggaggaggtgattcaatttccatgtaattgtatggttttgagtaaatttcttggttttgatttcaaatttgattgctctgtagtctgagagactgttacgatttcagttgtattgcatttgctgaggagtgttttactttttatgtgactgattttagagtatgtgccacgtggcaatgagaggaatatatattctgttgtttttggttgaagagttctgtagatgtctgtcatttccatttaatcgagtgctgagtttggatcctgagtatttttgttaattttctgtcttgatgatcagtctaatattgtcagtggggtgttaatagtctcctactattattgtgtggggacctaagtctctttgtagggctctaagaacttgcttcataaatctgagtgctcttgtgttgggtgaatatatatttaaaatagttacattatcttgttgaattgaaccctttaccattatgtaatgcccttctttgtcttttttgacctttgttggtttaaagtctgttttgtcaggaactaggattgcaacccctgcttttttctgtttttcattcacttggtagatttttctccatacctttattttgagtctatgtttgtcatttcatgtgaggtgagtctcttgaagacagaataccaatgggtctttcattttgataatttcttttgacctgtgtttgagttcagtggtgtttttcttctgtactgtccagtctgctgttaatttcattcaatgaatttttggttccagatactttagctttctgttctaggatttcttttttgtttttttgttagatttcatatctttcctaagttttcttatctttttattcatcatatccatatatgcctatagattccttgacatacttaatataggtattctaaagtccttatttgctaatttcaatatctgagtcatctgtaagtctgtttcagtttactatttttttctttgtggctacaggtcacattttccttctttatatgtttagtgatttttaattatatgccgtacattaaaaataatatattgaggagacctgggatttatcttcctctgaagactgttgaactttcaggcagttaagttactggtggcctcccttaactttgtggagggttgattttgggctttgttagactgtcctaaactgatgttgctcttaggcttagggtatactttcttctaatgtgtggaccttttgggggtttaatgggaagtccaaggtgttcaacaagtccctttatataggtaattggcaagaacatatgtaattatattatgggggagtcttgccacataggctactttctattccatttaggccctaggcttggcttgtttatttgttttaatcacatatgtttttaagaaacatttataagaatatgaataaaataaatattacctgaatagaggagatcccgcatcttaaaaatcaaatatagatagtccctgactgatgatggtttgacttataattttttttactttatgatggttcaaaagcaatactctttcagtagatatcatactacaagtacacatataaccactctgtttttcactttcagtataatactcaataaattacatgagatactcaacattttgttataaaatattctttgtgttagatgattttgcccaaatgtaggctaatgtaagtattctgagcatatttgaagtaagctagcctaagctatgatgcttgagaggttaggtgtattaagtgcatttttgacttacaatattttcacttatgatgggtttattgggatggaactctgatgtaagtaaaggagcgtctgtattttctgacccaaatagaaaacttatcatgttcaaatttggtgggtgaatgcaagcccactgctctttcaattgctttatgttttatttgtaatattttcaaacatcttaagcccattatctattaaaagacactaagatacttaaattttcttctgaaaatatgtgtatatctttctggctgttaattaccaattttggtgattattgataagctatatattggtaggctaaatgccaatctaatataataattggaaaagttctgagtaggcaaaagttgcctccatacttgtttggccatggttggcatacgtatttagttttttaatcatctctttttctttttactacatattaacaaaatgtctcctcattatgttagcagaatcctgcctattatttaggcacagagttattcagctgtaacattgcagtcaactaggtgtatttctactttagcatccctatcatcattgttttaattataacatttgttcttacaaagatgttcatacatttttgacaggaacattttcccatcagacttttcttagtccatactgtctccaattatgcctggacacaagtgggcattttgcgtacctcttctccagttgtgctagtcaacacttacctatgccttgtccccctttgatgactgtttacctttaccacatttatagaaatttttcaaatgatgatggaaaactgccacattaaatggtatcctaagagctcttaaagaatgctaaatttcttaataaaatatcgaaagataccaaaaacaaaaattttcaacatcccaaattgagacaaatgacctattgttaccttctagaaggaattttcactaattatagtcaatggagttgggtagagaaaagtagtcagggtcttaaccatgctctgcttcaggaaaagagaacagcttcacattccttaaagaggtagagcaagagttcctcacttcctcacgctctgctccttcatctgtattattcaaaaaattgggcagctttatctctattcatttcaaggcatgtattctatgatcttgtattatactagaagaaaatagggaggaattattgtttgtccactgtaatcttggagtgtagctaatgagaaaagtagtccaggacgaggaaaagagagtagcgtagatggaggcaccttaatgaagatagggaacatgggatggaagagcaaatttggatgaaatatgattacttcagttttgtatatactgtgttttactgcaatcattgagacttgaggcacttcacattttatcatcgttgagacttttcatatagaatcaggtgaaattattggtaggaacttggccagttgaatagactttaaggtggaagtgatatggatttggaaaacatgtcatagttgaaaccatggatatagatgagaaaagagaaaagggcttgcataaatccccaagatgcaccaactttaaatttaggcaaaggaaaaggagcaggctgagttaaggagggacagaaagagagatggaaacaagtcaaagagagagtgatctctcagaatccaagggagaaaagtgtttcaagaaagaaggaatagatcacagtgtgaaatgcttcagattaagtaggtatgtaagttgtgtgtatgcattaagcaagtattaaataagagtaagtaagatgaatgctgggaagtgcttactgtaattgagtgttatttagtcattgattatctttggcaaaaacatttcagaggaatggtggaggtaggagagattcccatgagttgagtgcatgagagggccgaaataagggtcacaaaagtctttctagaaatttcacttttaaagtaaaataaggggcagtagctagaaggttatgcaggatcaagggaggtttttattgtttgtgagaaagacttgaatacatttatatttttgagggaaggaagcaaagagattgacaggagagagaataaacagcatgttcattctctgaacctagagaggaacaggtacatttattgacaaagagacaacttactctgtgattcacaggacccaacttagagatttttggatccttgagttctcaagtgaaattaggttggtgctagggctcatagagggctttaacgtaaagtttgacttggctatagaatttttgccataccaggttgggcgcggtggctcatgcctgtaatcccagcactttgggaggccgaggctggtggatcacctgagctcaggagttgaagaccagcctggccaacatggtgaaaccccgtctctactaaaaatacaaaactcagctaggcgcagtggcgggcacctgtaatccaagctactctggaagctgaggcaggagaatcacttgaacccaggaggcagaggttgcagtgagcagagatcgtgccactgcactccagcctgggtaacagagtgggactctgtctcaaaaaaaaaaaaaaaaagaatttttgccataccaagaatggggttgacttggtcctgcattttaagacagaggtttcttctgcctcaagcccctaacttcagcctgaaatcatcaacatccatcacagtagcggaacaacctagaaggaattgtttcattctgaaaagactttgagatgattaaaatatgcaatacaaatgggtgaaaagaaataggtgataaaatcaagacaaatgggaaattaagtttgggaatattaattaaagctgggcaaaattagtacccgataaactcatagtacactgttctgttcagctgttacagggagcctgcaaattgcctctaagcttgttagtggcctgagcaaggaggggggaaaacaattggttacaagattcagaatgtctaaatgacgaaaacaaactagtcattaaggaggccacacagcttttcttagtagtgaggcttgagagaagggttctttcatggatgttctgcatttccacaataaatacacaagcaggttttatagggattttcttacaatacccctcactgaaagtggacggcaacatgactgtccacatcactttttgtagaatgaagtgtcagcaagggccatgtaataggtactaaatacttaaaagattttgatcattttaatgggtcttattacttacactgaattgttcctcaaacaacatctgtccagtgttccactcttaattttcattttctttaaaactcctgagatgaagatgattcccatttcactttagaatggatttaaaaattgtctcaatttcaattgcctttctcattgtttaccatgctttatattcaaggtgagcgaagcaaagcacttgttactaggagataacagcgttgggtttcatttataatcgttaagattttcagatagatgctgttttggggggtgcatccttatctaggagaggtgatcaatgagcctttgctagtgcccagcagagacaaggtacagacagaggaaattaaaattctgggaagaggaaatcattgttagtcccaatgttatagtgttgttttcttttctttttttctggccggaggtaagccaaaatttaattacactcctgatggtttgggcttgataagtgtaatggatgataagtcataggtggctgaaaatcaatatgttttttcagcagataataacatgtttgctttggaatattttatctaagtgtgagatacaacgtgcaaaggctttcatattcctttgaggtgagagctctggaaaatgcaatagggcaaaggcaaactcacgtttagggcttagatatgccctggtagacccttgtctttgaataattattttagaaatcttcatgcaccaaaagctttgcctctggttactgggaacaaggtctttatgtgtctgaaactacattagctttctgcttatgctgcttctcatgagttttccagattatgtattgccaggctgtggctgtgcttcctgccgagaacaccaacttaaatgaaagtgtttttattttggagctgtaccagattagagggaaggtattctcagaaatagctgttgcagaagtgagaagagcaaagatttacaaagagacaagtggtatgagaacaagagcagtcaatgtgtagagcaagaagccatcagaagaacttggatctggttccttccctagccagatgactttgttctcttctgttccatggatatagaccttgtctttcaccaggtgggagtaaattgccacttcccttttaagaagagaacccatgtataccttagatcccaatcactgagttttgccatcgaaaactctgacttataatatgatgtttagaaagtaattgaacttctgggcttcagatgcctcttgagtatgatctagactaataatattgggtttttcttaccccaatgggagatgcagagctactcaaagcatggaattctaaagctcaaaagtcatctggcttagtctagccccaggtatgtgagctcaggggtatgagctctccatcacaattggacctgcgctaaaaaacaaaaacaaaaaaaccaaaactctcctcttctcccctagggtaaagaaacttctctggttgattattagactatcttattggtcttatgcaagtatatgctctttgttataagaaatatggttactggagctggaagtaagataatatagatagtatcctttagtttgacaagatgcttcatttattagctgtgtgacttggtaaattaccttgatcattctgaattgttcatctgtaaaatggaataataatcctacctctctagtttcatgcaaaaggagagagtttttcaactcatatgtgctaatgttactttatatttggttcacatttattctgggaactaaccacttttgatcaatgactcacatttgctttgtggtgcaccaagatatccaggtgcctctggctacatctggggctgtccagttaatttcttcccacctaggatatatatggtttggttttgattcaaatgatgcagattatgtttaaactcctttctctgaacgaagcccgggcacacaggcaggcaggcccagagatacgtacagatgggtccattttatctcatgggtggtcagagcagaacagtcacacgaggtgtatagatgagtgatgtctcacctgctcccaacacatggctgttccacagcaggtaacccaaagctcagctctgtctttggacattaactcaaagaaaggtctcaaatgtgtgttaagaattgagaatactaccctcagggcataagaggtcataaactttttctgtgccatggatctctttggcagtttggtggagcctatggactccttgaatcctataaaatgtctaggattacaatttttttaaagaaggaattatattgaaaatcattaaaatattttaaaaacaaatctgtgctattgtaaggcatgtattttttattcattaactaaatactaagccaaacagcaaatagaataactaatttaaaagctgtggtgtgcataatagttattttaacatatctacaaaaagcataatataatatgaaagtgtctgtggtttccgttggtgacaaggtcacaggtactgctaatcctcctgaggtttgttatctacaattgcaactgagagaaatgctaaaattccattcgagattaatgaaagtaaatatataattttttactatccaagttcatagattcccctggattccatcccaggtaaagatcccagagttagacaataaggaaaacagaagaaaaagtaagtataaggaaaatggaaagtcttatttttcaatgtaaagttatctgacagttaattatatttcaaacaaataacattaaatgtgttccagtttagtgattagcacagctttttacatagttttctctcaataaatatcttttgaagaaattaacaaaaacattgttttgcattgtaattctccatctacttgtctttttcttccactggtctatgagctcattgaggacacattaactgcccacacatcatttgtacagctttttaacatcctgttagataggaaagagagagctctcatgaatttctggtagaattctgttcaatagctgtaattggttatttattataagtcagagatataatgtcatttaatactcacaataagcttagaggtatacattattccaactcaacgatgcaattcaaatgttgttgagggtttatgtgtggtaagccagggcaggcattgcactaagcacaatgtcacagtggggttgtagagatgaaaaggattcctgcctgcagataacatacaatccagtagggtggaaagacatggatatgcctaattatgagacaaggtaaacaagggcaggctgggggatcagcatgacaaaagacactagggcaggatggagttttcatttttacaatgggtttttcagagaaagctgaatggataggctgaaatttgaactgcagagcgaagtattttagacttattatatgggtagttcaaaaatatcactgtttccttcaaaccacataccaattgtatatctcattccaaatcactgtacactagatgataatgattttgtaggagcctctgagaagaccattatgaattttgatgttttcagattaagtttaatcagcacccctctccccatccctaatgtaagtgttgctcaaggcattcaggtgactgggtttctcacaagaacagaagcatttaaatgccttctgttaccaacccaataatgctaacctgaagccctgctttgctgttggattcagtggttaagcatcatagtagtggttcctggtaatttttccaaatcaaaagtttaagagaattaataacatgtagtaatttgatccaactttattctcttggaccagtcaagaccaattaaggagccaccatccatgccatgcctctgtttatcctaatgagaagtgcatggattgataatgaaggctggcagcttaatgtagctcaaaacataatttgtaaactctaatgaccagaatgttagccataagaatggtataaatggaactgcttctcagaatatattctgttttggtgtttctggatcactttgcttcattcactcaaggaaaaatattgccttgtacataatgcactaggtaatcatacagttgcatcttctactgaaaatgtttctctcagaatcatctgtttatgtacatatttgggttttgcatatgtaaagtcatgggatatttgagtagaaagggcttacaggctctctcatcaaattgtcttattttacagttaagattctgaggcccagagagaaaggacttaaccaaggccatttgacgacttactactagacctgggatgggactcaggcccacacatttgttccacactgagtagtttttagggcacttgaccttttatttttttggagtaccttatgttgcacaataacatttttctctgtcaggtttccagaatcttctggcctagtgccattttgtattttgcaccaagtggagagataacgtcgttggcgaagcatcctttcctctcctttgacttcttgcctttatttctgaatatccttcttgcagtgggttgaatagtggccctccaaaaaacatacttatgtcctaatccctgaaacctgtgaacatgacattatttggaaaaagagtcttcgcagaggtaattattgtaatccccaatgttggaggtaggacctggtaggaggtgattggaccacgagggtggatttctcatgaatagtttagcaccatgtccttggtgctgttcttatgttagtgagtgagttctttcgagatctggttgtttaaaagtgtggcacctcccctccccgcttgctcctgctttcaccatgtgaagtgcctgctctttctttgccttccaccatgattgtaagtttcctgaggcctccccagaagccgagcagatgccactatgctttctgtacagcctgcagaatggtgagccaattaaacctcttttctttataaattacccaatttcaggtatttctgtataacatagcaagaatggattaatacagatcttgagatgagatcattcttgatttaatccaatgtcagatatccttataagagaagtgcagagggagatttgagacacatgagagaaggtcatgtggaaatggaggcagagattggagttctcctgctacaagccaagggacagaaaggattgctaacctccaccagaagcagggagagaaggcaggaatagattcttcctcataacctccaaaaggaccaaacctgctgacacccagatttcagacttcggctttcagcactgtagagaatacatctttgctgttttaagtcatccagtgtgtggtgattagttacagcagccctaggaatcaaatatgcttcataagccattttccttgggccacactgaggactgggcactgtagaggccacgtgtgtgagcattgaggggagctgactcatgttcgtgttcttgctcccacaatgactagagctatgatgctggtaggttagattactgctctgtgactcaggtttttcaactataaaatggggatcattattggttatgataatgtgcattaattatacatgataatgtataatatacattatatagtgtatattggttatattataactgataatgatccccattttacagttgaaaaaaatgagataatgagataatgtatatctcataataagacagtgtatattaatgcttagcatgggtcctggaacacaccaaatgtttaacaatgtgagctgatattattataatgtcgccagcctcttttgcttgcttctttgcttgtagaaaggggattcataagcatttcctagcctgatgaatggcatatgtgctgttgcttgtggtgtggcaaactctgtgtaggaaggtagtcctttctgatacatgggctctgccctcctttctatcagtgggttctcatggccccaacacacccttggccctgatgaaccctccttgagaaactctcttcctgcagcatctagggcagtggtgctcatctctggctatgcgttggaaccacctgtggagtttctaatgcgctaatgcccgggccccactctagacccctctgaatcagagtgttttcaatagaacaggctcagtgaccacagggagaagggctcagctatggttcaggtaacacacctcattggagtttctaatctgagaaactgcagggggcaggcaaggaaataggagctgtcacctagagcagaatttttctatccaaggtgaattaccaacttcaagaaaatttctaatccatcacagccaatatgttagtaaaatacaataaaaagttgactacacaaattctaccaagtacccgacaagtactcctcataaatgaattacttaaaaaacaaaatttaaaacacacacaaaataaaacctctttttgattattacattaaacagatataaatcattttgtcaaattgctgaaaagaggttaaacatatacttactatatgaactagcaattccattctaggtatttacctaagagaagtgaaaacatataagcatacaaagagttgcacatgaatgtccatggcagcttcattcttaagaatcctaaactggaaatgatcgaaatgtccatcagcaggtgagtagataagaaaactgtggcacatccgtacaataaaatgttactgaaccataaaaataaataaattactgatacacacaaaacatgaatgaatcttaaaggattatactaagtagagaaaccagatctcaaagattacagtctatatgatccatttatgtgcaattctagaagatacaaaattatagtgataaaaagcagattagtgattacctgagtctaaggggtggtcataggaatggagtgcaaagggacagaagggagtattttgtggtgatagaaatgttctgtatcttgaccatagtggaaatcccatgactgtgtatgtttatacacataccgtgtatgtcattgaactggacacttaaaatatatgaatttcattttatgcaaattataccttgaaaaagccgattttttacttgctgtaaaactttctaaatatacacagttatatgtcagagatattgtgagttcagttccagaccaccacgataaagtgactattgcaataaagcaagtcacacaagttttttttggtttcccagtgcatgtaaaatttatgtttacactatactatactaaagtagttatagtatactatactgtaactacactatactctaaagactatagtcttttaagtgtgcaatagaattctgtcatatatatatttacacacatatatataccttaatttaaaaaatactttattgctaaaaaatgtggacaattacttgaaccctcagtgaattatattttttttttggtggtagggtcttgccttgatgctgatggctactgactgatcaggatggtggttgccaaaggttggggtggctgtagcaatttcttaaaataagacaacaatgatgtttgctgcattgatggacttttcctttcatgaaagatttctctgtagcatgcaatgctgttcgatagtattttacacatagtaatttttttttcaaaattggtgtccatcttctcaaaccctgccttgtaaactaagtttatgtaatattctaaatcctttctgtgatttcaacaatgctcacagcatcttcaccaggagtagattccaaggaaccattttctttgcttatttgtaagaagcaactctctgtccattcaagtttgataatgagattgcagcaatttagttacatcttcagacttcacttctaatttgagttctcttgctatttcaaccacatctgcagttacttcctccactaaagtcttgaacttctcaaagtcatttacgagggttggaatcaacctcttccaaactcccattaacgttgatatcatgaatgttcttaatggcatctagaatgggtaatcctttccagaaggttttcaatttactttgaccagattaatcaaaggaatcattatctgtgacagttatagccttataaaacgtatttcttaaacaataagacttgaaagttgaaattactccttgatccatgggctgcagaatgcacattgtgttagcaggcatgaaaacaacatcaatctccttgtacatctccatcaaagtcttgggtgaccaggtgcattgtcaaggaacagtaatattttgacaggtgtcttcattctgagcagtagatcttaaaaatgggcttaaaatattcagtaaaccatgctgtaaacagcagatgtgctgccatccaggctttgttgttccatttatttatttatttatttattttatttttttacttttattttttagagcattaacctttgcaatttattttttttattatactttaagttttagggtacatgtacacaacatgcaggtttgttacatatgtatacatgtgccatgttggtgtgctgcacccactaactcctcatttaacattaggtatatctcctagtgctatccctcccccctccctccaccccacaacaggccccggtgtgtgatgttccccttcctgtgtccatgtgttctcattgttcaattcccacctatgagtgagaatatgcagtgtttggttttttgtccttgtgatagtttgctgagaatgatagtttccagcttcatccatgtccctacaaaggacatgaactcatcattttttatggctgcatagtattccatggtgtatatgtgccacattttcttaatccagtatatcattgttggtcatttaggctggttccaagtctttgctattgtgaatagtgccgatagaacacaggcagagtagattcgcataattcttaagagctctaggatttgggggatagtcaatgagcattagcctcaatttaaagtcaccagctatattagcccccaaaaagagagtcagcctgtcctttgaaatgttgaagtcatgcattgacttctcctctctagctgtgaaagtgctagataacctcttcttctaatagaaggctgttttgtccttatagtgaaaatctgttgtttagtgaagccaccttcattccttatcttagttagatcttctggattatttgctgaagcttctacaagagcacttgctactttgtcttgcacttttatgttatgcagagagcttctttcctcaaacctcatgaacgaacctctgctggcttccaacctttttcctgcagcttcctcacctttctcggccttcatagaattgaagacagttagagccttgatctggattaggctttggctaaagggaatgttgtggctggtttgaccactaaatctttcttgatatcagcaataagactgcttcactttcttattcatgcattcactggagtagcacttttaatttccttcaagagcgtttcctttgcattcacaacttggctaactgtttggcacaagaggcctagttttcagcctgtcttggctttcaacatgcctttctcactaagcttagttatttctagcttttgattcaaaatgagggatgttgtgactcttcctttcacttgaacacctagagaccattgtagggttattagttggcctgttttcaaaactgctgtgtctcaggaaatagagaggcttaaggagagggagagagacaaaggaatggttgatcagtggagcaatcagacaacacacagcattcattaagttcaccatcttacatgtgagtggtttgtagcaccccgaaacaattacgatggtaacatcaaagatcacggatcacagatcaccataacagatatgataatgatgaaaaagttgaaatattgcaagaatgaccaaaatgcgacatagagacacgaagtgtgcacaagctcttggaagaatggtgctgatagatttattcatcacagggttgctgcaaactttcaatttgtaaaaaatgtaatatttgggaagcacaatacaataaggtatgcctgtgttcttgatttctgtatgtatcttgttgcaaatgaacaataaatcatttgtaaacccatactggtctgtgaaccaaactttgagaagcattgaactagatgatggagcgcccatagggtggcattcagagccttgctctatcttgagtgtcttaggaggttattgtcaaggactttagtgcaagggccagcactgcagcctgatccctcagaatagccctgcaaagggtttgaaattgctgctcaggcccatatttggaaacaccaggttggatgtctgcttggctgcaaatacaatccaagaacagacatttaagccccacttgagttacgatgaggccatcagacctccagttttaagaagatatttaattttgacctccctgaaaaggggcagagagattaagcttgcagtatgagtagggatatactttatggaaagtagatgctaacaaataattataggttgaatgaaaggcaaataaatgcttgcttctaaaaagtacataatggtccaattcatcagcctgccaagaaattaggccctgtagagaagataatagaaggttgaaactctcaaaggagaggcaaattccgttgtaatctttttgatgccaaatgtatttttctgcaataatcgattatgtgagtttgagactccagttgttatcgtcatctgggaaagatcctgcagttcttccatacttcgccaccatcagtcagtaggaggattactgttttttcttcagggtggaggtaggctctgaaggatcacattcccataagagggctagtggtaataagaagaactaagcgagttcagtggttgactctgggtcttttaataacttctgatcttcaattttttcatctgtaaaatggaacaataccttcttttttcttttctttttttttttttttttttttagatggagtctggctctgtcacccaggctggagtgcaatggtgccatctcagctcactgcaacctccgcctgctgggttcaagcgattctcctgcctcagcctcctgagtagatgggattacaggcgcccaccatgcccagctaatttttgtatttctggtagagactgggtttcaccaagttgatcaggctggtctcaaactcctgacctcaggtgatccacccgcctcggccacccaaagtgctgggattacaggcgtgagccactgctcctggccaaaaacaataccttctttaaagccttgtagagatcccaacgtgagatgggtgtgatatatatttttaggagaacacaataaatagcactccattacttgcctgagttctgaacacattgagaaataggacaaaagaatcaatagatggaaaatgaaagtatcatcttcatggttaataaaggctaagatgagctcagtgtgagactcacatgaggctgtaaatcccagcctggggaggacctacctttccagtctcaggccacattggaccctgctgtggggacagagcctgtctctggaggagctgggtaaacttcacgttctctatgatctggccaacttccgagaggaagaggcaggattatgcatgttaaatttatgtcaccaagttcaccacccaactgaatgactcccaggggaggagtaagctagaagtggaatgaggccaggaatgtcatggagatagagagtcttccatacagaaagagacatcaagaatggggaagagttttttttttttttcctcttaaacaatcaggactaacccctaaacctgtgcttatccatggagtggttttccccctgccggaggggatcagtgggtcagcagggctgtcccattcccatcctcaggaggctgttccccataccagccactgctcaccagcacagcatcttgccttggtttatatacaagataatgcttgtagtttagttcacaatctagaaatatgtacttttaaaatttctaatagttggtatagatcttgaaagaaatcagctgtaggtaaatatatcttgataattatgaagttagaggaataaatctttttctttttaggatattggctaaaaagggaggttgagaattctctctttttctgtctctctccgtctctttcttgccttcctccaaaggcccatctgttctctgctccaaatttatgtctctcaatcccaaaaaatatagttggctttaaaactctttataattttgaaatggtcttctattttcctatagttgttatagcttaatactatgcaatcaggaagattgcctaatgctcataatttgtaatagatatgcaattgtaattgatcttggatacacatttatgatttttccctcttcaaactgaattcaaagataacattaacctagggtacatggagacctgggattaaatgttttgaagaactaagtatagctgaattagtatagcttacaagtatgtaaattataaagactctctccctttatgtgcacccagtacccttgggaactggttattaagttcggatcacatcctatacctttaaagatgaaacaagatctcaattttacatgttttttgttctgtgacagcaattctgcttgtctgtgatatgtctcctaacttcagcatatgcacactggccacttctcagcatgaggaatggatgtatatgtttcagaacaaaagctgtaaaaatggatttttagtgccctgtaaagaagcctggaaaatcttgaaagaaacagaaggggggaagttgaaggggcagtggaagaatttgctattggcactaaatcagaggaggctaaaacataatcgcagtataagatttgcaaatgttctctttcaaaagtgcttcgatctctgagaggtaccaatgttgcattactttgaattttacacacacacacacacacacacacacacacatgcacacacagcttcatatatcctgcagtgaactgtaatctgtcagcacaatagctgggatggagtgagaatcagtatctgatttaacagtaaagtagaaaatttccttcctgtctttttctttcctctttgaatattctacctatgtttatttacaacatagcctcttggatctttgagagatagaggggaccttacttagaaagacagtctaatttcccagcaaatttaagaatgctctttctagcatttcaaattgtgatcttcctacctgtatttgaacaggtaggaaagggatgctcccaaatgctaaggacaatggtgttctttgtagatgctgctaacaattagaaaactcttatatcaaatttgacctttctctccccataatttctagtctatggtcttcattcagtcttttggaagttaggaaccaaaaagactaaatttagtttcccccaacccctccttctcacaagactcttcgatgttggaagtaacctctcatattatggtaagcctgcccccacaccacccatgcttatattcaaatactgcccatagcgggaagtggcatttctaggggagaattaacatcttaatatcaattttccaatccagaaagacgatatatatatatatatatatatatatatatatatacacacacacacacatatatatatatatatatatacacacacacatatatatatatacacatatatatatatacacatatatatatatacatatatatctccatctcagtattcattagtttgcttcagtaatgcttttaatcattttaatgtgcaggtttgatataatttagttaaatttatctctaagtatttaaatttttttaaatttttaaaaaatttttaaattgagatataattcacacatgataaaatttatccctgtaaagtatgtaagtcaatggtttttactatattcataaagttgtgcaaaaatcaccatttcatagttttaaaattttattgtaaatttcaatttccaattatttacatatagtatcatagttggtactacctagatatacaattgagttttgcattttgactttgtatcttgagaccttgctaaactcattaattagttctaataaggtttgggttttttttacattccataggattttctatacaatcatgtcatcattgaaaaatatagtcttaattattcttttcttatatctatcttttacttctttactttgtattattattaaacttccattaaaatggtgaatggcagtggtgagagcaagcatatttgcctcattcctgatcttaggagaaagcatttagtttttcaccattaggtatcatgtagctataggttttttatacatgccctttatgaaattgtagtttccttcaactcttagtttgctgagagttattttaataaatggatatttaattttgtcaaatggtttttctgcacctgttggtattactatatggttttccttttaaaatatgttaatatggtgaattacattagtaaattaatttgaaaatgttaaatgaaccttgcctttggggatgaacctcccttggtcatgatgtattatactttttctatattggtttatttgatttttaaaaaaatttaaaagttttgcatctatgtgcacaaggaatattgatctgtgatttctttcccttccccccacctccatctctcttttctctccttcctttccttcctttctttttcttctttcttttgctaaccatttaatggtggccttataaaataaacttgaaagtgttccctttctttctgttttctggaagatttgtgtagaattggcattgcactcctgtaaatgcttagtagaaattacctagagaaacatttggggcttgatatttctttgtgagaatgtttccaatgctgaactcaatttatttaatagatataggcctataggttatttatttatttatttcttgagtgagttttggtggtttatatctttaaaaaattgccaatttaatctttgtcaaatttgttgtcacaaagttttcttgcaattctctcattattctgtctgtaggatctctgagcagttttctttctttcactgctaatattggtaatttgtctgctcttttctgatcagtctacctagtgttttatcaattttgctgactttttcaaagaactgtaattgatttgctttattttttcttggttttttatttttccaatttctgatcttatctttattacttcctttcttccacttacattagatttaacttactttttaattctggtcccgtaaggtggaagattagataattgattttaaacttatcttctctaatattgatattctacactataaattctctctagtcgttagtttagctgcctctcataattgtaacacactgtgttatcattttcattcagttttaaatattttccaaattcctttgtgattattttttgattcatgcattatttagaaatatgttgtttaatttttaaatatttgggactttttcagatattcttctaacattgatttctagttcaattccattgtggtaaaatttcagtccttaaacttattgatacttgttttatggtctagactatagtgtcttcgtaaatgtttcatgtatacttgaaatgaatatacattctacattctgccagttctgagtagtgtgttctttaccacaacaggtttcctttattcattccacatcacttataccaccatatgatatgatattatagatttatttctttacttggcttgttttctgctcccccaatctcccccttccccaccgtacaattggaatgtatactctgtgagggcaggagcttgactgttttgtttactccagtattctcagttcctgaatgattaaataaatgagtggatgaattcatgaacttttctcaaaacatcaagaaagtgtatatactagaagttatgtacaggctagaccatagggctcagatgagtactttaaaactttccctctttggttagaataaaaaatgtgaaaacttacatcatgtacatatttacctaaaaaatcagccattaagaaaaataatttgtatgtgtcacacacaattacttcttaaattcagaattcaagaaaatactaacccacttcatttgtcaaaatttatttatagaattaagaggggaaatataaacaacaaccactataaaatgtaatgtaaaatgatctcatttacattagcaacattaaagaaaatctagtgatacacttaacaaaaatgtttaagatctacatgaagaaatcttcaaaacactattaagagatagaaaagtttaaataaatgcttatttcttggaaaggaatactcaatattatcagctgtctattcatattatattaatctacaaagttaaaataatgccaaaataaatactaaaggtttctctggtgtatcaggaaaaagaaatctgccagagtagaaaggaagattctgaaaaagaagaccaagagtcagtggtaactggccctccatgtgttcaagtttataactgctgtaattcaaactctgtagtacagaatcagacttagacaatgaaaaagtcaatgaaaaagaaagggagtccagaaatacacccaaatacttataggaacttatgctatcccaaagacaccatttcattttagtgaagaaatgatgacttaattaatgcatggtattaggacaagtgagatgtcacctggaaaaaaaagtattttaaaaagttggattcctactttactccttataccacaataaattccagccagatcaaatatttaaatgtaaaaaataaagccataaatttcaagacaaaaataactgaataattttttataatcttggagactttggaaacatgacacaaaattgaaatgctattaaaaagaataacacttgactattaaaatgttttaaattgtcttataaaatgccataagcaaagtcaaaagcgacttaggctatagtgaatagtagctgcaaaaaacatgggaatgaagatgtcccttctataactgatttcgtttcttttggatgtattcccagcggtgggattgctgggtcatgtggcagttctatttttagttttttgagaaacctccatactgttttctatggtggctgtactactttacattcccaccaccatataagcatgctcctttctctgcatcctcatcagcattgtcattttttgtctttttgataatagtcattttaactgtggtgagagggtatcttactacggttttgatttgcgtttccctgatgattagtgttgttgaacatttttcatacacctgttggccatttgtatgtcttcttttgagtaatgtctattcaggttttcccacatgtccgtcaatgaatgaatgagtaaagaaaatgtgttatatggacgcaatggaatgttattccatataaaaaagaatgaaatactgtaattttcaacaacatgcatagaactggaggtcattatttaaagtgaaataagccaggcacagaaagacaaatattgcaagttctcactcatatgtgggagctaaaaccgtagatctcatggaggtagagagtagaacagtggttaccagaggttgacaagggtgggggtgatgaagagaggttggttaaggggtacaaacatacagttagaaggaataagttctagtgtttgataaaacactagggagactatagttcaccataatttattgtatatttccaaataactggaagagaagaattggaatgtttccaatacaaagatcggataaatatttgaagtagtagactcccagttatcctgatttgatcattacacattgcataaatgtatcaaaatatcaaatgtacccccaaaatatgtacaactatcacatatacatagaaaagtcactttgaaaaaaactgtgaatatttttgacaaagaaaggctaacatcattgatgtcatcaagagcactcatgtttcagcaagaaaaaaaagcccagtagccaaattttaaaagtgggcaaaggacacaatcagttcattgaaatggaaataaaaatagctttaaaacatattgaaaaatattcagaacttctcatagtaagagaaatgtgaattaaagttgcaacaagatgccatcttctgtctatcagattgacaaagattaaaaaatttagtagcatatgttttcagcaagggtgcgaggagacagaaactcatatgttttgggtcagaatgtaaattggagagcaatttggcaatatctatcagaattttaaagtttatagcttttgacctggttatttcgcttctagtcattgatcactcagtggtgttggtacacatatacaaagacatgtatctacaaggatatcagcattgcctgtccttacaaaattggaaaggacctaatatccaatgtggtgttccacctgcatccccttccctgggccagtgcatctgtctcccgccactgtgagtgttggctgctgacggctcacagctcacccttccccagagaattaccctcaactgaccaggaacttcctcacctggaagtagctgggaggttatccagacgaccatttctttgtatattggcaatatacaaagccaatatctattgtatattgtggtacaaaaactcaaaatgttttcctgctgccatgcatgctccagtgctccccatgggatcaggtttgacttgactaaaacctcatctttccttagcttcttccccagcctaacttttctctctggtttctatataagattctcttgaaagcacttctcgataaatcgctggcatgagagtctcccccttaggttgtgcttctagagaatctcacctaagacattcatcaacagggtactggttaaataaatgacagtattccatataatggagtaccacctagacattaagaagagagaagcaactattctctatatactgacatggaagtctcaaaatagagtgaaaaaagcaagttatagattaatatgaataatatattaccatttatgttaaaatggcaatttacaaatatagttgaatattcatagaatatctctttgtatagaatatctctgcataacagtgtttgcttgttgcagaggggaggccaattggggtctatgaaattagaaggaagaagatagagtgaattttgcactatatactttttctaccttttaaatattctactatgtaaataaattatctgttatattatttcaacagtggtaaaaaagcattagtattttcaaatagcttcagtgttttgaaacaaagcattagtagtatcaaatatcttcagtttaggataatatcatttatcagaaatatttcttctgcccttaggaataaattacatttaaaaaaattagcatgtcagtactctaaatgaaaaagtatgtttttgaagtccctagagggtgcaaaaaaactatctcattatctatatcttaagaattatctctgcaattctgttaattttcttagtaaacacttcccttatagataatggcattgcaacttccagctggccctttttaaatgatcacaaattgccatgtatctccatttaaatgaattgtgctttttgttaacctgagtttaattaccattcattttaccgcattaattatgatagatttcctgcctccttcatacctgtggccacatagacattgcaccattattagtgcttttggcatctggttacaaattatacacacacatctgctgtgaattgtggattacattaagaatcaaacatactggatttagggcttcaacacagaaagtgatgtcaatgcacagtcctgaaacatgagaccacacattgtctctgcctcatagaacagaggtcatgactatacaaaaaacctttttgcagctgagacatggttgaatatatttcatacatctctcactgtccatttcatgagaccagggtatataacagcccccagtggccttacccttcacctgcatgtgtgctacattttttttttttttttttttttgagacggagtttcgcttttgtcacccagcctggagtgcaatggcgtgatctcagcttgcagcaacctccgcctctcgggttcaagcgattcttgtgcctcagcctcctgagtagctgggattataggcgcatgccaccacgcctggctaatattttgtatttttagtagagacagagtttcggcatattggccaggctggtcttgaacccctgacctcaagtgatctgccagcctcggtctctcaaagtattgggattataggcgtgagccaccacacccagccgggttgctaatctttgaggcaggcaacacacatccaaaatgctttaccctaccatctcccctccctgcctctcactcccgccacattggtatatccattcagagacggcacaggaaatgcagagtgggaaggctggtacgaatgctattgtggcagtggtggtcatttatttgttcacgtgttctttcattcaataagcatttaatgattcctgtgatgtgccgggcactgtgctaaaggaaaggacaagccatagtgaatatagtatctagccttgaggggtagagacttacttttgagagtcagagagtaagtaaatgtcttttcaatgtacaaaaaggagagggggaaaaactgtgaaatttaatgctatatgcatgtataattatataagtaatttgactacataacatttcaaaattctgtgcacaagaaatagaagaaataaagttgaaaggctaaagatgacaacttgattgcagcacataggacatttttatgggcaagtcgtgcttaaaaataacagaacgacaaatgggcaaaaagaaaaatgggcaaagacacaaacagatgattcacaaagaatgatcacattaaatcaaacacaagataccattttcacccactgaactggcaaaatgttgtaactgtattaccttatgaagcaagaatgtagttgaaaagattcaacacagctgttagtagaattggtacctcttttctgatgcctgtctggtggacaatcaggcagtataaatcaaaagcttgaaactagttcttgccattggagtcataattccacttttcagaattttatattgagggaataatcagagatgtaaataaagatttttgtacaaggatgtttattgtagcattatttataattaggaaaaattgcaagcaatctattccaaaattagatgattaaatttgctgacaaaattataggccagaacattattccaccattaaaatccatattttcagagtaaaaatatgagaaagcacttaaagtatattattaagtgaagaaagcatgacaacacagtaagaacccaaatggacagacagagaagaggaagccaaaatattaagattgattattcagaggtgattgaataagaagtgatttttatttccattttttttcccctgtattttccaatatcaactgtcagcagccattacctttatttattttttttttttttgagatggagtctcactctgtcgcccaggctggagtgcagtgggcatgatctcggctcactgcaacctccgcctcccgggttcaagcaattcttctgcctcagcctactgagtagctgggactacaggcatgtgccgccacacccggctaatttttgtatttttagtagagacagagtttcaccatgttggccaggatgatcttgatctcctgacctcgtaatctgcccacctcagcctcccagattgctgagattacaggcttgagccactgtgcctggcctactcttataatacattaaaatattgtaccaaatgggaaggaagagatataaataccaccaaattcattctgcacttgatgtggtttggctgtgtccccacccaaatctcatcttgaattgtagctcccataatccccacgtgtcatgggagggacgtggtggaaggtaattgaatcatgggggtgggtttttcctgtgctgctctcctgatactgaacaagtttcacaagatctgatggttttataaagggtagttcccctccacatactctcttgcctgctatcatgtaagacgtgactttgctcctccttcgccttccgccatgattttgaggcctccccagtcatgtggaactgtgagtccgttaaacatctttcctttataaattacccagtcttgagtatgtctttgttagctgcatgagaacagactaatacagcactcaatccaatattttaaatgattttttgctcaaactctttaatgatttcttatgtccttctgaatacaactgccccatgacatctcaaaattcctctcggatagattgcttgttcacaattacactttgttgtctcactggaaagcttgggctctttctaaaaacttactctaaaaagctcttggcatcctccccaaatatttatttgaaaatttttgctgggctgtgtctgtctcacctggagctctttggatgcttcatatccttttaatccaggaaagcagatgtattatttctctgttttctttttcaccactctcttatgttttcaaagtgttcattttaacaccaaataaaattagcctttcactggaaggtcaaacatgagtgtagctggcaaaaatgtactatgtcaataatatgactggaatcgtaacaataacaaagtatgggatattgcatatgataggcatggaaataaaagctgaaatgcaacattttgtagttggaaaagggaatattttaaagaatattttgtattaagtattaaattttaagagataatgtaaggttggggtatatatattatggatacagacaacaaaacaatctacaagataccacggttagaaaataaatccttgggcatgccaaggtaatttatagattcaatgccatccccatcaaactaccaatgactttcttcacagaattggaaaaaactactttaaagttcatatggaaccaaaaaagagcccacattgccaagtcaatcctaagccaaaagaacaaagctggaggcatcacactacctgacttcaaactatactacaaggctatagtaaccaaaacagcatggtactgataccaaaacagagatatagaccaatggaacagaacagagccctcagaaataataccacacatctgcaaccatttgatctttgacaaacctgacaaaaacaagaaatggggaaaggattacctatttaataaatgatgctgggaaaactggctagccatatgtagaaagctgaaactggatcccttccttacaccttatacaaaaattaattcaagatggattgaagacttaaatggtagacctaaaaccataaaaatcctagaagaaaacctaggcaataccattcagcacataggcatgggcaaggacttcatgtctaaaacaccaaaagcaatggcaacaaaagccaaaattgacaaatgggatctaattaaactaaagagcttctgcacggcaaaagaaactaccatcagagtgaacagtcaacctacagaatgggagaaaatttttgcaatctactcatctgacaaagggctaatatccagaatctacaatgaactcaaacaaatttacaagaaaaaaacaaccccatcaaaaagtgggcaaaggatatgaacagacacttctcaaaagaagacatttatgcagccaaaagacacacgaaaaaatgctcatcatcactggccatcagagaaatgcaaatcaaaaccacaatgagctaccatctcacaccagttagaatggcaatcattaaaaagtcaggaaacaacaggtgctggagaggatgtggagaaataggaacatttttacagtgttggtgggactgtaaactagttcaaccattgtgaaagtcagtgtggcgattcctcagggatctagaactagaaataccatttgacccagccatcccattactgggtatatacccaaaggattataaatcatgctgctataaagacatatgcacacgtatgttttattgtggcactattcacaatagcaaagacttggaaccaacccaaatgtccaacaatgatatactggattaagaaaatgtggcacatatacaccatggaatactatgctgccataaaaaaggatgagttcgtgtcctttgtagggacatggatgaagctggaagccatcattctcagcaaactattgcaaggacaaaaaaccaaacaccacatgttctcactcataggtgggaattgaacaatgagaacacatggacacaggaaggggaacatcacacaccggggcctgttgtgggggtgggggtaggggggagggatagcattaggagatatacctaatgttaaatgaggagttaatgggtgcagcacaccaacatagcacatgtatacatatgtaactaacatgtacctgcatgttgtgcacatgtgccctaaaacttaaggtataataataaaaaaaaaaaaagaaaataaatccttgggcatgatgatgtaacttttgttttttactttttcttttctttcttttttttttttgagacagagtctcacttggtcgcctaggctggagtgcagtgctgtgatcttggttcacggcaacctccgcttcccaggttcaagcgattttcctgccttagcctcccatgtagctgggagtacaggcacatgccaacaggcccagataatttttgtatttttagtagagatggggtttcaccaagttggccaggttgatcttgaactcctgacctcaagtgatctgcccgcctcggcctctcaaagtgctggaattataggcgtgagccactgtgcctggcctattttttaccatttctaaaagacatttcccatttggttgaattcagaaattcaaatatacatatatataacttggagttgtcttttgcaatattgctgatattcaggtcagtattcccagtaaaatgtattcagcatgatataacttaacataaaaatattttccaggctttatctgaagtgtgtagtttcagtttggtatgtatttctgttgtgactaaagagaaggatttttcttactatctaagttttctatatataagatcctagagtggttctcattcattcaaaatatatttattgcatacccagtatgtttctggcaatatgtttttatgataattctattatgtcctgaaaatgtcttacagtggtattttataatggcaaaatttttggcaagtttcacaagtatgtacttttttcaaaatagcttctttattcaatgccaaaaaaatagaaattggacaaatcatcttgtcaactttaatgactaatttggaatcaccgagaataactgcttatttatgaaaatcagaaataaacccattctctaaaagacagggggatggtgttagtgtgaaagatcctgcagtgtgattgtgtttcatgaacatatataaactttagatatatcagtttaatatttgttaatgatgggcaggtactgaggtaaaaaaattaacctacttgagaatatgttaactaatctacagaggacattagtttatgcagtccttggatataagaaaatttgtattattttatttcctgaaactatgttagactgaaggtcatacaaaaattaagaggtctttcatagtccagacccctggagaaggatccacttgccttcagtccacactggtcacttttgaaaggctccttggccaggttcttgtatcttggacctcactctgtgagccttgcagttttaggacagtggtgaggggacatctctgagagaatagatagatgagttcctggcactgggagcttgagatggagtatagagcagaaaaagcaggtactcaggggctgaaagaaagaacagaagatgcccttcttcaggccggatatttaccagctgggcaggtgggttggtgctcagagaagttctcaactatgaccatgaagtcagcagattcatacttcttccaaatttcccccctttttagcctgtaaagccacagctaagccagtgctggttctgaattacttccctatgcacgatgtgtaaatgattgaaatcagatgagccatagactgtaaattcacttgtataaatgtgtgaattattgacatggatccaattaaatggggaatggtagcaagaagtagtccttggtccttcattgtagggagaaaaagttttagagggaggatactgcagaatggagtttctgatggaaaatgtttccaccctcacagattttaaataactcttctttagggaggtcagtgaggctacagggagccagagggtggcccctgctgactgtttcaaggctgtccttcccctcttctcaggcctttcacctgttggtgtcatttcacatgcgtgataatcttcaaacccagctctgccaccatctaccttccccattgctgcccttctgccccaaaggatttgagaacaacataaaacaataaatactcagctccccatgagctgccattcacttcaacttggctctcaccagtgcttgacacatcttctctccatttctccctggcaggtctccaaaagggctgctttaaaccattcctctctccttagcccccagtcccacatgctgagagtcaagagaacatgtgtgagaacgtaggtgtgggcatcagatggaactcagcactcaccagctgcaggaccttggttgcatttcctaactacatctggaaaagaaagatgatcataactagaacttaacctttgaaggttttatgagcatgaaaagatgtctggaaagaacttagcccaccaggacagggctccgtgaatgtcatctgtgactgtgggtacccttccttcaaatgagtgaacaataccctcctcattgacttggaaaacaagtgcccctagcatgctccttcaactacttgatattaatttccacatataactcactctttccacttaatcgccttttccaaaatgtacctccacccctgtgttactggatgccattgtttgtgcctcaggctccttgttgttgtcattatcccaccttctctgggactttccttggcctttaggaaaactttatactttgaaacaagtgggctgaaattctgtcttctcttggatgacctggcaccatcgctactatgtgtcacttgtgtcccccacttcttcctgtgtcatctcctgtggttcagttcttagtgtttcagtctttgcttttgacccattcactccaagggcttccagaggatgttgaatgggacaaaatattgctatgtgacccacatttgagaagatccaatgacagttggatccaggcacctccctatgacttaccactgggaggcagaactacccagttaaggaaggtggtatttgtccttttccaaagatagcatagtggttaagtgcacagatatttggagtcagactacttgggtttgaatccagcctctgccacttactaactgtatgcttttagttgagtcacttaacctagttgaattatttaacttctctgtgcctctggtttctcatttgttaaatagagataataaaagtttcttactccataggtcaattgaattaactgaatccactattaagaacagcaattatgtcactataattccccaatccttctgccctgccccaagtcccactaagggaggagagaagaaaagaaggaatgaaccatgcttgcctctaacttcaagtctccccagcaagggatcaaaatcgtgtagaagggaaggggaggggaagaggtgagatttcaatcacatttgagatagaaacatttaactggtttgaaattttaataccttttcaaaaaacatgcctggaaagctatgagatatgttcaagatgtaattatgaactaaaaaggctgtattgcagttttttagaaaaataaaaatgatttcatttaaattcaccaacttgattcctcagtaatactcataataatgatgatgatggtagctagctgaattcaggattatttttttgatattcactaccatggcaaactgtcaaacttaaaaaatcatttataactcatatccactacaatggatattatgaaagatacaaataataacaagtattggtaaggatgtagagaaacccaaatactcatacattactggtggggatataaagtggtgcagccactttggaaaaaagtttgactctttcacaaaatgctaaacatagagttacaatatgagctgggaattctactacctagatatatttccaggagaaatgcaaacatacgttcacacaaaaacttgtccacaaatgttcatagcagcattatccataattgccaaaaaagtagaaacaacacaaatgtctgtcaatggaaaaatagataaagaaaatttggtatgtccataaataaaatattgttttgccatgaaaagaatgacatatttatacatgctacaacctggatgcaccttaacaaacacgctaaatgaaagaagcaagtcacaaaacctatatactgtgtgatcccatttattttaaatgtccagaataagtaaatctagagaggcagaagttagattagtggtttcctagagctgagtgtgggctggggtgggaagtgactactaagggtattttgggtgataaaaatattctaaatttagattatggtggtggttgcacaattattttaatatgctaaaaaccattgactagtacactaagtgagtgagctttatagagtatgtaaaatttatatctcagtaagttattaagaatcagcttattattctccaagttttgaaaacagagtcacagtttccctgaccttgggctttaatctttacaataaataaccttagcctcctctctctgcatggcctctctttccacttggtgatggcagtggacatgtgtcatttttctggctgccagcatttgaatccatttccaagtttagagaactgcccccctaccaccaccatttatgagtcttggtggagtgcatcagccgcctcccattataaaatggaaaacgctggtacctgcttgctaaagtttagaggcccccaccctgccccagctttgaagtcaggcacttcaaatacaaagatacacttcagatacaaagaagtgaggacagtgggaaatccattctgatggcaggtgagcagtgacaacagccaacttggtttccagggacagcgtccgtgtccagtgccaggtagtgcaaggcatggccacactgtgctcagcaggagtgatctcaccacattgacttttggcttgattttgcctgtgactaaatgctacttagtcttctggtcctgcctgtttccaagcctgtttctttaactttcccactaattgtgtgagtttattaatagccttccgatcagttcctttccttccatgctcagtttctctgcttgctcctaagaatcctgtttgatacagtcagcaaggaaggataattttcaccccagtctccaggatctttctttagattctgtaagcatttacttatttagtgactactttgtgccatccaataaatgatctcataatcgcatagtggcaccgataccaatagctcccatttcacagatgaggaaacaggctcattgaaatgaatagcttgtagattcaaacccaggccaagcccagtgcctttcccataagatcttcatggccccttctccattttcactgacaccacatctcgctcattatttacagaacaaaaggtcccactcctctccctccctccactatctttcttctttaaatcgctgtgggcatcattgtcatatttcatcataagagtattgttgattcctttgtacaacagctgatgatgactccctactgtttaggtgatcagacctcaggaaggtatttcctgatcacatccaatgcctcctttgtctctggccacatcttttactaattctaaacaagcccatcacatgctacaagagtaagtcctgttttctcttagtctggctcaacttactatagacagcaggacctcaatcaatacccttaatctggaggctgactaaagacaaaatattgaattcactcttcatattttcatcataaaccccaaattctatgacaatgatgattttggaaacaataaattaagcatcaagcatcatatggcaaaatctattggaatgtaatatttttggcaggaaatcatttcagagtggaaaatgtttgctaaatataaacactgcaaagccatgtgcaccgccaagactttattattagattctcagggatttttatttagaagctgaggaacttgcgaggctgtacaattcctggaatggaatttaggtttgctttctgaaatcaatccaggcaagcctttttgcacatgagcattcttagaaagtctttgaatgtctattcttactcacttctatgggtggcacaaaatccaaaaataaaattaccatgaggttctgcttgcttcctgctttagcgacactggaaatcctccagggatagctcatgtactttgtaagttctcctttgcctctctcattgccagcattgggtagttgaaacctagactcaggacaagatctgggatggtgtgaacgtcaggaaggctgtgcaggagaattcagaggactgggccacaactgctaagggtagacctggaatgcaagggcaattcacagagggttggtcagcagggatggggccagctatagtggtacttgagcctgtcaaggggctgagcagagaggcctggcctgactcctaccttgcactactcttctctcaaatgggaatactgggggaatccaaacagatcctggccattagcaggagagattgaagagaccacagcccacatcctggggcactgtagcatgttccttttattgctggatctggctgtaactttgggacctgactgtgacaccctgtgtagttatcttgtcaaatccccttgtaaggcccagcctagtgcttggatgcctgacacttgcatcttctttctgtatgcttcttcctgcctcccatgtgactttgtcaagatggctgtcactccatctttgttgctatgagctttgagcccctttggacaactcccctggatgctgcttgctcacctgggccactgcctgttgttcaggccatggctttccatcaacactatcttttaccgtctcttgccaagtcaagcctgtgccctcagggccagtcttccttcatacaactctgtgaacagacctaatttcagaccctgaccatgtgttgacttcaccaggctctactcctcagaggggtagcaggagctgaggaggctgtcaggggcccaggcatgggttaaaggctttggtagcatgaatagaaagaatgggtcagaagcccagactgatggacacaggcatcagggaatgcaccaaggagaccagggcttcattggctcacaggtccctgtgctaaagaggaaagcacatccacagttaaaaaaagctgctcttccttcaggtgtatacaacctgtagcgatttgaatgttggccccaaaaggatatgtgcaagtcctaacccctactacctgtgaatatgatcttatttggaaaaaggatctttgcagatgtaattaaggatcttgagattgagatcatcgtggattacccagatgggccctaaatccaatgacaggtgtccttataagaagaaaagaaacagtgagaagaaggccatttgatgatggaagcagagattggagtggcgtaactacaagccaaggaatgccaagtattgctggcagctggcagaagctaggagaaaggcagggaacaaatgcttcctcagagcctatagaaggacccaatcgtgccaacaccttaggacttctggcctccagaactgtgagaggataaatttctgttgtttttggtcagtttgtggtaatttgttaaagcagactttggaaagtaatgcacagccccagaaggagacatggctttttgggtagagcacaggctaactttcagcccttcctgcccagcagtctggtttctttgtgcaaggcacaaactacaccacaatttatcaaggctctgatggagactgagaaaccagagcccaaatccacagaaagaattaaaggagtcagcatttggtaacaggaaaagaatgaactctataggcagatggaagcctgggattctgacactgtcgcaagttagtatgatgttgagcatcagtttttttcacctgcaagacggggtgggaagggaagtagcacttgttgatcaccttttgggaatgatgattcccttgaattcactggatggctctcaggattggatgacagagtacagtgcttggtttcccgtctgtcctcaacagatatttatttcctgtcccctcctctcctcaccttgggtaactggtattagtgttgcaggagcaataaggatacttgaactctgctacaactttgcttaagctcagaaatgtttggagcctcttgaaattgcagccaatggtgtctgccattggctccatgggccttgcagggagaatgaagttgatataccttctggaaaagaaagagcagggaaaaagcaggagctacagtttataaattctgtttctccaacgtggccacaatttgaaatctacactgcatgtttattctgtttgtagcactacatgcatgcaaaactggttgaagacagtttccatgatgaacacaagcattataattgccatgttgatctccataggaattcaagtggaaaaaaggttctttattccaggatgcccatatttggacattgttgcccttgccagacaagagggaatgaccttgttcttaatttaaaaaaaaaatggaaaggtggtggtagtagcctggtagtagccttggttaaaagattatgggttcacacttttctaccaagtggaatctgtctggctattctgaagcatagagacattctatgtcttctgaacataaacaggagagtttgttgaaatacaatattaatatgcactactgagaagattttgatggttcataaaaccctcatgaatcatggatgagagagttactggagtctcacagatcaattaattagatgtacaaagtgtatacatttttcatttgattatattttggtgttgtgttatagatatttggtagataaagtgaatccaagtatttatttaaaaaactacttcaagacgacattggagggtggttagtgagtctgagttgaaggattatgagggccccaaggctggtcctgagtgtgctggttaaaggggtgcacaggcacctgacataacagagctgggagtccagcaactaacaggagagagaaaaggtggcatccttctccctgtgaaagtcgccttaagaaagcttaggctccacttatggcacagagagctaaacatacatcagcttttccctccagggaaatccttcggggtactctgaacacatttctgttggattaacagggcccttagtgagatggtgttaggctgtccagcgactgggatcttccatttctttcagagcaggagacagcaaaatcatggcttttgttatctatctatatatacttattaatgaagacattccaaatgaatgatgacttcctgagctatccttgtggcatgtgcctgtccttgtgtgagtgcttgtgtgtgtgtgtgtgtgtgtgtgtgtgagcaactcacctaaaaagtaggctctagagtaggctctaaagagcttggctgtgccttttgaactgacagatacatatactttatagaactgtgaactttttcacccaataaaacaggggtaatacaagagtcttctaaatctttatgtttcatgtcagtattaccaggaattctgaggccgaagttcattgcttacagggtagttaaataaagatgttaaaggattagctaaaacattatccatgtattatcctagagtcagtggtaatatctactgacaaaagagaagattaacctcagagctttttgctaaacagcaagctgatgctcaagtcacgtttcaacatatttcttttgcaaggaggctcttttatctctatccaaggtgatactaatagacttatggaatacgttttcccggtctccagaagtgtgtcagctttccaatgacgtgttttttccaataattcaactcatcagattcatctggaaacagttgttttgatgccttctgtctttcatgtggtgccctaataaaggctgcagaaggaatatggtttgcagaaagattaaggtgacccaaagatgtattaatgccctgctgatgttcaaacaagccaatggctttttctttggaagtttaggtgttagtagaaggaggcacagaggcttggagttacagaatgtttggcccagaagagcttagagatcccatacccatctcacatttgggagccctctgtggctccccatttaggtggtctccagccatagtttctgcacattcagggcagagaaagctcactacttccccaaggcagtctatttccactgttagaccatgataacacaagaaaagtacttctgagctgagctgaagtgaaatatgcttatgcaacatttggtcctagtcctgctttctaaagcacaaagaataaatctctttcaccctgatgggccacacagtccagatgaatggatggagatattgggtttgactctgctccatcacttaagtagcagagcatgttagaatctctcagaatcttggctttctggtctcttagacgaagatcaggatccccatcacctgggccattgtggagtttgggccaaataatatattttaaccatctatcatggtacttggcacatggcaggcatttattgaatgctcccttcttccttcttcttgggagctcttcaaacacttggaggcagcaagtctattttcctttggttttctcttttcccagccttcatgctgcagatcaaaggaatggaactgaaagtgggggctgggaaatatctaagtcagtgtctcctaaagtgtgggcatcaacaggtggtaagaaaggttatttttagatagcacatgcatgatcattttataatttaaatataaatctatctatctatttaaatgatatatttcatagctgtcctgtattatgtcagggaatactatttttctatatatgctagtgatataaagtctcctttaaaataaggttatttaagaataaaggcaaatcaagtacaacaaaagctgttattattaccttgttgaaaatcaaatgagtttccaagcaaatcaaagtctatttcaaaaatctcattagcaagcagatctgaagaaacgacatggtgtatgactccaactatgtgatattctggaaaaggcaaaactagaaagacagtaaaaagatcaatggttgccaggaacctggaaggaggaagggatgaataggcagagcacaggggatttttagggcagtgaaactactctgtatgatactgtaatggtggatatttttacatattacatttttcaaagcccatagaatgtacaacacaaagaataggtctagtaaactataagatattaatattagctcatcaactgtagcacatgtatcatactaatgcaagatattaataataggagaaacttgagggtatatggacactctttgtactttctgttcagtttttttgtaagcctaatactgcagaaagagtctattaattaaaaaaaattaattagctagacaactttccagcctgattgtttattcactgccatttctccatctgtctcagggacatttcatgtcaaaaaccaaattagtcacctttctctacagaagagtactgctatctagttacttccaattgttaacctctgagatcctcccaaccttagagaatattgtgctcctattcctccttaatttaccaccttaggttcattacgaaatctctctgtccctctactccctccctttactgtctctggaatcccaaaccttcacaatttccacaactattgccatggactgggagctctcatcactccaagcctgggctactctgattgcctcttggatggtcttcttatctttaatttctcctccattccaagatcatccatgaacagctgttaaaatcaggtttgaataccaatttcaccccattccttctttgcttgagaatttgcaaacctctgtttccaaccatccaagtgggtggaatggtcaaagacctggatattacctgtgcccaccaagtcaagacaaggacttggatgagcagctactagctgatccaacaaagataattaacaccgataattatgaccatgtattgaacaccagtagaggatgctgtggttcgtgcccaggatgaggttctcattccctcacccagtggctggcactctcaggtgagcccctctctaggaattgccctcacctgaaggcagccacctcccagggccagcacagacttgatgactggtggatgaggaggaataacggccccatctcctagccatgaagcaagatacttcagaagggtcagctgagcatgagagttcccatgggatgggctgcccctgttgtgactgcatcaaagtttagcttctccccaacttcctcacagcacttgcatcctactgtgccagccaataatctccctgtgcacaaatcccatctgggcatctgctttgtggagaataagccctgcaacagcatccaaagtcagttggactctgagtttgtgctatgtccactgatctacactatcttttgaaaacaggcataataatagctgtctgctgtcaaatactttctcggttccaggtgctctcctaggatattttatttatacaaattctaatcttcacatcaaccctgtgagataggcccgctttccagatgagaatacctaagaattagagaatttggaaatgtacaaaagtggtccagtcaaaaaggttttggggacttagggaaggccagtccgtggcacctgggaggcatgaaatacaagtgacttgacattgaattattcacttcagactcatttacttctccctgcccagggacagatcctaagaggggttaggagggctgggcagtcgttcaacgttccctgcttatctccgttcttcttcccagggatgcatccttattagctcttcttctgactacatgtgagcattccattccaatccagccgctcagcctgctgtccactccctgcagtgcaacccagcccagcccctgccttatgtgcgtgtcgtgttttgtcttctgaaatgctcattcctctgcccatgcccatcatgttcctttcagtttggttaaaaaaggatctccttctgaaaggactttctggtgctatttccagagagacaattcacctccccaagtacttaaacactcattgtagccccagttgttctagcctatttcatatccattagaggtcatgcttagaattcagaccatttcttcttcttctttcttttcttcttccttcttccttctttcttcttctttgttaagcaaatatactcttctctatgtgttaccacttctgtggtgcccgtgtgattttgaagtgtttttcgtatgccattagacctggtcttttctgccagattgactggaactggtagaacatttagcatctgcagctgggaaatcatagaagaaatgcctgaatgttttcctatgtgagtgattcttatctcagccaaagaagaagtaagattttaaatgagccaaaactgttccagaaggcaattctaggagtgagcattgtgtaaaaatctggaaaaataaaaagtttaattgtgacaactggggttttatgtggtaactctctcctctttatgtcgtgttatacccaagaaaatcttaatatctcttcctatatttataatattattgagggtcaaaattacatgatgaaggcgtaactgtgcatggttcctgtggccactgaatccagataaatagatagataaactctatgtccagaaccaaggagtctattttggttgtctattgtctggatccactcattaggctggagaagggttaccagataaaatacaggattcccagttacaagtgaatttccaataaacagcagtataaatgtcaagtatcacatgggctatacttatactgctgtttatctgaatttcaaacgtaaatgggcattctgtatttcacttgctaaatctggcatctgtaagctggcaggtacctggaaagactcctccttccaaggaggaaaccaggtcatgggtgaaggctttagtcagggatagggggaaggaatatttcttagtggcagccaagtaggtcaaagtaatgcatgttgtcccatcaaatgcctttctccctttgaaaaacagaagcaattacaggaaggtgagcctaaccaatgatctgtgaaagtcggaggttgagacagaggtcccacatgtgtacatctagaaaaccagttgggtgatgtggttaggtttggcttttggttatgtggatatcctagcaatattatgagtaagtgaagaaaaatgaggttttggggaatcagaagggcagggctggcttgccagaaggactaactcctgatgggatgtctggttttcttaacatctagtattgaaagttacagggcaaatttggccttggtatgggcaagctatgcaattcaatgagatccaatgtggcaggctggttgtgggagaaaggcttggctcccacagacagcgctggcaagttagggttaagtgtcataactcttgacccagtaggggcctggagaacataaaaggtcatgatgaaagaagatgaaggctggagaagggagttaatgaggacaccagcttaaagctcttggactcctaggcttctcccaacactctaaggatccttctagggaagcctgtttaattctgggtctagcctaggggtggagttgaggcagttcatggcctatctgctttggtcaggctggctcagagtttaggaggtgggaggcccatgagatagaccaaacagtcaagatctgagtagctcacaggaagctagaggaacagctcccaaatcatcttcatttgtgccaggaaggtgtgtggggtagagagtaggcaatgtaccagacaccacatgaaggagtagcagaaacagttggagaggcaagactgattgaaacaggaaagtacaggccaaagaggcagatgagtcatcatataaagatagcactagacgccatagaaggtcttcttcttttgaaaagcagaaacaattatgaaaaggtgcggataggcttttgaaggttgtgtctgatctctggctaggctcacaagcccagcaggagcctgtcctacaaagcctttccctgaggagagcttgcaggttgggcagcctaagccctcgacagaaaagcacatgtttccatgaagtctgaagtctcaaatgattgcatttcatggagtttgccttgtgcaaagtcatagaaacaaatgcaggtgcactgtgggcaccagagctaataaagaagagaatcttgtagacatgaaagagagaaagtaagagagataaaaggagatatgtggaaagagagagagagaaagggaggccataaactttggtggtttttgcctttagtttcacttatgtaggcctttttgactaaaaattctgaagattagtgtttgctataccttcagttaccttatttttcgtttctttctttcttttttttaaattttgctgagacagggtctcattctgtcgcccaggctggagggcagtggcacgatcttggctcactgcagcctcaacttctcaggctcaagtgatcctcccacctctgcttcccgagtagctgagactgcaggtgcatgccaccatgcctgcctaatttttttgtatttgtagagatggggttttgccatgttttccaggctggtctccaactcctgagctcaagagatccacctgcctcggtctcccaaagtgctgggattaccatgcccggccccagttaccttctttttcaatatttaagttaggtattacacaaaaatgtttgcaatgtaattatcaacttctataaggcattccttacttgtttactttgcactaagttgatttatattacagtgttgagaagctcactgtctggatgtggactgtgctgggccctgaacacttgcttgtctaacttctttttttttaacatttaaaaaataagctttattttggagtaatactagatttgcagaagagttgcaaaggtagtacagagaagtctcatatgccccttgcctagtttccccattgttaacatcttaacaataccaagtatatttgtcacaactgagaaactggcttgtctaacttctaaatgtgcttctaaatgcccaggctttcaggagtggagaaatgccctactcaggttgatgttttttcttgctccgggagcctgaactttccacccttggctttggtatccatgtgtggtcccttttccaatggtgttttcctttcttatttgatttttgtatttatcatatctcgatttacattcccaaatgtaaaataaactatttcaaaatgattttttcgtacttctagagttgaaacagaggaaaaaaatgcattgttctggcaaggaaaaatatactaacaggagtaaaataaaaacagtcacttcatattcaaggccaaactctggaatttaatcatctcttataaaaaaataaacaatttttgaaaattacttaattcatcactgattgagcctggaaattagatatcgaggaacaaaaacaataaaactctgttagttagcatgaaaaggccaaagcatgtttagtctaagtgtttaggttaatagacaatcactgtgtgttcactctaaaataagagatcagttgtgaaagagggctctagtgagtgggttaggaaggtacaatacatgagagcactgggctgagagtctacttccagtttctcaggctaattctgctacaaatgctttgtatcctccaaggcaagcaactttatctcaagccctgatgtcttcacttgtaaataagagatagttagagataaagaagtggctcaagatttccccaaattctagattctgattccataacaaaatccaattccctaaacactcaggagtttaattgagtattattggatgattcacttggcagttaggatcttgctgtggaagagggtcaccagtatgaatattcactattgtgatgatgaaatgtataggtgagaattcatggatagttggaggatcaaacacaagatcaatgctttcaaatctgctttatgatgtggcatacatagaaatcaggggtaaacagatgaggatgcctagacctggggcatacttagattctctaaactattcccagttcctccatgggctcatacttagattccctaagctcttcctagatcctccaagggctgagaggattgatttcttaggtaacaacttataacccagtaatggcatagcctagcccaacagtcaggaagctcttgactatggaccagaatttgctctagaatggagagtgacatgtaacacaataaacatgatagctactaaagataacatgcctttatatttttattccttttttttttttgagatggagtctcactctgtcacccaggctagagtgcagtggcgtgatctccgctcaccacaacctctgcctcctgggttcaagtgattctcctgcctcagcctcctgagtagctgagcttacgggcacatgctactgcgcccagctaatttttgtatttttagtagagatggggtttcaccatgttggccaggctggtcttcaactccagacctcaggtcatctgcctgccttggcttcccaaagtgctgggattacaggcatgagctgctgtgcctggcctatattttcattctttagttcttgtaaaaaaaaaattcagaataaatgagagggaacagatgatgtgaagggggtggatagtaaatacagttggtgacacactgattctgagatacctctgaagcatctgaatgtagatattgagactattggtagatcctcagagctggaagtcatgagggaattgtgggctgcagagagttttggaagtcattagcctatatagatgagagttgaagccatggatgaggtttctctgaaagagagaaaatgagaagaagccaaggataaagctcaggggaacactaatatttaaggagctggcaaagagaaggagctagcaaaatctatagggttcatttacagctacttacacagtgatttaaagtcatttcatatgtgaaaaacataagaccaatggatatccacatatagatttgatttgtgttgtgtaaggatatacacaaatgcaggcaaaggaacccacatgctgtggatttgttcactcattcactcattcacagtggatgcattgattctttcaatgaatgtttactgagcacttactgtgttcctggcattattctaaccactagggatagagcagtaagccaaacaggttacgtcccttccctagcggagttttactatggcacataccaccacacacaccactaaatactttagagcttgctctccaagagggagagcagaatgtagacaggctctgtatttttacctctcaagaatcctgtgtcttcctaaaggattgcttgtcatcacaccaactcatagctttggccctggtgctgtatttgacttttattcacttaaaaggttaactggatggctgaattacaggattctagccaaagtgtgctccctagaggattcccagctaatcagtcagctgagctgagctgacgactgtcttccattcctaaggagctgggcatttgcaggctgagctcacactgtgaaggctcagcaagaccttgatctcccttcccaagtcatggctgagtgacagggagcagcaaaggtcatggttcaaatctgaggtggcagattctgaggacaaagcctgcagagatcgctttctattgggaactttctcattttaattccttgtcagaatattccaactccaggccttccaactccaaggaaactgaggcaaaaatctaccttctatcttgttatttcccccagattaatatttttcttaaaattttctcagataattagtagatcagagattttctttattttggggctggtatgttttgggttttcattggctaattagccaacttcatctctagaactttctgtttctatcaatatctatccaaggatgtctctaatctccctggttctttaacgtaattcccatgcatgaagccccccacacccgcttctttctccattgtctggttgagatctagtggaaagcctacatggcagtggagattggaaagtagtctttgggtgaaaatatgctccattatggctaaagtgttggctatgccagtccttttaattaatgaacttaaagtaaccttagactccttcctcttccatcatctgtcatacctaaataattatatatgaattagatttcttaaaatgctatatgtacatgcatgctttagcaagtaacttttaatgcatccctattacagactggaacccaaatttattagcctattctttgacctagtgatgagtgctttcaggatttatcttaccaatagagtcatacatgcaaaataacctatttgaaaaattatttattgtagcattatatgtaatagcaaaatacaggaagtgatttaactgtccatttattggggactgttaataaattatgattcatctctacagtggagtactatgcagctgttaaaaaggaaattatttatatactgatgataatgacctctaaactatactgtaaaatgaaaacagctaaaatttgtgaaaaaagaatacacacgcatacacacatgcatatccaatttcttgtaatatgcacttaatatccctggaagcatacataagaaacatcagtttcctcaggagtggagagttgggtaactgaggaataggagtgggaggggaacttttcactataatatgctatggggacttttgatttttgagccatgtaaattgttacagataaatatacaaataggagctaggcgagatgcctcacacctgtaatctcaacactttggtaggctgagataggcgggttgcctgaatccaggagctcaatactagcctgggcaacatggaaaatccccatctctacaaaaaatatgaaaattagccaggcgtggtggcatgcacccgtagacccagcttttcgtgaggctgaggtggggggatcacttgaacccaggaggttgaagccgtagtgagccttggttgcatcactgcactccagcctggtagacagagtgagaccctgtctcataaataaataaacaaacaaaaacactttaaattttaaaattcttcacctggcatttgaaagcccctcacaatctgcccttgattatattatcaggcatatttctagaatatcacattttcccttgcacaagccgtctgctctgcccaccaagcacctcctgcctcatgtgtgattccatttaggtcctttcaaagccaagttgccaggttctagttccaattctacccaactcgcgttttctggaaactccgcaaaaagcactgtgcctgcagctgcaggctatactctcaacttagccttttctcactttgtattccctgggcatgtaaaatttgttagggcaacatccttgatcttagacccttttgtggagggaaggaaaataaatggggtagaaagagctgacaaaagcttcaaacttcttcagtatctgcttaaaggcccatctccgctaggaaaccaggcctatccattcagccatggagatctcctcccctggctcctataagtctaattatgatgacccataccaccgcccagcaccgaccttatgtagccatacattgacatgtgtgatcatgctgtgtccccccaccaactcaatctatgtctttaccaaatatttaatgaacaccaccatgctaccatgttaccaggtagcaaaagatgaccgagaccccattcctgctgacaatggaactcataggagaatcaaataacaattgtacttgaagaaattgtctctaagatagtgcgacatggaattgagacctctgtgctctgcatggaagacccgagagggctgctaaggggatactgtccttgacatgagtcatgaggatatatatgtatcacttttcaagtggaaacaagcggaaaaagaaaaaggcatttaacaagaaggtgtttcaggagaattccaactaattcagtatggctgaagtacacagcacctgcaaaaaagcaaaggtggtgagggtggatccataggcatgagctaaaacaaattcctcctgtgtgtaggctccttagcagcagagatttttgtgtgtttattgatggatcctgggtgctccatagtgcctggcacagaacaggtactaaatatatatttgttgtataggaaaacaaatcaatgttggaaatggattaataaatgtatgtcaggaccagaagtttggactttgacctaaagggttattgaaggactttagtcagctcaatggctaggtcatacgttcatttcagataagcacgtaatcaactggaaaacaaatgaaagtatataaaggggctcaatgtgaaggcttacagagaacacacagacatcatctctttatacatatatgtaatgtccaataataaaataaatagcaataaaaatttaaaacaccaagtaaaattaaaatgtgcaagatgtacatctttaaaaacaataaaacttaataaaagaataaaaagaagaagacttgactaaataaagggaaacatcatgttcttgggcaggaagtctcatattgtaaagatgtcacgcttccctaaagtaatatataaatgtaatacagtttcaattaaaatcccagtgaggttttgtggtacttgacgaatagcttttaaaattcatttatatgtacaggtgaatgaaaacggccaagaaaaacttgaaaaaccaataaaaatgagaaaggagcttgcttaaccagatcaaaagacaccaaataaatttatggtaactaaaacagtaaggtactagagcaggaacacagaaattgaacagagtcaagtatctaaaaacaaatcttgtgtatagttagcagtggtgatagctcacatttattgagagcttactatgtgcctggcatttttctaagcattttgtgttactcattttattctcataaaaccctctgaagggtgtcttgttattatccccattttatatatgacaaagcacacatagattatgctacatgcctatggtttcagagctggtgagtgacatccaggctgtctgactcaaaagccttcattttcaatcacaataaaatggtctttctgcaggtaaaaagcagaggcattcaaaacataagagacaaatttgactatataaatatttaaggcattgatcctgaaaaaaacagtgttaaatgaaaagcgaaaagctaggaaaatatttgcaaagtacgggaattcttacacatcaataaaatatgaacacctaaatagacaaagtaaacaatcattatgaacaagacaatttatacaagaagaaatgcaaatggccaataaacatataagatgctcaatctcaatggcaatcaaaaaaaagaaaattaaaatgagatgtcatttttctcccatcagaatgataagaattaaaggtaggagcctagggttggcaagaacatggtgggaacagtatcaagccaacaatattggagcttgaggtaaaaggaaaaatcaataatattgattctacctttatttcaaatgttgatattttgttcatcatggacttttcttgcatgaattttgatttaaaaatattgtatcaaaatatttgttttgattactgaggtttgtttatagcacgttaaattttgtgtccaaggaaaagtgcctcactcgtgtcatattagtcccaactctgcatggacagtctgcaaatataaatcaaaatgtttaggtatgcttagccactactagcacagcaattctttttctaggaatttaacctaaaggaataactcatcaagcacacagagataaaagtacagagatgctcgttatggtatgactcgtaagaaaaagttgtaaactatcattaagagattggttaaagtatgatatatttgtacgctagaatactatacaggcattaaaaatgatgtcatagaggtgtgcatatttaaaggaaaagatatccgtgttgcattaaagagtacataaaaaagcaagaatatgtacaatgtgtacaataattccaattatgcaacacacacatgtaactccaaaaaaagtcttaaaaagtaataagtttttattggagtgacatgaaaaagtagcaaaatggaatgtcacacttcacacagtctctcatcgtggcagctattttattttctctcacaaaactcccttttgctaacataccctcttacaattttttgacatatttcaatttccccatggtagcacgtagtgcctcatatgcctgcatttaatctgcccccatgttttcaattctatagctctgcccatcacccaggaggactagtacctttaacacattagccttctttcctacaaggcaggtgtaacagacatttatttttcttaggggaactccttggcttatgagtctgcctccctctatagaagccagactctttttattccagcctccctttccacttgagcatagacatatgacctgggctcagtcaatcagctgcccctgcccaagacttgcaatcagaagctagtgactgaaagcagcaggtgccatgtagaatccagtctggttgtggtggtggcagctgatgccttcagttttcagaagcagcaattgcagggctcccggtggaggcaaccagtgcccagcatctgccgggtcagcagagcaggctcctgtactgcgttcagtggtggggctgttgtgtttcctccagaccagctctgcagtatgactgggacttctctggccatgcagcctccacgcctgggttgctgaccattccagagattctgtgagtgacttcacattctttaacaaatctctttcctgcttaaattaaatgtttgctttccattgttttcaactaagaatcctcactaatacatagttatttttggtactgccatatatatgtgtgtatgtgtgtagaaatctgatttcaacacccattatagcttactctcccaaagaaaaacaagtgtataggttaaatcaagttgatatgcttagggaagcttcattcatctagaactgtatagtcaaatacaatagctactaggcatgcatggctattcaaatttaaattaattaaaagtaaataaaatttaaattcagtttctcagcaactctagccatatttcaagtgttgaaaacccacatgtggctatgggtaccaaaccggacagtgagatttagaacattttcattattgcagaaagttccattggacaggacaatctagagggatcttgagatttcaccagcccacctcactgaaccatcacagagagtgaaaaaccactttgggttacatgcattgcactatctaaccatatcgcagaaattttgtgtcaacagagaagtaaccttgctaactagattagagtgtgttttacttctctatttaaattattcttgttttcttgctctctgcctcccagcctcccattctctttctttccttgccaggactttgaattttttcaggttacttggccatatgctttaagtcttcttgtgatagtatctgccccaccaactttacaggattgctgtgagccaataatataatttgggagggaattttatattcatgattggtctgaaatgagccctgatattagatgattctatgattcaagccatctgactttgagcaaatcactcaactttcctggattcctgtttcctcaccagtcaattgaagaagttgaataagataatttctaagttccattaacaacattaaaaaattattttatatagagccccaaatactttatttatgatctcttcagcagagctgaggagttctgatgcaggtggccaatgatgaggcaggtagagatgacaataatcaagaatgagtcttttttcaggatttgatgggcactagcccattttactagaggcaaaatgaatataaaaggcagaacagcaaagtgaaagcttatactacaacctctttctctcaaatcactcaatggtcatatttttcatgcaccgtagttaatgtttaaatgttcagaagaaattgcaaatacgtgaagtttttaatctctttctttttgagatgcccagcttcatgcttggcaatgcattccttgctacgggaacacagtctacctgaaaatgattccattgttgttctaactaactatatgttcttctaaaaaatgtaaacacatatttcagaggtaacccctttagatcagtgccaggtccatcccagagaaaacctcttgggcctccgcaaagggctttctattcaggaattcaaatacacacgagagtgtcaacctgtctctcttgagtctcctccactacagtttctattaccagattaaaatgttaagctgaagcttcttgagaagcaagggtattctaggtgagaatgtgttcaagtcttgcagattggatagcttagaatatctttttagaactttctatcaggaaaatggacagtccttattgttattagggaattgtgttatgataacaacattcattaagcatttctacgtgttaagcactttatatgcattatagcattcccattttacagatgtagaaacagggatgcagagtggtttggcaactgccttgccttacatctcatagttaatcaatggtgtgaagttgagaggatttgaagcttggagctgctgcaaccatcttgctcctacttccaggtggaaagtgatcacaacacacagaaggaagaagtaaaagaagcgagctgagaaaaatctcatcctgatgcagcaagtgagccctaaaatcagttgtgcctgaagccagctctatccctgcacactgaagctttgacgaatcagtcccaacccttttcacttaagctttgggtgttagttcttctttaatatgtactctcgagaattttacttgatctaaacttgttttatttaatgttaccagtgaaaatatacataaccttatccaagggataagttttaattcaggagtgtgcagaaaaatagttcaaattttttttattgtggttgaatttaaaaccacaccacccccattgtggctcccataagctggctggacatggaggtttgtatgtcacactcaccccctatttcctcattcaggaacctaagccctgaattgcactggagaaataatttactgtggcattttactgaaacatcctgtggatattttaggtatttgcacagagaactttttgacctttgaataatatatgtgctgagaaaggtcttgggatattttaacaacatgttaaactgagatagtcctgatgagatttattttggtctctgttggctgctacgttttttcaaatcctgttggaatttttagtttctatgaggacatttccaagatttttttactgcagcatatttcatgctatttaatggtccctttatcaaagatgacaggcaggcagttgataagctctccagagagtgactcctcataaagcctttcctccgttaatgtgctaggtacattgccaccgactcccatggccacctgagcctccagtagtcccctccaacttgatgtgtcctaaagtgggtgctgggtacttaaaatgaatacacaattttctaacatttaaaaccgctgattaattctctgaaaacataagtgcaggtgatcacaggcataaactggccagtatagccaaaggcatcatgaggattggatcgcttccacaggcagtggacattagatgattctatgattctagccatctgactttgagcaaatcactcaactttcctcgattcctgtttcctcaccagttgattgaggaagcaaatattaattagattaattaattgaagaaataaatatgatcagactttccccaacagccccttggtagaggaggccagaagtaattctgtcagtgcggtatgacagactgcagcttaaacagaggattaattgaaggtgcatgcatttaaaccacaaggtgcatattctcccagaatgcaggatggttcctaggctagggtttggtatctttgaaggacctgtttaaatttctgtgcaagtaggctgccaggaaatacattcctgccccggaggacactttgtctcctacagaaaggaactagcattgtggaaatttgtgggtgagaatgcaataggttgattctaaattatgttaactggattttcttccaaattaataaaagagcatggactggacctgattgctcattgctgagttcctagaaatgatcacttgtttgcatacaacaagcgtgtactaattatttcttgagtgaacaaatgtgctaaagtggtgagcaaatgtcttgaggagacagaagttaccttgcaaaggagacttttggaactgggtgttcaagaatgagtaggggctctcttgatgaaaggaaagaggagtaataggagaaaaagaattgtagtcaaggaaacagaatgcacaagggaatggagacatggatttcaagcttctagtaattcatagcaggaatctataaggaaaatcttgcacaaagttatgaatgacaaaccttcacaataaaagtgcaaacaaaatcccaattcataaatgtcttgctgtgaatattggtcagaagctggactttcgccaaaacataagcattatactaggtcaattacctttgtgaggtgatgaaacatttctagaagttggcagggtcctccgtgctggttttataggctattgcataatgtcaacttattctagaatgttgcctgaggctgcatcactgggattcaaggattggtcaggaacatacattaaccgtctgtgtttgataaagtgggaaattcttctacaattggtctttggctgattgctgtgtttttgccagtagtgtacttctgacagtttggatttggcttaagaaatctaagacaatttttagaaatcaatgtgtcttagaaaccattaaacacatttatctccttttataagtttaggatatgaataagaagagtccttaaggaatgataatcacccttttctcaggccaatgggatgtgttgcaaaagagaatggggataatctccaaagatgttaggctgctgggcacaccagagcatattccctactcaagcaagggtggagatgtctgcaatctttctaaccaacaacatatcttgaatagcgctcatttgccagtggaaaaaaaaaaaggataacataacatcccttatactaattaacaaaccatctggtgcatatttagataactattcctgaagtgctttcctttgctttccaaccggggactgtcaaatgctaaccaaccatcctgaagcatgaattgtgtgaatttcttattaggaaatgcagatgttaaactaattacacctggagtgtatattgacgttaacttatatacatgtatacatacagacacccactgtctatgctgaactactctgaagtaattacagaggagattgtgtcttaattcctgattttttcctaatggttccatctctacctctactgccagcaaataatggaatcaataaggctgcatgaattaaccaacttatactggacatgattttgctcttttctgtgtcaaatgatgcagttgtcaaacttcttatagtagtttagttctcaacaaattcattcgttatcctgttgatctcatcttcctactcttctgaaaatgaagaaaagtaaactgaagaaaaaaactagtcatggctccaataccctaacacaatcaccttttgaatccagtaaaaagaatggtgaactagaatgtttaaactggagtgaaattgtaaattaaaatatgcttttctttgtatagtctgattgcctgattatcttttacctcagtggacattaggggtgagttatgttacatctaatttattaccaatgctattattattaatagtagtatttcttgactataaacaataatttataatttataagtaaatagtattatttatgaaatgctgaacattgtgaaaaattttgtaatataaactggaatagaataagcatgttatactcctacacatgttctcaggtgaggaaatgttgaagttagccatggtgcaggttaatattcatatgtgtggcatgtgcatcaggggagaagagagggtaagatctgtgtcttgttttggcctgagatgcttatgtatgagatgacattggctttgattctgctccagccacagagctggatggggactgtggatggtgccacaaataacgtcctggccagatttcagccaggtctgcgatttgagaagctgggtactttcgtgccttcagcaggagccactttggcaggaaggacaatgagacaggaagaccccaacgagacctgtcttcctcaaagcaaattcaaattacctgcgtcattatgtgcagggctggaaattgtgcaaagaccaatgtacagatcaatggaagtgaaagacattgcacgtaagaatagcattccttccacgtgtacctagctctgtggtttccccaaagctctcaggtatattgcctcagaaggctgggaaggtagtgtgctgtgatgggaatagcaccagctttggagtcaaacagtctgaaagctcagctgtgtcttcactgtgtccctgcatgttcattatttataataacatatccatgacaaggttcctgtgatgattaatgaggtatctttgggggaaaatagcttttatttataattgattgctgtcacctaagaatgggtggatgacagtagttggaagactttttgtttgtttattagattgatgggtggtgggcacgcaaggttagactagttaggaaagagctaaattgtttccactcattcattcaacacatggatatttgggatatagatgaacaaggcagacaaagaccctgatgatacggtgattaccttctagttggggaaagacagataataaagaaatagtcaaatagaaaaaccatataatgcgggtaatgatgagtgctatggagaaaaagaaagtcaggggaggggttagagaatggctgaaatggaaagggtagcagggagaaggtctccctttcaagatgctcagagaagtcctctttctgaggtggtggagcaagttgtgcaaaattcagtgttgaagagtgttcctggcagaggttgctgaggtataaagaccctgcagtgggcatggggtgggtatgtgtgacaaattccccagggagatcaagggatcaggagtagaatgaggcatgcatggtaagaagtgagttctgagaggtagacaggacccagataatattgagaggctcaagttaggggttcagattatattctataggggctgggaagccattgaaatgatttgaaaagaatgattccattaatgtatataagaaaagggcagggatttagaggcctagaaggaagaatgaggaaactagaatgggaaatagagtaatttagatgcatcctggaaaggggttgagggaaaaatatatcccttaccttatcttcccactggcttggtcaaagagggtcgttggggagaagagaagtgacaaaagaacatttgttagattgttcaaagtatggtgtataatgagagctcttgcctctatctctgctacagaatcttcaagaaatctcacactggttaacaatactttagggtgagtagatcctgaatggtgagtgggaggaagtgttgtgtctggcttaatggctaggcagagtgagaacagaggctggaacacacgtggaaataccctggtgtggtacaaagcagagactcaagaagtgtgcctttccccttccgtagtccttacttcgttttcaatctgtgtgtagggccatctccttgtttatggaatgacattcaaccagcctgagttcctttcaaggctgtcagtttataaccctatggcctatggcttttatctcccagacaagggaactctctctaaatgtaatttttccctcaattttaatcacagcatttaatgtaatcatttgggggaatcaatctgaaaatcatcagggattcttttttctttttactgctaccacgaatagtgattgtgcaacagagttggggaaagacttttgtttttgatgttgcaatagcaggaaatagaaagttgctgctgtcagccacttggtcagagttacatttcttttgcaccacaaaagaagacttgtaggagactggaatatggttccaggtaacccaactatacattcaatgatgaatgcaccactgcaaaggagaggtgtggccattgttgagtaatttgatgaaagaacaactaaaacagattctagatgatttaaccttgacttaaagtaagcccgagggggagaccataattataactaacttccatttttcttggcagagtctacagtccattttgttttcatttcatttaaagtattcccactactggattatctccattttagatcaataatcctcttcctccctttgcagtggctttaaatgttttaagaatttgtagtcattttttttttaagctatcctgaggaatcaatctagactatcacttaggaacaagaaatgcatcataactggcatcttgcagctagtataaagagagtaaattacaaattaaatattgaaactaacattgaactgtgctgatagatagccaataggcacatttgtcaatttaaatttaaatgaattacaattaaataatattaaaattcagtcctttatttgtcacatttcaggtgctcaaaacagccacatgtgtctagtgtctaccacattgatgtaatagatatggaatattttcctctttgcagacaattcaattggacagcctgatttaggaattttaatagttggagtcaagagaagagtcctttagagtgtataaagaggcaggagagtctcatcaaacagattccatgacattttaatttcattaaacatgacttcttcagcaacggatccatgtgttagaaccaattagctatcccaaaggaagaaaagtgaagataactttcccacaatttccaatgtgttagtattgcccagattgtaggttactttgcaaaatggccaaaagcatttgcagcacacggaaagagggtccctctgccaaataatcacgaggaccttcccctccctggagaaatagattgaaacctcttcccctccctggagaaatagatccaagcctctccactgccatcttgtcaaacatatttacattgctcaactgacttgggaagaaaacaaatttccagtatgagactctctggtgggccaagctgtttctcaaggagcattgagaaataatagcaactccaaatattaccttgggcaagacaaggcaaatgatatccttaactttgttatccaagcatagttgaaagagtgtcttcttccagttctctgtgtctttgactctggctagaccctcagggcctggctactgccttgcatactagattcatgggtattttcctgaagctcctttgtagctcaagctgggcctgctctccagcaactcaaactcaagtagagcttttggcccaccatcttttatgatctcctagcactgtagggaaggacacactgtgtatatatgcacattcgcacacttgggatacatgctctctgaggggctctgggaggtcatgtttcaaaggcttcctgcatctggggagtctgggttaaaggcagtttcatgggacaaactctcagctcaaatcttgtcctgcagggagctatgagccctgagtccagtaactttaatcttcaatgctatggaattgggtagaaaaagactaaatgaaatgcctgtaatcacacagcaagttaattatggaatcaaaaaatgattttttggctgaaatgtctgttgcatgattaagaagtttcctcttttcattttgcactgctctttataaaggagctttatgtgcccagaggaaaagggaagatggtgtagatactgattttcacttaatagagttcccttgggatgtttgttagttttgtcccaggcattaatggtaggtctgccttcatgcaccttttcatcatgctgataggaggaagagaaacaaaaaagaatccttctttccctgctgcttaagactgtaacttgggtttgccttctgtttgtgtgcaacaggcttgggaagacaggccatctctctcgttctcagatgttaaggactgggaccaaatgagaagaagaaagccaagtaggcgtttctcccatggtagttatctttagtctatgctgaggtcatgtcccagcataagaaagttgcctgcttatgggcttggggccaaattcacactgattcttgaagtctggaaaatcaccaaccattccagcatctaggatcagacttcttcacaggcacaacgacggttaaaatcccctgtgtttttgtcttgcgtttgtatatttatatgtggaaaataggtcccggggaactagtcttgtacaaaaaagtgaattactataaatacatataatttgtgaatatatgcatgtacgtataaacacacactataaaagttttctgtagcgacaatgaacatgagagaaattgatcatttacatttaaattgaataaattgatgatttattggaagacatgttccaagaatggtctaggtgttatgaaagggcttaatcttccaaaccgaaagtgaattcagaccaccactcagtcactattggccaaacaatagtctaagcaagattagttattctttctttagttttagtagaaggccttgacgtagagccatttttgcttcatgactgaaaatatttgactgccattttctttttttacttttatttttatatattttaaaatttaatttatttttaagtttttatgtatttagggggtacaagtgcagatttcttaaatgtatctatcgcgtagtggtgacatctgggcttttagtgtacccatcacgtgaatagtgaacactgtacctaataacaggtgattgtcaaccctcaccccaaccttccactctcccgccatcccaccttttgtagtctccagtgtttattattctggtctgtatttgactgccattttctgaagcctggagaaaagcatctcttcccatgattacagctaacatgtggtgtgaatatgcaacccaagagcaattgacaggaaatagatagccttaaggaactgaatcactaccactgtcgccgtctcttttgtatattagccttggccatgctaatctttaacatcattgggaactagaaagcatttgaaaattgattataaggacagcatagtgtaagatgattttatcgctagggaggcatcatctaggaaagtctttgccaggaagcgttctttctcattctaaatcctaggaggcacaggaggaaagctagggatgagtgctctggatcataaggcaccaaagggatcctggaaacgctatgattacagtggcttccagagatgtggtaggaaaaatgtgagcaccagtggtcagcatgaccaacttacaggtccagcaaactgggtggcctgagtggtcatcacgatgggaaagacatgacccatggatctatttgttctgtgacagcacagttaggactgtgcagtcatgggaggtgactaacaaactcactgactccatggccatgtggccaagggtgaggttcagcttgattgtacaaagtgtcactcactctgctgagtgtgtatttggaagaagaggcaagtgaaatgttagagacagcagcagccactgtaaatggaaatgaagcatgccaggagacctgccacagatgaaaagaagcaagccaggcacacaagaaagaaaggttgaaggaaaacaggacaagggctggaactagggctttgctaattttagctaggtgcatctactgacctcatagtaacagtaattgacagtccaacaagaacaataactagttagcacacagtcaattagttatttttcatcctacattgtttagcaaatatgtaagtagttcactcatagggttccaaggcttgtgctttcaaagaaccaaattaaagaactctgttcaaacattattactaatcttaaaatgggcagttgccatccagtttgaaggttttattccaactgtgttttctcaaaaccatcataacatttgggtgttggaaacaaaagacattaggtggatggacaccaacctgactagcatggctttgatgccttggcatggaaaatctttattgagtcttccagatggcaagaggcacagacaatcattatatatttggcctctaaactgaaagtgttcctggtaccaatattggaaaaaaaagaagtggtactcatttactgagcaccaactatatataatctattgcacttgctatgaatttctttatatactcttatgtttccctcacagtatatctgggaggtagaattactattcctctattaaagataaggaaacagtggtgtaaagtttcaagtgagatcttcaacccactttctcacagttgcccccagagcctgccgctgagaacttacaatttggagaaacgacagctgccaccaggggcttactgattggtgtgctctttttgaagaatgaacagaagtaaaagtcatacagttaggaaaagagaataaaactgtctttattcatagaataatgattgtttaggtaggaaattaagaaatctacaaaaagttactagaaccaataagtgaatttagcaaggtctcaggataaaagatcaatataaaaacgtctatttctatacactagcaatggatgattgaaaaatgacatttaaaaacatttcacttacagaattcctggaaagcattaggatctgaatcatttatcattacggtagtcttctatccagaagaaaaagggagtcaacagagaagagttgctaggaaagtcaaatgtctacattttacttccaaagagttgagaatcctcagactctttacaccatgcccagagatactaaataatttgcccaaatccacacaactagtaagcccaaaaactgggatttgaattttggcatctttgattaaaaaaatgtctagttttttccacagcgcccctgcaattaattaaagtgtttccctgtgtactgcaaatggtggaacaccttatctgctctttattccaagagcccaaaggttcaaaaattgtttccgaactctcagaatttccatttggctcttggttggcattcaaagtccaatagtataataatgctgtctcatatttgaacaatatagtttattaaactttcccatgtattacctcatttggttctcacaataacttgtggataagaaatggttaaaattatctcaattttatagctgatgcatagctagacccagatgaaaatctactttgaaaacatcaactcagaaagagcaccagactttgctgacatagacagggttttgttaattcaagtagttcattgacttagacaacatctaagcattgaaatttatttaagaaagtacaggttgttatattcatttacttaaaccagtactctaaggaagatggggaaacggaagtgtggcctcatgttttagagaatgccatcaattgtaaaaagaaataggaaactcatttttaatatgcctatttaaaaaaaatagatgtcatgactgaaggctttactcatccaaagctgaactattccttggtatataggtgtatagatcactgattcaaaacattcaagagttagaaagggatcttagaggtctcctagttgaacctgctctttcctagttgagggaacagaagctccaggattttcaatgattatttctggtcacaccactaattagtggcagaattggtcttggaatccaattagagccagactccaggccagttctatgatacaccccaagctcaggaatttcttcctcctctttttaatttctatgagacactttcaataataactttgaggtctctagttctgagtggccatgattttgtaatgcaagtgatgctagctcagaaactccatgcctggccctctctagacacccaagggaagggctgcagaacgtgggcaactcccagggcttttgaggccctggagcttcccacccggaacacaaaatacactgtcatgtgtcatcttgctttgtgacttctcatcttaaggtcttgtcaaagctggccacgtaggcctttgaaaatatcatagagttctttgaagtaggttgtttacttttcttgaaacacatctgtgattcatcttatttgcattttaaaatgtaagtgttttggccagcaatttgagggagaagtccaatagaaaatcagtataccagtccaatttgacagctttcatctaatctatcatcactttctattcatttgttcactcattcattcagcaactacctaatgggtatttactacatgccaggtactgttctagctgcttgggaaacagcagtgagcaaagcaaggtcaggaaggtttcattccagggaaaagggacagataataaacaaaggtataaattttttatgtgtcagatgttgatgagtactatagcaaataagtagggtgagtgaggatagggagtgtggtgtggatggtgctgattgggatggttaaaaaggcttctttgctaaggtgacattttgtgtagagacctgatggaagggaagaaacaagccatgtagccatttggggtaacaatttccagacagaggcaacaacaaggactggctcctgaggctaggagactgctcggtatgtccaagaaacagctaaaaaataccaagtggagtgagtgaggtctggaatggtagaagacgaggtctggggaggttgcagggaccaggttttatagggctttatagaataatataaggacttttgccttttctttttagacggagtctcactgtgttgtcaggctggagtgcagtggtgcgatcttggctcactgcaacctccgcctgccgggttcaagcgattctcctgcctcagcctcctgagtagctgggactacaggcgtgtgccaccacacccagctaattttggtatttttggtagagacggggtttcactgtgttggccaggatggtctcaatctcttgacctcgtgatctgcccacctcggcctcccaaagcgctgggattacaggtgtgagccactgcacccggtcagacttttgcttttttaaaaaactagattttttaaattgaggtatgatttacatccaaggaaatgcacagatctcaaatttgttttgaaggtatctggcaattttatactctgcaactatcatgcaaacctagacatagaggattttcatcacctcagaaagtttatttgtgatgctttctagtcaattctccacctgctcccagcccagaggtaaccagtgttctgatttctatcactattctggaactttgtaaaaatgaaattatgcatgcttttgagtctgggtttctttcactcaatggaatgttttagagattcacctgtgttgttgcaaatatccatcgttcattgctgggtagtactccattgtgtaattatatcaccacaagtttattcattttcctgttgatgggtaattagattgtttcttggttttggctattttcaataaagctgccgtgaatattcttgaacaggtcttattgtgcatatacgtttgcatttctcttgggtacatacctaggattgaaactgctgggtcatagggcgacagatgttttaactttatatgaaactgctgaacagttttcccaagcgatggaacaattttatgctcccaccagcaaagtgtaagagcttccattgttccacatgttcactgacatttggttatgtctggtgggtttgtttgtttttgttctaatcattctggacagtgttctgtgtaagaaatatctgtctactccaagatcgtgaaaggattttctcgtagaaacattataggtcttagcatttaggttttagctctaagatccatcttaaattaatttttgtgaatgctgtaaggtggaggaaagaagcagatatccaattccacattatttgtgaaaaacactgtattttcccattgaattgtctcagcagaaggagtttgcttttattccaagtgagaagaaagttgctggggtgtcttaaattttcctcaaggcaataatagttgtcttgcataatagtggtctactttgcatattagatgtttattgcacttttaatacacatgtgcatgcacattgcacacactttgagaacaggaactacatcttgcttttatttttatcctcaacttcagtacctagagcagtgcttggcaaaccataatcaatgaaagaatgaatgaatgaattccagcaaatgacataactttttattttcctgtgtagcctgtggatgtactcatttgtctgtgatgtactcacatgtatgtactcacatgtacaaatgagtacatgtgatgtattcacacacacacacacacacacacacacacacacacacacacacacacacactctcacagccacttgagtcgactgaagagatcagagaagaaaagaagtgaggcagcatttactacaacctaaaagccaagcctcagaagaagtgagagcctggaactatgagccttatgtatgagcagctcttgtacaaaagagaagtgagataaaatgggtcaggagtctaaaagatggcaatcccagtttacctttgcttttatcctactttgatcaaataatgagtacatgtgatgttctctttgtcaaatgtactcatttgtctgtgttctatatggctcccacacatactatgaccatttccacttgaggttgttagtctcagatttatgggtcattgataatgtacatgcaggattatatatttcttatatataccacataaacctatgctggccccttacatggttaacttagctgctatttttgttttcacttctacatgccatatttggggtagagaagattaaaaagcatatgtggacaacacagaaatggcatctggaaagcagccgtgttgcagcactctcaacttcccttgaaaatttccagaaaggctcagaaacaagaaaaaaatctcaccacagccacaaaaagcatgcttgtcagacagcctgttgccaagacccaggagccacctccctgagggaagcagagatagaaggagtggagaaaggcttttatgcctcccctggagttttccatttacagagccccttggtctattccagccagaaagctgagtccccctcccatttttcaaggagctgattccttttaaggcaggcaaaaagctgcttcccattcacccttccttctttctctattcacccaacctccacaactccccaaatccagtaggataaaaaaagggagggatctttttccctcccttgaagcatgtgtaaagcttaactgcatcctgggaagtgtagttccagcacttaggtggatccaagaagtaagatttatggcagaagtattctacatgctgggattgtagcttttcatgcacagggtgttgagtcagcgtctcaaagaatcagacaatgacggttaggagcaataccccacccgtgcagagctgcattagaatttagagttaggttagaagctgcgcaaacacctgttctgcagctgcaggtgtgagatcatcatacaaatggagggccggcattgatgaagccaaccccataccatgtatgactgctgcctcaaagtctcaagaaagctcaccttatttaaatatttatattgaagaagtaagttataggaaagactacttggaatcagtgaaaaaattgttgaagaccccaggatgtctatttcaggaaccaggagaaagtttcaaaaattttcaaaatatcttttgaaatgtaagccttccttaggcaggcaacactttctaccttgcattatggttgtttgtgtgcaacgtcttaatacacataggcatatacatacatctgcctgcacactttgataacaggagacatgtctttcttttatttacattcctaacatcagagcccagcacactgcttggaatgtcataggaactcagtgaatgaataaagaatgaattccagcaaatgacaaaatttgctctttttttcttattgagtatgtggatgttctcatttatctatgttctatttggcctttaagaaaacagaaatggaaaaccacaaggtcataggcatgggagtgggagtgaggtgaaaatgaaaatgtgaaatggataaaatctgactgaaagttaacaactcaagagcagaattaaaattcgtattagagtcaacaaataactgaactaaaccagagaagaactgaataatgattggagaggataaactggaaatctctctcagaatgcagagaaaagggaaaaagctatccatgtgataggagagatattgttagatgtggagggcagagaatggagttccaacctcaaaattataggtattttgagttagtaagaataactgaaacagaaataattataaagactttgaagaaacaattttctgtactaaaacaaagaatatggttgtcatactccaggcaaaatgaataacaatttttttatgacaaagagaaagaaaaatatcttgcagatctcagctgatatcatctagctgcatggcgtgggcaattttcggagcctaattttcttcatctttaaatgggaaagtttccagagagtcactagatccctgctagacgtgactattttatgatttcataaatgtttggaggactagagggtctaagacagcaattgactattttaacatctcatttgagatagaacaagcaaagaacaattgcaagtcctcccaaacaaggctttattgccccttaatataatttgctccagtgcattaactgggattccaggaatgttctaagcaccccagatgttctcatagtaacatcaggacctcacagcctctggcaacactacctgtttttgacttcatgtggagcagaaacctcctgatcacaatgatgtctgtcaaatccagcattaagattttgaacactaggaccctccaacctcccagcagattttggcacacttcttgctctctcctctcttccggaagactctaggactaaggcatcttctccatgagctccctctaagtccatgcatgccctcagtcccaataatttttggcttccagagctccttcttctcagcccaggcaccaagcaacttttcagcatttattcagcatttaaatcaacctcaacagtgaacacagccttcctttttgctcattttcagagcccagcgatttcatagaatggcagggcatcaggtccagatcatttagaccactgccatgaccagcgataggtatggactccacttaaaaataaggctcgtagccgggcatggtggcacaagtctgtcatcctagctactcaggaggctgaggcaggagaattgcttgaacctaggaggcagaggttgtagtcagctgaggtcgtgccactgcactccagcctgggcatcaaagtgagactctgtctcaaaaataaaaaaaaataaaaataaggctcatagttccaggctctcatttcttctgaggcttggcttctaggttggagtgaatgctgcctcacttcttttcttctctgatctcttaagtcgactctagtggctgtcagtgtgtgtgtgtgtgtgtgtgtgtgtgtaggaataggcatgaatttaccagccagaatatacacacacaccctttcctgtcttgtcgtgtcctgttttaggttattcaaaatgttattcagtggccacatttacagcaataataaaaataggcagaagtcatcaacactatgaatagtaaacacatttagaaaaaggtggcagacaataacgacgtctgggaagtgtttcagtggagtctttcctcacatgagcacgcagtggtgtggctgccagaactccctggcttctgtacttgatttacgcaatggtctgggttgccctagttgtaaccatgcagcttggctctgggcttcataaattcagaccccagaatacagtttatttatgttatgactccatccaaaacgttgcaaagaagccaactcccttcatcccattaaaaaggtataatatgtatttttactagcctgcagagcttggcattcagaggtaacaatatgtgctttgttactctgcaggtttgccgtgaagtgtgctgtaatctttgccaggggtgtgctgctctctcccaggagggttcacagcccgggaggaacacttcagactgcttaacgacttgctcgggccttgccttatatggaatttttccttctgcacaagagaatgacaaccacttagagtgacagccagcagggaacagatgacagccaaaaatccactgtgctcttggtcccaggatgtcctatctgacttgaacttttgctgtttaggcttgctctctgataatgaatttgggaatgccaacaggtttggaggaataggagtcacttagaaaagctagccagataactccattttagaaagcatgggggaatgtctttcccattaatcctggtaagttagttaacaagcacagggcacaataggtccccaaataaatggaagaaatggtgcaaaatgcaagctacaaagtaggtgtttgatcatacacattcatattttattatttaatttgattcaatcttagggtcagagctaacagaaataaatatatttattattattattgatcaataattattagaaccataaagaagtgtcctcacactcagagtctagtgtgctagcccagtagagagacaccaatgatatccccaggaggtggaagggaggttggtgtggatctggttcaggcactgctgtaaatgctttagatctactgtctcagtgaatcatcaccacaaccctatgagatagtcctattttatcttcattttgcagatgaggaaactaaggcacagggagactaagaaacttgcccaaagtcacacagctaggtgtggctagatgtggcttctagttggcagcagcctagagttcaaatacaggcagtcttgctctatgaagattttaacaggcacaggtggaagagggcagtgcgtgtggcagagatgtcagcaagaacatgagaaaggcatggagtagagaacagggacatgtccagttggattggagtatgggtaagagggttggaggaaaattacaccataaacacaagctactgccatattgtggagggccatgaatgctgatgtgaatatactgtaataaatattgctaataataaaagccaatatttctatggttttatattgtgtataatatctgtaatagcctagctttgtttttacaggtgcccaaaaaggccaccagcagatggattcactaggctcatttctctttgcccttgtctttcaagtggtttatgtcaggctagcccccaggccaccacgctgattttcagttaaaaagtcactggtattgaggttttttaaaattataaatgccttcttaaacagatgttttactctagaaatgtttgttaaaatatattctattcaatttctagtaatggttagcaaatttgccttgacgttcttggggttcctgtcttggcattcatgcagaatttgatataaaattatatatactcataagaagaaccaaagaaccaaatagttcttcttgccagtcacttggagattacaaaacagcatttctgagtagaaggcataatcaaatatgatttcatgaactgatgcatatatgagttagaggccaagaaatattgaatcatgaagtaaagttcttctcatttctaaaatactgtaactccataatttttttcttttttttttgagacagagtctcactctgtcacccaggttggagtacagtggcatgatctcggctcactgcaacctccacatcccagactcaatggattctcccacctcagcctcccaagtagctgggaatacaggtgctcaccaccaggcctggctaattttttgtatttttggtagagacagggttttggcatgttgcccaggctggtcttgaactcctgagctgaagcgatctgcctgcctcagcctcccaaagtgctgggattacaggcatgagccactgagcccagctggctatatgtccataattttaaagattacaaatgactctatcaaaagttattctgttgacagtttcaacacaatatttaccagttgaaactgatttttatgctcttggaagctggtggccaccttcttatatgtatgtttggtttattctaggatacttagttgattaaccacttggaatgaagtagagttgtgttttcttttttttctttttttaactgtagcagagtgaccaagcatgcaaaggagggagagagaatatgatccatggcaaatgcaaataccccctatactctttccatctggacttggtgaattgggctgcccttctgcagttgagggtacatgaacagcccagtttctcattcccaaaaggacactagggtttgcagggaatgacgcactacaggggttcccaagacagctggggcatcggccttaaacatgaggcgataggagcagctcttgtacagaagaggagtgagataacatgggtcaggagtctaaaagatggcgatcccagtttacctttgcttttattctactttgatcaaataatgtgtgatgctaacatcattgtattggaaatagaatcatgatgcttcctaagttaaatggcagattgcatgtactgtcatgtgtcctatctgtcatgatgctgacagttacacaattttgctctggaaactgggaattacactttgattttggggtagagggtgttatattggcttgctaggctgccataacaaagtaccagagactgggtggcttaaacaacagaaacttttttgctcacaattctggagtctggaaggccaaaatcaaagtgttggcaggattagtttcttctgaggcctctctctttggcttatggatggccatcttctccctgtgtcttcacctggtcctccctctgtgcaaggttatgtcttaatttcctattcttataaagactccagccatattggattaaggcccactctgatgatctcattgtgacttaattgcctctttaaagaccttatctccaaatacagtcacattctgagatactggggataaggacatcaacagatgaattttgggaggacacaattcagcccatatcagatgtgctctcccttagggggttctaagacaactggggcatcagccttaaacatgaggcgatagaagcggctcttgtatttctgtctttagtcccttggtctgcccgttagtccttctagaaggagtccacttgacagatcatgatgcccttcagaagtacccaggtctctcacagtatctagcagggcctccccaggctactccaacagactattgaaattagtcacgcgccccaccatattagaaccactttcctgggcctaggcaagtccctagtgctggggaataatcactggactagtgatcaagagatctcgttcttgtctagattgctgctggcttgctcttgggcaagtctttttctcatctggggctgattttcttacctaagaaatgttgagctttatgatttctgaggttggctatatgtgaattgccctagtaagtgcaaatgtgttttcataggttagaaaaaaaaaaaaagcccaaaaagtattttctgggaattgagagttgtaagcacctacaattctagaatatactttattataaaagttaaaatgttatgcaatcctatagaaaaattcaggaccattttgctgttgtctaaaatcagatgtgtgatctccatcttcttaatttgacagacatttgccacaagtcacttccacaccaggcagagtgctgagcactgtgagaaggatgtgggaattcagaggctaataagttctagtcccctgctcccaaggagttcgttgtcaacctgttttcatcactggatgtttagaagccttggataatatcaaaggtatctatgttggagaccatgggcttcaatttctggctgtcttttggcatttagaacctaaacagctctgggctggtagacatcactgacatgactttattgttcccatgagtgaacatctgcatgagatcaaaagtagtgatttcagtgtcaccaatattgaaaaatacagaaattgaaattgtaggtaaacccctggatggttatagttaaggacagaaagacaaggagtgaaagaaactccgtgaaacaggaaatgccaagaaaagcctatagcttccctgacttgagacaaaggctgttgactagaatctcttgattcttagtccagtgattattttctagcaatagggacttgctcaagcacaggaaattagttccaatatggtgggggcacatggccaatttcaatagcctgttggaatagcctggagatgccctgttgcatactggcatgtttgattccttattgaaaacagataaaatatatacaattgcaaaattcatataattctgcaaaagtaatataatgtaaaggaaaaagaggaaaaaaagttctgctaccatgttaaaaaaatcatgcaatgctaagtatgatacctgaattagaatggtcaagggtggccaaccagtggagacaaaactcatttccttctcatcctcagagctctgccctaggacgtgtgtgtgtgtgtgtgtgtgtgtgtgtgtatgtgtgtgtgtctgtgtgtataccaggatgttagcctgtatgaaatttctgggctagatgaaagagaggggttgggattgaggcaagttctggaaaataatttgtttttttctaaaggtcatgatagctacttggatctagccaattgttaccatgaagaaatttttaaaatgttggcaatcaacttaagacattcttttgtaagatatagtatggtccaaacaaaaccatgccttggtcactaatttgcaatttctgttctacagcatcttccagatctttatggttacattaatgatctgaggcaaaaagtgcaattcaagacaggtttctttcccaatgaagaaatacaagataggacccaatacaggcagagacccttgcattccaccctcacccctgcttctggcttcctaagcaaactgtacaatctacttaagtgcgatgtccatgtgagtctttcaaaatatacctgaatccagccaggcaaccctagattttcagttctgttttgtttgctttcaaatgattttcattcagtattccactcagaaaatgtctaaactgagtggggaactgcggttgagttgggcatatacaaggatatcctcagtttgaatcttccctaaatatccataagggaaaaaaccccactttaataataaattattcaaatgtgcattcgttcttgaaacattttaaggatgtttacattgaaaccagatgcctgctccacagacagcccccgtttctgttgattttacagctctcctgctcacttcagttttctcagtagggtctttgttttactcactagtaaaaagaatgtttcttttgtttgcttttctttgccatccgcgctgaccagactctagagggaactccagccatgctgtgatttggctagcatccccttcatttcactcctaaaagtcatatgtacacataatagtaaatcgtttctgagacctcatgcgcttgggcttttcctagctcgttcttcttccatgtggttggagttttgcagcagtttgagtaacagttcaatcatgctctcaattaaagaagttgagtcagttcatgatacccatctcatagagcaagatgaagctaggatttctagggaatttctggccgttcaaaaatgtcatctgaacccaaagcttttatttctaagctgagctgaatccatcaccgagtaaagagcaggagggagaactcatttgttcaaatgcctgcaggtattggcctgagggaatatggggagaatagctattcccaaggataccctttttctttcttagtggttggccattcaaagtgtagcaagaaccagaaaggtgagctatctaagtctaagaaaaagtaaaagtcataaagataactaagcaaagcttttctactcacactctatttggcctgattggtcctttcatgtattcatttgtttattcaaaaaacatttattgagcacctactatgtattgctaggtctgtgctaggtgctgtagtgcatatctcttggtggaggtggcagaagagtccagaaaattttagtgcggtaacttatatggcgagaaacacataggataatgggacactggagaaaggcattcaatgaagaccagttagagtgaaggtagaatgcaagaagacttctgggaggacgtggagcctgaagtgaccatgagtaggaattagcaagccacagcttttcaaactttcacatgcacaggaatctcctgggaatcttgctatactggtgattttgactcaggtctgggatgggtcctgagagtctgcatttctaaggagctcccatgtgaggccaatgctactttgggtaggaaggagataaatgatgacttgacatgggaaaagagaaagagggattgaagaaaacatttcaggtagagggaatggtgtgtcaaaaagcctagaggtgtaggagcatgtggaatgtttggtaagttgcaaataactcagaatgggagaagcccaaggggatgagggggaatgatgaccttgaatctggaagcagccatcatattatgaaggaccttgaaggtggtgctaaggatttggggctatttcctaagaacaagaggaaaacactgaagagttttatataaaggaatgataagaaccacttcattttgaaaggattactctgattgcgatgcaacagatggactggggaaaatgccacctagaggcaagagaccagtagccgggcaatcttgttcatccagttgagaaaagatgaggtcctgaacataaagagtagcagtgagtagagagaaaaagcaactggctttggaatattacagaggttaaatgatgaggagtactagctggtcaagaagaggagaggcaagttcaagaactgcctgttttctggctttagatgaagttcactccatttcaatcctggtcatagtgtcccgcttcctcaagataatgattggtgaaccaagatgccacttggagtttccaagagaaaataccagagccaggatttgtacccatgacttcttgattcaaagcccatgttcattttaccatactccattgcttctcagtggctttcttaaagccagagaggagaaattcggaagttcccacccaagttgagtcttagagattttactactgagcgctgaagcacaggggagggatcaaggctttagggaatcagagtggctggggtacttagtggttgtttccaaaaccgttccagttctgctctaataatgggggacggggaaaaagagggtgcctccttcctcagtttgccatcttctttttccagcttccaaaagcatactcgaggaaagccattggaaacctgtcaagctgttccctagtactgaaagacagtttgtgacaaaacaggcttttctgcgcccttgggctttctgtgactttctcaagatgtttgcagttgatgatctgcatgcaagcaagccacgttgacagtttctgacctgtttccagcacctttgcaagtgtgtgtggaagaactgttcagattcattttggatgcttttccatatatcatggggaatttgatctatatatctcagagtcacttaaagttaactcatcgaggcagttagagattgtgcctatcgtttactaaattataaaaaggattaactaagactaaaagccatccaagcattggagttcttcacttctttaaagtaattgaattcagctcttaactttttaaaaatcaaggatactacatttttcggatttcaaaaatgatacaagtttattgtagaaagtttgaaaaaaatacagaaaagactaaagaagagaaaagagtaattataatttcactgccccggtataactactgtcaacaccttggcatatgacctttccatcttttaaataaatctgcatatacacaacttttcagtgattgttactgtactctgcacattgcttcctcgcttactgtacattaaaagttttcccttgatttttcctttattagattttattggagtgccaaatacaaaacatgtggcatgaaagataaaacagaaaaagtaccctctaaggtatccaaggtagcttggactcttatttgtaaaatcaagaccagttaagctacttctctaagatcacattagttaggaaatgagcaggactacaaagtagaacttatattaagtccattgttttggttactgtgaatcctataacagaatccaaaagctgagaactagaagtaattttagaaattatcaaattcaacttcttcattctctcttttttgtcttgttatggtaagaacacttaatgggagatctgccctcttcacagattaagcgtagtatacagtgttgttaattatagtcacagtgttctatggcagatctctagaacttatttatcttgcattttgtcattgacttcctccttcccatctgtcttagtcagtttgggctgctacaacaaattgctatagactgagatttctgagacaacagaaattcatttctcacagttgtggaggctgggaagtcctagatcagggtgccagcttggtgagggttctcttcctagttggcagatggccttctggctgcattctcacataactgagaggagaagcaagctctcttgtgtctcttcttatatgggcactaatctcatcatgagggctccaccctcacaacccaattactccccgaaggcctcaactccaaataccattacattagggattagggtttccacatacgaatgttggggaacacaacattcaggccatagcaccatcctaataaatggcaccactatccaaccagttgcacagactccaaacctagtcatcattgctgcctctagttcctcttgccctatagcctgtgtataagcaagttctgctgactctcctgccaacaccaagggctccttagaacctccacctctgccacccgagtctaagccaccatcacctcttagctgcacaaattcattggccttctacctggtttccctgcttcctctctcactcacccatccccactcccacatacgtagcagccacaagtatttttaaaatgtaaaccagaaaatgccacttccctgctcacactcctccaacagcttctcattcaactgaaatccaaattccttatcctgaccaacaaggctctttataactggtcctgccagttcctctttcctcacctcccaccactccccctccattcatgttgttccagccacagtggccttcagactctttctgtaatgtgtccagctggttaccatcctagactattggtctcattgttccctctgcctgaaacctcttctccctcatctttgcatggcgcacaccttgtcatttgagtataggaacatatttcctgacaactctattgaaaacagcccacagccaggtgtggtcgctggtacttgtaaggtgggaagatcatttgaacccagaaatttcaggctgcagtgagctatgatcatgccactgcactccagcctgagcaacagagtgaaaccttgtctctcaaaacaaaaaatagaaaagcaaaataaaatagtccccagcccccacctccacccccttagtatccctttacactgcttaacttttccataatgccctcatgactatgtaacattaaatatttatttatttatttattatatgtgaggagagccttgctagaatgtaaacctgatgaagacttcaaaacccctggaacagtgcttttgcacagagtaatcatcatcaatacatacttggtgaaaaactgtaaaaatggcagcacaatcttttatcacagagatgtaccatgataagcatgcagattcattttgatttttcatcactgcacatgatggtttgatgagcttccttatacataaacccttgttcccatctctagttatgttcattactgatattccaaggggcagaatcacctaaatcaatgggtatatatagttataacacttttgattcacatcaccaaatggttcaccagaagacttgcaccatttatatacatacagataccaacagtatgtaagtctgttcctcaaaccttcactaatgctgagtgtgattgcttttgaaatcctgcccactttgatagtcaaaataacagcgtcacattttgtgtttctttggatatctgtgaaatgaacatttctctcgtgtctgtttgccataggtatttatttgtatgtgaatgtgtgattggacccatgttctactattaatcttcatcttttttcttattgattcataagggctgaactgttgatctgttacatacagatgttgtggatatgttttcctattttgttgtttgccttttgattttgattgtggtgctatcttttatagacatgttcattggcttttggccaattttatcagtttgttcttttaggatatgtcctgttccttttacacccaaaagtcacttttcaccctgaaattaggtgtttactttttatgcttagctctctaatccatgtggagtttatctgagtgccagttgtgggatatggattcaaactgtagttaatttctccccagaagttaaccagatactctatgcactttactggatatcccattatttcaccaccagttggaatttcaagatttatcatatactgattgctttgaatcacttgagattgttttatgcatggttagcttttagtaattctgaccatctttaattttttttgatgagtacatatttatagggcacatgtgatattttgagtacatgtatagaaaacctaatgatcaaatctgggtatttaagaagtctatcacctcaagcatttatagtttctatgttttgggaacatttcaagtcctctttctagctattttgaaatatacaatacattgctgttaaccataagtgacctattctgctattgaacataacgtgttctatctatctgtatgtttgcgcctattcgccaaccactctttatccccacctaccctcatacacacccttcccagcttctagtaaccatcattctaatctctacctccatgagattaacttttttagctcccacgtatgagtgagaaaatgcaagatatgcctttctgtgcctggataattttacttaacataataacctccagttccatcacattgcttcaagagaacatttagtggcaaagaatactttgtaagaatcccatactgtatctccttctttcataccaatgcgtggtttaatatataataaccttgtttgaaataaaagcctttgatgcctggtgcccttaccacttatgaagtaaccatcggtttccaccactaaaagtctcctatggtcacaaagtcctttgtgaaaaaatccaaaggcaaagagagaggcaggtctgccccatacagaagttcaagctgtgcattgcacaactccaaggagtgtctatcacatagcaagttatataaatggtgccccagagtttgatagtccgcaatatgtacagttgtgtgcattgatcatgaagagagaatccatgttcacttcccaattcagccctcaagaaaaccaacacgaggtcttcgacagcttactagatcttagagatcaacttcatcatttacagcaaaacatgccaaggttcaccaaaaatgtataggcttgtctatggtcataagacttagtgatagaaaagggatagatcccagatttctctttttttcattgatttatctatgtaactttttatgtatttcattgatttatctatttcattttttctttactttcaagaaggtaatatattctcatggcccaaaattcaaaatttatatccacaaaaactgctttacccatcctaaccccctcccaaccccactgagagttcccataaacaaaccctaataccagttggtggcatatctttccagggatagtccaagtatatacaagcaaatacagccatacattctccaatcactcccctttttaacctaaatactaacatactgcacactattctgcattttgactttttgatttataatatatcttcatgcttgctccccatcagtgcatgaagagtttttccatcctgtcttaaagagaagttgtgtactattgtatgatatacaacaactcttttaaccctatggatggacattcatttgctattagaaatagtacgacagtgaataatgttgttctcatatcattttgagcatgggtcatctgtaggataaaatttgtggaagtgggattgctgggtcaaagtacatttgtaattttaatagacattgccaaatggttctctataaaggttgttccgttattagctgattttcttatatcatcattaacactgctagcaaacttggtacattttgccagcccaatgcatacaagagagtgcagtttgtgtgtgtgtgtgtgtgtgtgtcaatgtaaagacaaatatttctttaaataataatgtatttgtattattttttgcagtggaattggaaattttctcacagtcctatccagatgtgcaaagaagtggtagtttatttctataagtgacctaatcatccactgtgtacatttgctgtttaatgaaatctcagcttctcccagctttaacatgtattctcatttaaagatttagaaagataaagtaaaagggtggggatcagattctgcccttcctctattctttcctacaatttgagtctcatgttggctcttttgttcatttgtttttaattgactcatgatagttgtacctatttgtggggtataatgtgagatagtgcagctttcatttgcctttctcttattatgagtatgtttaagcatcttttcttgtgtttcaagctatttgtattttctattctgtgagctatttcgttcctttgctcattttcttaaaaaactgagctattggtctttttgcttactaattaatagaaagagaagtaactttttcactagttatattgaaatagaacatcttttcatagtttgagagccagtgtattttctctcctgacctgtctgttggtatagttttcccttctcttcttttggggtgtgaatctttttgttcttgatgtatggagtcatttatgcattatagaacccagatttttggaaccctattcccagcctcttacacttagatgtgatgtatcctcatttcttcattgcacatttcttcatttcatagaatggtagaatgttttgtaagtgtacatgtaaaaattaatcaattccagaatcaccacaaactcagaaaacatggcatcaaaacggtgattctttaaggtgcaagatagtgtgaatcatttagtctccagcaaatgcatccatcataatataagaccttttagaattagaaaaataatcaaacctgtaacaaattttgcaagcaatttataaacaggtgctagaatctaagatattggtgacagtagagaagcaaacaaacaacaacaacaacagcaacaacaacaaaaaccaaccagtgattaattgtaatcttttaggcccattttaaatgcgtcctcctccatgaaatatttcttggtttctctggacggatgttgtttctcttgcctctgaattcccagagaactttgtacctctcttagggaaattatcaatctctgtcttttattatagttagttatgtacatgagtatttccaggagcactgccaatttcctatactgatcatagatttttcctaatgaaaggctcaaaggtcccaaggcaaagtattcttttttgaagtaaggttattgtggtgtaatttatatatggcaaaattcactcttttcaaatgtacagttcaacgtgttttgacaaatgtatacatgcatataattacctccaaaatgaagatacagaacatttccgtcaccacagtgttctcttggtacttctgttgtcaagccaccctcttcaccctcagcccctattgatcactgattcgatttttgcccctatagttttgcctattccagaatgttgtatgaaaagaatcatgcatcctgtagcattttgtgtctatttttactctaaaccgcagtactttaaaattaaacacgggaaataatttactcattgctttgtggaatttaggttaagcagacttgctcaccaaaatcatgccagtagttaggcagtggtcaaaaggaaggaacaaagaggaaaagggagggagaacagaaattgagaaaaacacagaaggaaagtttaatgtttattataatattctttattgtttagaaattattttctatagagcacgtccaacgtctccagcattttgtgtcatcttcacgataactttacaaactgttattattcccattctgcagatgaggacgctgaggttcaagttatttgactgacttgtccccaaacagaaccatagaaaaatgaaaaatcagcattgaataaactctgatttgaaggacattgttttgtggactccttcaggcttcctcttccccaaattctagtaagagagagttaacgagaagagctgtcagctctggaaggaagagcttctcgctttcactcaccattgtaaacccagaaactagcactgtgttagcccactgtataagaggtgttcattaaatattgttaaatgaactcacgaaacaagtatctgtccttcagatccttagagtacaaatgcactcaattttcctccccaagagctccctgggagtttttttcaactgttgcattttttttctcattttttaaagtttccttttttactcaaagtaaaacacaaatgatttctcaattcctgtaactttgtgtcagggcacattatcccaacacatgcattgaaggcgtgtgactgagtaccaccttttggattgtctgtcatttgaataaagaatatggtttatgttcattaaggaccactccagaggtaaccttcagctaatcatttcttatgttcttcatctagaccagtggagtaatgatcaaacataaagtgatctatttgaatgaaaaacaggctatacataaaatggttttaaaatgaaaagaaaatctaatcttatggcattttaagatgctgacaaaccaacagggtatgtggaaaattccatccaaaataatattattgctttcctaaaaccaacctgaatgtttgaaggcagatgaataggtcaggaattataacagtatctattactttgtggattgttgtaatgtctgaaacaaggatagaatttttttttcaattttactttaagtttcgggatacatgtgcagaatgtgcaggtttgttacacaggtgtacatgtgccatggtggtttgctgcaccaatcaacctatcatctaggttttaagccctgcatacattaggtatttgtcctaatactctccctccccttgtcccccacccccaacaggccctggtgtgtgatgttcacctccgtgtgtccacgtgttctcattgttcacctcccacttatgagtggaacatgccgtgtttggttttctgttcctgtattagtttgctgagaatgatggtttccagtttcatccatatccctgcaaaggacatgaactcattcttttttatggctgcatagtattccatggtgtatatgtgccacattttctttatccagtctatcattgatgggcatttttgttggttccaagtctttgctattgtaaatagtgctgcaataaacatacatgtgcatgtatctttataggagaatgatttataatcctttgggtatatacccagtaatgagatagaagacatttatgctgtcaacaaacatatgaaaaaaagctcatcatcactggtcattagagaaatgcgagtcaaaaccacaatgagataccatctcatgccagttagaatggcaatcattaaaaagtcaggaaacaacagatgctggagaggctgtggaaaaataggaatgcttttacactgttggtgggagtgtaaattaattcaaccattgtggaagacagtgtggcgattcctcaaggatctagaaggacagaatttttttttttttaatggtattgtttcatataaacctatgtagttcccaaagaggtcttcaaagtgttttaggtccctgggaagtttttgatcttttgaatttctcattttctttttacataattatgtctccaaaatggctcctcttttggcaataaactttgatcagtggaagactagtgacacctggattctaggtctaagtttccacttttaatttaaatatttgtctatttaacaccctggaactttccaatgaaattccatcctagagtataagaaaagtctttattaatctagatgtgtagggcagtatagatattcacctttaaattaattgatcgattatcctcactgaattgccaccccagacccacagaagggattattggagctggcaatgtcttgaaatggcaatgtccacatggaagtggcattaatacagcagcctttgtgctttgtcattgcaacccaggccaatgtaagtcactcactgtgaggcaggaaaaaaaccctaagttattataaaggggcaaaagctacttttatatacttttcagaagtctcttgccttggagctgagataatgggaaattttaaaaaggaaaataggagaatgacatagacaagtgactttttgccttggcagacatggctttcctaccctccttttatctcaatgcccctccttcccattccccagggggtggaggggaggaaagagatgggaatgctgagaacagaaaccagagtaaacattaggattttagggtcaggaaagagctcaaagatgttaagaccatgtggccagagctggccacatgatcagagccaggcacatgcctatgtggacagagaagccaagagagaccagagggcagcactttcagggagtcaataagggtagagccttttcaaggatataagtggagagagcaaaggactccttgagaagcaggtcccaaaagcagggctagagagttggacaggttaacatatcccgggggtcactgtggcatgaaaaacagaagctgagggaaactcagagggcggagggaccacaaaagcctgaaacccagaaggctggcctcctcctgcccaccatccattgccaggccctattcatcctccccgcctcctcaaatctgcccttttctctccatctccatagagctgagaccacgggctatactaccagactgtcggtaggtaagaccctgccctgcctcctacttgctttgcaaccctaggtcaaatacctaacttctctgtgcctcagtttcttcatctgaaagatgggaatgatactaccatatccagtttaggaactgtttggggtgccaaatgaattgacacctgtgaagcattcacagggtacttaatattagtttcttagctatgttagtttcctagggatgctgtaagacatgaccactcactgggtggcttaaaacaagagaaattcactctctcatagttctgggagtgggaagtctgaaatcaaggtgtcagcagggttggttccttctggaggctctaaggaagaatctgtccttgcttctctcctagcttctggcagctgctggaatttcagagatgcataggccctcaatgtggggtgggagggaagtaggtggaggtccttggctcatggacacattgctccaatctctgcctctgtctccatgtggccttcccctctgggtgtgtgtgtgtgtcttaaatctctttctcttatgaagacattggttattgggtttaggtcccaccttaaattcaggatgatttatctcaatatccttaactaaattacttctgcaaagactctaagtgaagtcacattcacaagtacaaggggtaggacttggacagatcttttggacagccactattcacccaggtacagtcatcatagttattactttcaattcaggctcctattgtctcttgactatactcttataatagtctccttgcctgcagtcttcacacagcaacccattctcagtaaagtatccccagtgagctttccaaaacatcttcctcttttacaccctcaagtggctccctgtcacctgcaggggaacatctgacatgctgaactagacccaacctggagcttatctcatctccccagggccatctcccacccccctccatcttgtacatccttctccaaaacagggtgtctcccagaactctaaacacactgcgctcttttacacctcctggcctttgcacagcttgttctctctgcctatatactacctcccccctagcccccattgagagcctatgcatccttgaagttcagttcttatttcatctcctctgagatgccttcctggacccttctctggcagttcccctagatcccaagaactgcctccttatccttactgattcttgagctcacccctgtcatcaaactgtatcaactgattcccaaagatctattaatgtttctgttgccccttgagagttgcaccttattcaactctgcctcaccgatgccagtgcagtagtggaaggtgttgaatgatgaatgactggtggatggatggatgaatggatggatggacggatggatggatgggatgggatggatggatagatggatgcatgggtagatgaatgaacggataaagggatgaatattttttaaaaaaaagaaaagaaaactctgagtcaggaatcatttggaactacaaggtgaaacctggactaaagctaggaccatctgtgatgagaagacctgagcagttattagtgaggaaggaatgtggatactcaggattcatatctttgtcatataaataatgaacagccatgtatctgaactgccccatagatgatgccaaaagtaactgctgagcaaactcattatagctctgattctttttaatgtctaaagccttaaaataaagaaacccctttgggagtggataaaacgtggttctcacatcttacactttagtatgaattagatttacctggtccataagtttaaaatgtggacacctaagctccacccccagagattctgatgaagtcagtctgaggcaggctcagtgatttgtgaagaggttaaaattgcaaattctggctctgccacatctgtgctatatgaccttaggcagttccttaatttttcatgtcttaagtggagacaatgctagtacttcttcacagaattgtgatgagttaaatactagtaagaagagttcagcacatgtaagtgctcagtaatgttacctgcagtcattgccgtcttcatcaccatcatcatgatcaccatcatcatgatcatgatcatgatcatcatcatcatcatcatcatcatcatcatcatcatcatcaatgacatctgtggtttttaatagtggctgcatagtaaaatcacctgagaaatttacaaatagatcctgatatagttagtctggagtgggcattgggtaagggtataattttagagcaacccgcctttaaaagtctgatgtgcagtcacagttgagacccagccttgatctgtgcttctcaaacttgaattgtgcacagatcactagggcagtttgtaaaaaatgcagattctgattcagaaggtctcagggtgttgataatctgcatttcaaacaagctccaggtaatgctgctgctgctgtcacagaccacagtatgaggcatcaggttttaggggatgagtaaaacctcctgagcctgagatgcaatgcacaacatggtcggggacttggtatcaacccagtgaccaattgtgatggaggccacatggttcctggttatacccaggcctgtcatatgcagagtgtcacatgcctgccttctggaattcccccagctcctcactaatgtcccagggaggagaggcaggcaggctgtcttgggcttctctgataagatatgtcaagtgtacatgcattaccttccctactgtctggggagtcctttcggaaagcacttaaggacatgctatgcactgagcacttagctctttatattgtggagctcagggtcaacgttttgcccataaaagggccacttgtgtaggtcaaactgccgagtcaatgaccctgcccagtgggaatagtattgtcacccctgtttttggcacaaatgatttgagtgttttccaaacatcattaaatgccaaggtccctgaccctaaatgtggttcaggtgtagggactcagaggcccacagctagactgggcaagggaggggtagaagattaaaatgggaatgactgacaggcataggctattaattctcaaaggttggctctgcatcttcttgcagactcattgcgatttcctcaaagcaaggccttcactgcctggttgtgcatcatagagttcacagcattgtgaaatcacccttaaggcaaagctgacagcatctttatttattgtgcatggatttcatgttaacctcatcatccttttgctgcatgttgataaggcagaaatagtgagtcatttaaatagcggattacaaagactctgatgtagtaaatctaccctctaggttttcatttcataaagaatctgtgcattatttatcatcctcatcagcagaataataaaagccaacacagaccttctcatgaaccccataatgtagatattattgtcctcagtttacccaggataaaattgaggcacagagaggttaagtaccttgcccagggctcccccatgccaataaatatggagctgacgttggaacccagagccttgcagtgccagtgctgttagccactgtccccgactccatttgtgagaatgctgctgactggcatttatgagagtgcttagtacctgccagacactgtgcctggggatttacatggattatctacttttaccctcaaaacaccgatatgagttaggcactattaatttcattttctgattgagagagctgatgtgagagaaatgcagtgattttctcaagtttaaactcaccttgtaagcttcaaagctgtgattggaaccctaggggtccatgttccccttgctcatgtgttctggcccctcctcagctgactttggatttttgtcccctcctactgctccctccaaccccagagtgaaggtctcctggctttgtccaaacattagttccatcagggccgccccaccggcctgtgcccaccctaataccacttccttggagtcccttttgccattggagatgatgcattcacaggttccagggattagggcgtgggcatctttggaggctgttgccccatctacccctaccacaccattttgcaggtctctcacatgaatcctgcaggatcttgctggtttccctgcttacatcttcttccctgcctcatccctggcagctggagtgaccttttaaaatgtaaatacattactttgcagtttgcttaacccctcccaaggccgagatctggtggggccaccctctggcctcctctccctgaacccctcccctcgctccctctgccctgacatgactccatcgctggcttcattcggggctgtctgattgtcacttcctcctcccatacctaaaccatcacccccatgccactctctccccttagtgttggcttgcttcagagcattcctaagttacagtgtgcacttctctactcttaatgtctctctcccttccctggattctaggtggaaaaaaggcagctgatctctagcacatgggacaatgcctggttcaaagcgtgggctaatacatttagcaggatggaaggagggaaggtgggatggaaggaaaagagggagagagggagaaaagaaggaaggagaaaggaaggaaggaaggagggagcaaaggcaggtaggtaggaagaaaggaaggaaggaaagaaaaagagggaaggaaggaaagaaaaacagtgaaggaaggaggaagggagggaagacaggcaggaagaaaggtaagaagaaaggaaggaaagaaagaaagaaatggaaggaaagaaggaaggaggaaggaaagtaggagggcaggagggagtaaagcaggcaggcagggagaaaaaaggaaggaaggaaagaaggaaggaaggatgggggagtcagctcagttgattgtccttttaatgtttgttatctgaggccttattccttaggatgacagtccaagtacttaaaaaaaaagtatcccttttgcctctttcaaatgcatattttttattcttaaattttttattgatacataatgtttgtacatatgtatgggatttatgtgatattttgttacatgcataaaatatgtaatgattaagttagggtatgtgaggtatccagcacctcaagcttttatgatttttatgtgttgggaacatttcaagttctctcttttagctattttgaaatatgcaattttttaaataatactgctaaatgttcctgatacttaagtagttccacacagtcacatactacaaacagtaagctcatcacctgatattattacatctgccacttagaagctgtgtgactggaagcactctgtgcctcagttacctcatctgtaaaattcagataataatagtgctactctcataggctgatatgaggtttacattagttaatatatgtaaagcactttgaatgaattcagtaatatagtcagcaccatgtaagtgtgtattaaatttaaaaatagaccaggcaaggtggctcatgcctataatcctagcacttcaggaggccaaggtgggaggattgcttgcacctaagagtttgagaccagcctgggcaacatagtgagaccctatctctatttataataaataaatataaaaacaacttaagttcaagactatcctctccagtcttctattcatacttttatttaatttaaaaagactgttggaaactttcaagtttttacttgcattagtttgtttctgccttatcagaacccataaaaatagtagtttttactgacattagtttgtttctgccttataagaacccataaaaatactagttttttactcctacgaaagtgaaatggcaaaagtgtacctatgcacattatttttcccaccaatggtcatattcttagcaaataaacgtttcctctgtgggctgggggtgttacaatgtttttaaatagtgggattatcaagtttagggttttattggctcagagggcaagtgtgaaatcttgagtctgtctggtgctggggtttgaaacctgatgcccatgtgtcacttgctttattaagtcaccaccttggaagggctgcttcctccttattaatgaaaagcctgctccatttgttttggcttgcaccaacctaacagtgtctttaaatcagcgacagactgttttccttggaagccacagagtccaatagttttggactaagctcagattctggctagaacttccaaactggaagtaaaatgacttcacccaacagtggttggggggaaaagccaggcaggcttttggaaagtggatttttaatattggaggatatttgtgaaggtgcctgatgagatggacctaacagtgtttgagggtgatgtggacaaaccgttttattattctgtttcaacatagtgctatgttttatttaaatgaatttgcaacttggggtcctgaaatctatttttgtttttgtttccacctagaatagaaagcactttcaagcttatcctgggaggcaagaatagattgaaaggataactactgtatgtagatgcaaaggaggtaccttctcggggagatcgggtgaaggctgttctccctagaagaactaaaggctgggtagacatggagtcagaggaagctttggttgggagaaagacagtggcagtaacccaagcccagagaggggattccttggcatttgtgccttttctgtgccatcaacagtgaaaagaactagagaagggcagctctcagagctcagacagccaatggttggctaggtcagaggagctcttgggctgggtcggagttggccagacttcttgtgctcttccattcatacccaaaaggagcttctgggtcttgaagataaaccactttctcttgttcctctcagttgctctgatattctaagacccagagcagatttttttttttaaccaggagtccatgagtcttctaagaatgtccttggaagaattcaaggaattcctgataccccagaaactatacataaaatgctgtatgcatgtgcactgctctgagaaggagtctatagttcttaccagattcttgaaaggattctgtgaactcttctcccctaaagcttagaatcactgttctggatggtaccaaaaaccacacagtagaacactttatacttttgtctcccacctctgataataaatgcagaatttggcatagtcaaaatgttacaaaaggtttgtacagcatcaaaagaccttggattgcaaattttacaggtaagaggcaatgaccaggttagcaaccagtcaagaacattcatgagcaaatgctggtctagtctgaagggccatcttgggtacacttgggcacaactggtgctgggctgaacatgccactcaggagtttttactggaacacaggcatgtagaaacacatctagaaggatataggtgtcaacatccagaaggatacaggtgtcaacagataagattatgctcataattagaaaatagaattcattgagcatctgcaatatgccaggagctttgtatacattatctcatttgtttgtcacaataatcttatgaaatgaatactattgtatttcccattttacagacagcatagcttaaactcagagaagtcaagtacaattctcaaggtcattaagtggtaagaactggaagataaggtcaggtttgtccaatctatgcttcctcccaacttaagtagcttcatcacatgcaaacaatgatcatggtggcttatgggacaccaattaatctgacaagagctccttcgaggctgtgactttataatttttagaattaactgaaagagtggcaagttgagcattcaatttgcaagtcatgctatgtttggaattaggagggataaccccttttccttcccaaagggactgacaagcataccaagagggggtgggatttctggaactctgtgaagttaacaagaagggacttggaaagttagaagaaggagggggagctgcattccaagcatagctcatggtatgagaaagcaccaaatttggaatgggacgaacagatgaagaaggtgtcaagttctctggggaggagtggagggtactagacaccaaatacagggtaaaactctggcaagatgctgtggtgacttatctgagcctaaaacaaaggagaaccatcccagaatcctagaaatctcccttcccccaaatcaatgaagggaagtttcataatgatggacagagtcccagatggaaattgactacctgttctacagaaaggtcttcaattctaacagagaactctctgatcgcaggaaaagctatctcaatttcaatgacttgtccactgacagaaaatagtgtaagaagggctcactctgggggagtgagaagtaaggcattagaggaggaaagatgataactgagtgggaagaaagaaaatcatgaaggaccaacaggaggcacctgggtcgcagcccagggagcattaatgatcctacctccagttttaggggcacaatacttaatccgacccagaaggtggaatgcaacaacctccctctcctcccctcccaccccagaggcattaccgcagcagataaacaactggcatgaccctccaatagaaagcaagatcacctttgcagcagaagtggccctgccagctgcccttcttctttccgtggggacagacactgttttccctggggaggccagagagctgctgagtcttcatttcctgaagggttgggccagatttgggagctcatgggagttatagaactgctttttctaatttacaagttctaaagtcttgttcctggtcacttccttctcaaaagcgaagggcgcagaggctcctgtggaaacaccttcccttgtgaagtctgcacagagtcctcacagagcctctggagtggctaccttccatgtgctggctaccaccgtcttcttccagggaactccacaaggctcctggctcccagtcaagcagccgcctttgtgtctgttctttttccacccccacctccccaagtatgccttctctagtgggataaatttagctctgaatgaatgcagaaagaagaacacattaaagtaaacacagaccaaacagcattcaaatataggtttggcacacacacacaactgacaaaagatccaagtttttctgtttccttctcttctgcttatctctgtttctcccatctcatcctctgactgctacactcttttctgcgtgtatttaagctaattagatatgtagatcagaatgtggggctgttggtcttcaaaccccatgaaggggaaatcactggagtgactgagaaacatcaaggagtgaatgagagccccaggtggtgctggcattttcatttactggcttgatcatcttagaaacccttccaaaaacttgaaagcatattttatcttatgtgttagcacaaccttttctcccggtgcactgagtctacagtggctatagaatgttgcaaggtcgggccgggtgtagtggttcatgcctgtaatcccagcactttgggaggccgaagcgggcggatcacgaggtcaggagatggagaccatcctggctaacacggtgaaaccccatctctactaaaaagacaaaaaattagccgggtgtggtggcgggcgcctgtagtcctagctacttgggaggctaaggccggagaatggcgtgaacctggaaggcagagcttgcagtgagccaagatcgtgccactgcactccagtctgggtgacagagcaagactccatctcaaaaaaaaaagaatgttgcaaagtcttttttttttgatatggggttctcattctctcatccaggttggagtgcagtggcacgatcatgattcactgcagcctcgacctcctgggtttaaatgatcctcctgcctcagcctcctgagtaggtgggactacaaccatatgctgccacacctggctaatttaaatttttttttgtagaggtagggtctcactatgttgcccaggctggtcttgaactcctggcctcaagctatcctcccacttcagcctcccaaagtgctgggattgtgggcatgagtcactgcacctggcctgcaacaccttctaaacatcttcccaccaaccagtcagcatgtccctaagccctacttttgaagtattttatttcactgtagttcttcactctcacagcatttgtagttctcagagcactttctcattcacgaactttaaacttataagaatctaatgggactagttagctatccctgttcccagtttacagatggaaaacctattcccattttacaaatagagaacctcagttcagagcaggcaagtgacttgtacaaagtcacacagcaagtggcagagttaggattaggacctaggattgatactttgtcttatgttcattccactctaccatgagctgctttggggaaaggcagtttgtccgggaggccctggctgggagggtcacacattagtaatgagcaatttttgagactggctaggatccatttagtcaatatatggagggtgtgcaaggggcagttgagacctctgtcattcccaaaggtgtcaggcaggcacagcatccataggtggtaggagctgaagctaggctttcccaatttcattattcattccccagccagcagggtggacaggatttagtaggcaggccaccatccctccactgccaaccccgcaggaaatttctctcttgtcagcagtgctgacttgcagaatgtacacggcattattgaaacatggttaacaatgaaagtgttgatggccacgctaccaaaagggattccaagctgacggagcacatcgtggtcattgtgctaaggtaaaccagactggcccctaagctctctgagaaaccaatgacctgactgtgtctactggcatcagataaccaggctggagtagaacctggccttcccaaagactttctagtttgtagctaattcatagccaaacctagaattgtttctaccacagagcaccttcaatatgtaggcatgtagctctcttcctaatactcaaaaattaagctgttcttcccatattttcctaggatttaatctatctcctcttaaatttttaaattccttcttatttataattgttagattgacccacactaaaagataagactgtagatgtctaagaatcattaaaagcagagtctagtaaaggtgtttctagataataaatgacatagggcagaatcctcttgtttaaaagatggaaaatgagaagtactgactaatgggaggaatgttaagaataccgatagctcaacccttaaaaaaaaaaaagcctacataaaagggtggataaaatgaagtcattcacttaagttggtccatggcatttttcatgaagcaatgattgggttgagtgatcaagattaccatttccagagcacctaccatggccaatcacaagccttttacatctgttaaccttatttattacaacatccctgtgagagggctgagattccaacttgtcttcagagttcctgtcttttctgtgtcatatctacctcctacttcctaatcctacttttcaaaacttttgtcattaacaggactaccactctggaccaacatctgaataacacagtatttaaacttatcagatatgacaacccaatgagactggacatcacatattttcatttccatcttaatgtaaggaaactgtcattctaatctattatgtgatttgtccatactaccacaacaaaataaatgtagaatgatctctaaccatttggctctaattgattcccgtacactctccttatctacccagtttcctctagggactcatgttgatcaactgacattgccaaagctaaccaagagaaaaggaagtcatcacagtgaaatattgatattcatttctagccagatttccaattgctcattttcaatctgctatgtaaagaccttagccactatataccttaagcaacattcagcctagtttatttttcacaatggtgctgttttctgacttctttctatcttcttgctccatggggactccctaaatgaatctatcatttggatcccatggagaaaaatagcatatacttgaaatcccatcaactttcccaaagagctaacaaccacaggagccaagaggaccacaggcaatgttctccttcttttgattctgtgcagctatcacatatgttttaaatgaccatttattttcaaaagatcccaggcaaaaaagaactaacacaaatataaacatttgaggggatcctggcattcctttcaaaattacttttgtccaagggaagcttcaggttgctgggaaatgtcacactcatagctcttgctcaacaagactgacttttactcacacaacgggccttggcaagtcatttcccttttggtatacagagctcttgttttccccacaaaggaattggctatgatcgtttgtgattctcaaaggactcatgttctaaaatagattctgaaatttttattaacaaaacatctattttgcatatctagcattctgtatccttttcgtataatgctttgcaatgaagcatctatcataaaaaccactaaaccgtacagatggtgtttatgcaacacaatttaatgtcccagcaagaactagtgatttgttacatacattatgcatcattgtgatgtatatatccagattttaaatgtttggagggcaaatagtcaccaatatcattgtggcactagactacgattttttttcttaataccaggccatggccaaacatctaatataaaataattatacaatatgtttattaaataaatagcatagtttgggttttaaatgcctgtgtttgtaatgggttcaaagattttaaaatactaaaatttagaaagttgaaagaagtgctggaagaggaaaaaagattttccctctgctccttggccaaccatcaggcagtcatttcatgtgccttcctgtttcacctagggttcttggtcccaagcaacagaaatagattctggctgataggagcagaaaaagaatgaaatgaaattgtattagatagctcacaggagagatggaacgtccaaagaaggaagcttgggcaatgggtacaaccaaaggtgaactaatagcctgaaggaattctctaacatgctcagtctccaaaattcttggcaggcacacatgcctgactgagccgagattgcctgccataccatggcttcagggggatctggggaacaagtgtctgatacctcccagcttctaccacaggatgtggctctgcctctcactatggcttttaatatgggaaatccccaaagatgggaaggagttcacaaattggccagccagaggaaaaaaaaatgtgtatatgaacaagtctgttacacttcctacctggccagaagcattttgaatttcctctcttctttggctttttgtcttacctgctttgataatccgcaacactgaataaacacaagctttttttattgtgggtctcagggcagttaaaaatcacttaggaagtacacactattggtcatgagtctttagtctattcctagtaaattcaattagtacaaaggttctaaacccatccctaactcccacatcaccctgtagaaatttaattctgtacaggtcttcaggagattctgatgcagatttctgattaggaaccatgttttagtctttctcatctttcacagtttctttacaaacgatttctatttttctgaagccccaaccctacgccatcagtcttaatcaatgactctttgttcaattgggaaaaccagtccatctgatgcaaattcacttaacctctctcctgagagttgaactcaaactttcttcttgtctttatccatttcttcctccttccctacttcgttattccttcttcccaaggctaactggctaatgtgatgctcatctgaatgtcctcttgactaattagagactttgactaatattcaccttcctttttgactgtatctttggcctaatttccctgttgtctaatttgctttgacccccaaacatccaagtcttgcctgacctaaaaaccctttccactagaccctgcttcccatgggctatgttcctgttctccaccttcatctttcacatctgaagagctgaaagaagcagtttgtactcatggttgcttctctgatctctcgctcatccccatttttgtttgttttattttcaacattcacttggtagcagtcattcctcacctcttgtaagtgcttccaagctcatcttctggacacaagtcactcatggcttactgacagccctccaatggtctcttcttcatctgcatcccccatgacctttcagaagcatatgaccctgttgaaaacctctttccttctttgtggcttttggtgcaaatccctttgaatttttccttctacttctcggatgatactttatcagtcttctttgctgggctctctcctcttcttgctctgttttctcatcctggctgttctcatttctttagctgtaaccgcaaagtagatgacacttggatgtgtgtccccaaccccgattcttctattcagagttcagatatttccaactgatcacttccaaagggtgcccaggcccttttccttctccatctccccattccatcactccttttaaaaatttattgcggttaaaaatacaaaacttaaaatttaccatttcaaccacttttaagcatatggtttgatgacagtaagtacattcacactgttgtgctcaatcataccttttaaatatctgtatagctgggagtagaaggaccatttctggttcaattgtttattcctggggcctgcttctatctccatatcattggccaagcctggtgcttaatggttaagagcatgggctctggtgagtgtgatctgagtttaaatcccagctctataactgtagctgagtctttcaacctctctggtctcattttcctcatcttagtattctctacaatcactctgctgaagcaataacagctttgtttatttgtgagcaaacccctttaaataacttgtcctgctggggcttgtgctggaaatgaagaaaaaaggatgcatttgaagaaaaggatgggcttagccagaaagtagaagtttctgatatattggagtgggatgtagaatctggcactggcttggatttattaaacaatcagctccacctacacttgttatgaaaaagatgggaaaacaatccatcagtaaacgattttggtgagtgcttccatctttggtcagaggagtaattgttcatcagtgacaggtgaacctctgtgaaaattgaaagggcaatttagttgaaatggaagcatttattcaggaaacaggtgatctgggaaaatttgatgtgcatttttttttttttttttgagacagagtttcactcttgttgcccaggctggagtgcaatgatgtgatctcggctcactgcaacctctgcctcccaggttccagtgattctcctgcctcggcttcccaagtagctgggattacaggtgcctgccaccacgcccggctaattttttgtatttttagtagagaaggggtttcaccatgttggccaggctggtctcgaactcctgaccttaggtgatccacccgccttggcctcccaaagtgctgggattacaggtgtgagccaccgcatctggcctgatgtgtatatcttttaacatgcctttaaatcctatggctctaaagaggccatattagttatttcagtgtttatttcatttgatgaagaaacgtttgcatatgaatgttgggaattctagcaggtcctgcctcaatgtgaagaggcatttttttttgcttttggcattgatctccttttggactgggcctgatccacttcttacatccagtccaggacctgtcacaaaagactcacattagtaccacatggtatcctgttttagtaaagaataggtgaaatattttagtgagtagatcctacttttcctttcagatgcaatgaacagaagaccctgaaaggatttcaatccagaatgtcacaggataataagagcagatgtctgtgatgccctttacaaagcacctttacatactgtctctcattcgtctctaatgacacctatgtgatcctccattttttcagatgaggaaactgaggttcagagtgattaagcgagttgcctgagatttcacagctaacacattgtgaaatctagtctagcacccaggactaaaaactctcggcttcttttaaggccacatatcgcctcaccagaagggtggcctctctggagatataccctaccctcggccgacttgatattgagaacttggtcatcttaagcatgtgggccacttgggcaaggcagcccttcccaaattgtaaatgtccccacgtggagctcaagcgtctggcttgagccagaaggtgccctgaacactcggtggccccagcccccacgtaacagcacgtgctcgggtcccacattcggtcagacgcccctctccactggcatctgcccggtggaggcgccactgcgctctgcctccgccccagcaagcgcgtgtccacgcgggcgcgccacgccagccgtgcgccccagcggctcgccgtgcgcccgcgccccaggtgcccactggctcgcgcgccctccgtctgcgccttggagacccgcggcggcgatcgctcggagccgccttggaccgcggcctcgggtccatcacactccaggggcggagcgaggcaccgagacgtcagggcggagaactagcgccgggctagcgcgccctcccggcggctgccggcgtcccacgtcctcggctggcgcggccggcggcggcggcgaccgggagatgcagtgagcggcggcgctggggcgcagccaggcggccgggagggcgggggccagaggctgagcccgggcgagcccgccgtgcgcacagctctgcccgccgcccctggagcggatccccagccgtccctgggcgttctcccgggttctagcaaagccccccggggtgcccatcagtttccttgggtgactacagcgtgtgttttttctttcctctttcccctgcctgtgtgcccttctccaggatggcagaggcggaattgcacaaggaaaggctgcaagccatagcagtaagtccactttcattttattttcttgctctattgtctggggtggaagggggcccccgagggtttcggggcaagcggcatgccagcacagtagccgcaggtcatatgttccaggggctaaaactctgtcagggctcagctaggctgccttttcttttctatgtctatagatggagacccccaagggcgcgctttggactgaggatttgaatgtggaagattggcttaaaaaaagatgcttgctgctgggctttggggaaggactaaacagaggcttggggtggggggacgactccaggaatattatgaccgaatgctcaggcatacgttggcttcatagcctggagaaccaagagaagggtgacctgaacggtggctgccatcctctctgcggaagctgtcctcctgttaagtggaaaaccaggagtcagcgactcagccagccacgcggtagaacctcctcccagaaaccgggaatgttagttttcccttctctgtttgatattgacaagggcactggcacaagccaccaccctggaggtctggggacttcatacaactgggtcctggttataatattccatgagagcctccttcttatggtgtggagtatctgaaaacctattttcagcctacaaaggagtagtcagttttggcaaagttcgtaggcactttcagaaaagtgtacccatgtgcatcttgggtttaaaaaagaactctctgagactgcctagatttgagcaatcttaacacagtgttgccaatgatccacagatgtggtatttttactggagccaccacagctggattatatatttccttcgaggatgagggaatgattactgctgccgtatgaaatagtaacaattaaaaaagaaggtccgttaacatattggcataaaagaatctccagacattcttccacctaaatacatttgtgtttttcagttcggaagttctctggaaacacatataaatttgttggagaaatagtgtgtaatgttttggaaccaaagtatattaaagcgttttccaaaacctttttggacagattcttcattgggaaaatgcacacagacccttccttttttagaagcatttgacatggtctccaaggctctgagaccctctttctcaaacgcctcaaatctgaaatgtcttggagacttcaccactgaagtgagagagatgtttgctggcaatattgaaatgccatggtttgcctattaggtaatctttgaacgtggtgctctgaactcagaaaggttgtttttttcttctttctctttccccctgtgcatgtgtattttgatggtttgtgaagttatttgtggtttctaaagttggtggcaaggcagcatggccagtgtgtcatgaacttgataagaatggtgatattgagttaatggtgccatgtagctggtgggtgttttgtgtgaactggataataggctgctttaactgttgatgcagtggctgttcccattggctgctgctgaaggcttccaacagttgtcacattttctgcctttgcacaaccagctttactggatgcctgaggaacagctgaactccatgaaaggacttgctttccaaacatggagccagtagctgctaacactggggtacccttttccaagtgcggttgagtaatcccagcagaggccaagtcgattttccaagaaagatctaggcaaatctttgggaattctcttgagcatataagaatacacacaaatactcacttgtgcctcttcagttattgaagaattgagtttgtcctgtgtatctggggagctgttgattattctcatgaatgtgcacctaatacagtctgccctccctattcatgggttccatatccacgccttcagtcaatcttggattgaaactattggaaaaaataatagatagctgagtctgtactgaacatgtacagactttttcttgtcaccattccctaaataatacagtataatcaactgtttacgtcgcatttacagtgtattaggtattataaataatctgaaaatgattaatgtatgtgggaggatgtgagtaggttatatgcaaataccatgctattttatagggacttgagcatcctttgattttggtatccaagggggtcctgaaaccaattctctgaggatactgagggatgactgtatgatgttgtcaggacagatttgctaacagcgtgtgtttgtttgtgtgtgtgtgtgtgtgtgtgtgtgtgtgtgtatgtgtgtgtgagagagagagccaattaagagacagagggagttgggtggggggacttatggccacatcggtaaatggttttatgctatgctttggtctagtgcctactcttctgaattctgcaaaccctgactctctcatcactttcctggagttctcaggggaccctgaggagatcacaagcctgcccccagaacctagcactcctgaagtctctctggagatgtgagggaagaagacaataggtcctcacatcttcacttacttgggcttctctctcagaggcagagaatcgactgggattccagtctgcagggccttgggcagtctttagtctgggtctcagctccttcatctgtagaatgggttcatgagttctacctcctgggctggttgtaaggtttagttaggatggaggtgaagcacctggcaggtagctgtcattggatggtgttgagcagagcccttagcttttgtctgtattgctgtcttgtcctgtggggggtcagaagcaacatctctgaagtggaatgtgtattaatgacttttttttttttttagacagagtctcactctgtcacccaggctggagtgctgccatgacagctcgctgcatcctgaaaccatcctcccacctcagcctccccagtagctgggattacaggcatgtgccaccatgcccagctaatttttaaattttttgtagagatggggtttcgccatgttgcccaggctggtctggaactcctgacctcatgtgatcctcccacctctgcctcccaaagcactgagtttagagacatgagccactatacttggtctgaacagctcttttttaatcccttccttcaactgactgaaagtcagggccctgcccagcatcactttctctaactgctttagacagaggcagagatatgacttgaggattcattcatccatttgttcagtaggtatttacagattgcctcctctgggaaggtattggcaacactgaaaagttggtgtccccaggtttcagctgcctgaggctgaaacctttatttcaccttttgcacataatttcttgaaggacagatgtcctgatacctaagatgcttgtcacatgaacatctgtggaatatccgcccccaccaacaaaactgaattaaatacttagaaactacagtgctttaatggaatcttccatttggatccaggaactaatcaatgagaaaagatgactcttatcctaatttctgccaaaagaagagcaagtccatctttgacaatgatctctacactcacatgctcctttcttctgtagggatactccccaaactttacatttagaacatggtaaaaagcctctgaaacagcatgagtgagaatggtaatcccagggactaataacaacaattgccatttattgaatattgttcattcagaaaggcacggtgtgaaatactttttgtttttcacctaacgttatttatagtctaatggaagaaatagaaaagcacataagcagttactatccaggagtactatgaaaatgagcatccaggaggaacatgtaaaccaatctcagagttgtgaaacaattccccaaaaagaagacattagagtaagtcctgaaaattgggtaaaataaaatataaaataacatcataaccttcccaattaccaggaggcatttgtttattcgttatttgattattatttattcaggacatttagtgtgagaaagggaaaggcaaaagcatgaagaagttaagtcagtagctaaagacacaaactcagagtgaacactgaaatgcttttcagcatgtattatctcattgaatcctaataagaagcttatgaggtaggcactacagtattactcatattttataggtgaggaggttctagaactggtctaacattaaactgatagtatcaaagccaggatttgaatgctgcccgcagcaggccattggagcctttgctttgactgctgccctgagctgccacccaagatggcggcagcgtctcgcacttttcccatgagcacactgtgcaggtggtctcagcagcctgagtgtgagccacagactgattccattgcaatgggaaagcttgagacaagccaggaggcctacctccttttgagagtctttcaagcctggattcagtgcatagaaatacccaacataaaatttaatggaacgagtaacattcccatggggaagaagctgttgtgtctcagtggaaactaaccttgtgggagggtgctgttatgtctgcacattggagaggaagatagttttctttgggcatgagtgaaaataagtaaatgttatataaattgtcttgggtgaaactcctaagagccacgtggacaaggctcaggctacaccagggaccagcatgagtatgtttatatatgtgcggaaataggaaatgctaatctaacctatgctgttctttagggaattttgtcatttaattagaacccactctgtgaagtaataaaaatgatctttgcatttgtgcagtactttataatttatgaaaaccttgtatatgctaccttcttcctgaggtgtgtagagcaaatcttatacgctttacaggtgagtattcagagctatccaagcttacacagatagaggtggaagagttgtagtaaatcccagcctctcctgactcccaattcttgtattagtccgttttcaccgtgctgataaagacatacccgagactgggtaatttataaggaaaaagaggtttaatggacttatagttccacgtggctggggaggcctcacaatcatggcagaaggtgaaaggcacatctcacatggcaacagactggaaatgagagcttgtgcagggaaactcccctttataaaaccatcagatctcgtgagactgattcactatcacaagaacagcatgggaaagacatgtccccgtgattcaattacctcctaccatgtccctcccacaacacgtgggaattcaagatgagatttgggtggggacacagcaaaaccgtatcacttgtgttagtggtacatccagccttggaagggtgctttgatacgggctgaaactgcaactaagatcctgctggactaaaatcttctggctgggaggagaggagtgagcttggatgtgtctctatggaatatgcccttgttaggatttcactttcggcctctttcattcttgaaattctcaccaaggggtcagctagtgagtttatggctttcatctgattctattctcagtcctgcatagacctgggtatacgctgttggcctaggctggctgtgccgtgggcttacagagaagtgctcattggcttttcgttggattcgcctctccatgccttttcttgcctgggagcattacagccttgagtaccaggcttggagtgtggggccagtggccaaggaggccaccaccctgcttttggtccaggccttttaggccgacctgcacagcatgggcaaaaagtccttgcaatgatttacatactatccagtccagcttcccaaggatccctcagaggggttagagactcaaacccaagccctgtagaaacaggcactgtgattcatgtggggaccatccccatccatgttccttgtggacttgtgttattggtatgcagctgtcagagaactggagaatttaagatcctggtcattcatctgttatcttatatctcagagatgcagatgacaccctgcttctaaaattccatgttaaggcctaaaaaatcatttgcgtggtatattggtgctgaggaagggttcaacttggctgagtctgtgaagctgcccactggataggtgacactttgggcccatgcagggtcattgctgtgtctgggagtgccaaggcaggccttacccagcatgcataagggtcacacacctccctgctacttatttgtacctctgagtatttcagtcttcagcttattgggacaaagagcagctactctgacaaactttaaaatgctctgagaaatagagcagttatcatggaaaaaaaaagtcatcatagaaaaagctaagtgaggggggttgtgggttatagtttgtcaatatttaaaggaaaaccagggcccagtagaattgtttctatatttctttgggggctactcaatgctttggggtcactgctggcccctttgaactctccacatttcaccactgatcccatttgggaatgttgatgaacttgcttggcagtaagagttggtcattctgtggcatgaaattgactgagacagcagatggacattgatgcacagagacggtggtcccaagggctgtcattgtggtggggtagttaccagcatggattttggtgtcaggaagacctggcgcaagtcctggcctttccgttggtatctgtatgatgtcactgtaccttggtttcctcacctgtaagatggggctaatgatcatacccacttcagtgtcttgttgtgatggttcttttagaggtttcttgggaaatgctcagagacagcatgcattaagcactcacaaactttcctatttataataagcaaaccaacaaatcataacttatgcatctttaaacagaaagtgaacacaaagagtgaaaggagaattttgttagccacagcatttttgtcaaactaggaaattagataaatactaggaaatcagataaatgttgtaactcctgagttttcaatgcatgaagatagtattaataataaaaaatggattatttgtagtaagcaggagtagtaaactcaacaggtcagggggccagcatgcaatgtaaatgagggacacagattgagtcgaaagtattggtccctagagagcagatgccacctctcagttaagatgcagttaatttatgccttgtgagaacgtgggtcttatgttgttacatcaactcattttcaagagaagccagaaatctgatttttaacatgtgagatctcccacttaaaaaagaacagtattaactagtttaaaaactttaaaaagattggcagtcacaacacaattccttttgatcaagaggccgacattttgtgacctttagatatagacagagctttgaactttacaggatgctttccttatgcattgatttatttggatttcataaggatactgtgaagtaagcctatcagcacccctgagatatttcataatgttgtaatatcgggttgcattttcaccagagctttgtgagtttggtgtccagatgtttggatcattggataaatggtgcttatttgcgatatcttttgacattaaatgagcccttgcaaatcactgacattattgaaactcagaatactcacatctagataggtaattgctctctaactcaaccaaaacaaatctaaaccacatcaagtcagcaccttaatttgggaaattcctcttattagaaaagaatctttaagaacctatactcaaggtatgcaaatctgaaatgcaaacctgatatgaagcccaagcctaactcatgtcagtcaggatgtttgagttgatcctgatttattattagcctcaagtaatggacattgtagggagattctgctgggctcaggactcatagtagcagcaactgccatttgaccgatgtttttgtcatatatggtatagaacagtaattctcaaacgttagtgcattaggatcacctggagggttccttaaaacacagattgcaagagcacactcccagagtgtctaattctgtaggtctagggtgatgtggcctgagaatttgtatttctaagaagttcccagctgcaactgctattctggggaacacactttgaaaacgactggtgaagtgtaggagatcaatagtaaaggaagattatgacctgggtcctgatgtgcatcacatgcccattgtgatatgcccaggagtttgtgtggtgtgtatattctgaagaggtgaaatagaataaaaggccaaatttagtcttgattaatgagagccttaaacatagcccagtttggaagtcatgcaagccgggtgcggtggcgcactcccatagtcccagctacttgggaggctgaggtgggaagatcgcttaagcccaggagttcaaggctgcagtgagctatgatcactgccactgcactccagactgggcaagagtgacaccctgtgtaactgtgtccttctcacattacactggctaatcaagaagaggtctttgcttatctcgggaacttgctttaatctatttaaataaagtgagatatctgttggttacttgacaacaccggtttggaaggtttgcccaggattggctgggcaggttgagagagtttgcctgggattgactgactgaaactatgggctacaaaattcccttggggaggccttagaggacacctcagtgagataagaagtcatgcagtagagaagatatccagcaacaccatgacagccccattgagagaggcttgccatacatatgatggtgtatagatgaagacatcaaatagcagatcagcccatcaagcctggtggccccttctccagcctgcaggtgctaattcgcgatgtgattgcttctcacgtgggcaactccaataggatgccaggagaagcagcaactgatgttcatttacttaatgatggttaatattttatgaagccagtctgtgtatatgcaagtatgacttgttattggcatatcaaggacaagtttattcttccaaggatgtcatgcaggcttccctcacttgtctttgtaccatgcattttttgagctaacccttcatttttggaaggattctgcctcaccggatctcttgtatatcttaaaacacaaagcacagaggctgcactgtacaggatgaggcctaagagaacgtggagactgtaggggatgggccacacagcatggcggagtttgtagaggaaaggttgctcataagtgctctgggtttgggagaagaccacacagctgagatctatttctgacaggaaatgccggcaggagcagagggtggtgtggggcagtgcgtgttggagctacagtgcccttggttaattattatctcagtatttctcattagtctcttgttgaattaaaatgctcaaaaggagattattaaatacacacagaaagggagacagactgacagacacagagacaagactacaccctatttacataatgcttgaacatatattaaaaatactttggattactctttgaccctagtatcactgtttctataggatcatataagtttagctagaagaaaagaatagagaatctgtacctttcttttgcataagatcgaaggggaaagaaaagccatgtgaggcccaagataaaagccccagctgtagatgaaaaagctgtgggccagacgtcggaacacatcttcctgtccatcatttcccttgtggaagcctatttcattaccctgcaggcttttaggctctagacagctttgcaataccaaatatcttgaaggcatttgtaaaacctactcttacttttttcctggaaaaaaaaaattatactggtttacttactattctaggtgggtgggatttttcccccctctgctaaattataaccagtcatctaagtattcactttatttttaaattcagggctgaaacttaaaaccttgagggttaccaaaaaatgttattcttaagagaaaaacatgcttgaaaacttaacccctttggtggcaggcaggggattttctttgtctgtgtttgagtgctaatgtcgacaactttgaggccaataaataccaaatggggctctaggatttgggcaactgtgatagtgtgtgtgtcctgcatgtcacatgagaaagagagaggccgggatttaagaaaggtgcctcttggctgggtggcatgaactcagtcagctggctttccccaggcacctgattggccttaaacactgagtttttgtggtgtgacttgacatacatcttgggctgatatcacgtgctgtttctactggggtgggaagtgctttgaaaatgtccttgctccagtggaactgtgagacatatctaaaaagcttaaggctaatatgagtgatgctaaaaggaagtcctgcttatccaggtaagcaaaagcatactctaggatagcagtgctcctgtaacctgcatggcctatttttcttttccaggtggtatgcaggcagtcttgttcatgaacattgatgtctgagcatgtgtgttcaaaattcagtgttgttaatcaaataaaactcaccacaaaacccgaaggatatttaacaatagatgagataggtttggcggagatgggtcagaagacagaggaggtcctggaggcagcagtagaatgtactttccaatcttactggtgactagagataagacactagtagcctgtttactccccatccttatttacactggagtgagaatgatatatgtcagatcagtattggatgcgatgagggagaatgaagagaaaatattgactctgaaaaatacagacaagaggaggcaaagttgaaagtaatgtaaactgcttaatcacctgcctttctctctttccaccgtcatctctttctacttgacatgttcctgcttttgcctctggatggttctatctctcatcccctctcagcctgggtccacagagaaaagcaggaagcagcctggcatggcagtggagggagccttttccagccttcctccagcagaagtgcgccctctcccctatagggagatagggcaccccaggcttcagaaagcaagggaaagatggtacttcatcatgtagcttttcttaaggggttggagggaagggctcccagttccggagagggtccatgtgccagccaccctgctgaatgccttatgttaggggggtgagatctcagatgtgcacaggtaccaggttgacttggctgagcttttgggactgtggtagccaagagagggcagactcctgaggggacagagagtgctcaactccaactgatgggcactgtgtgggaatttgagcccagggtctcctgcttttccaagagaacctggaaatccaattttgaaggaagtctgttgatgtttaaatgctcacaacagtttaaatactgtatgggccaaaccaaacataacacagattttaacacagtgtaggctggatttgttccctgtctcaatgaccctccccctctacccccagcctgggccaccagttttccacgtctgcatgtcacaacctattttatttaattacaaaaccaatagtatgtgggaatgggggctggggggttggtacagtataaagctatgtgagttgtagatacacttatgtatgttgggcaccttggtgggatccataccctataagaaaaccatagtcttgggtcagagtcagggctgctacttaaatcagttccttatccagcatgctggatgaactcatcagttctctgtaagaagtaaaaactacaagcactctttaaaaaaaatgaaaatgaatgaagagaaaaatagacttattaaattctttaatttggaagactgggtctcgctatgttgctcaggttggtcctgaactcttgggctcaagcgatccttccacctcagcttcctaagtagctgggattataggcatgtgccattgctcccagcactaaaattgactttcttgatgtacagctctctcaatttgaacacatgcgtagatttgtgcaatcactggtatactcaggcaacagaacagttccatcacccccaaaagtctcccaggaaggctgattttaaaactctaactggaatctaagtcattctgcttggggctaccttataccctgactttgaagaccctaaaaatcagttgagggtgggagggttgaccagaacatgaaacttgggttcccagccattggtggggaactgtttcataatgagcaccctaccatacctatataacaagtttttgcttcttcctaatacataccttctgctccagcctgggtcgtcttttcactatcccctactagggttgttccatttagcaactaaatgtataggatgcccagtgattccatggggacatatttatattaaaatattatttgttgttgatctgaaattcacatttaacaggacattccatattttatctggcaagcccatcctcttcacattcatgccacattctcatgtaagttcaaaacctactttctctgtgtttcaccaaagggtgaaaatactctttgaaaatactctttgattttattacacttaatcttagccaaaggccaagaagcgattgtatgctttgattttaaatagtagcatgtttatagggagatagggcaagtgttggaaggataagagtgctttctatacacataaatggattttcaagaaatgttttgtgaccaactggttttatcctttccagagaacaagaaatgatctaatatgtgctcaaggaaggaggacaactggatttcagaaattggttcatgttacagcccctcctctaccctttttctctggcctgacctttgaataatataagtctgaaaagactaaacaaagagattgctcaaactggatgagtttaaaaataacattggaatgctagccttcagcaagccatatatcttatactgcactgagcaggacagtgccctgtggtgggtagaagatgagtcacacagtgatcacaaccagatccttcccagcctggatactttggtggagagtggtgtgatggctgatttatttgtcttgtttgtttgttgtttcatttttccattttactagtgtgatttcagaatcacaaggaggcaaggaggaaaattgattttagatagcagcttcagaatgaaaaatgagtggaaattccacttttcggtctagaccagggaccagcaaacaatagcccgtgggccaaattcagcctgcagcctcttttcataaggcctatgagcagtgcctggtttttatatttttacaaatttgaaaaaattcaaaaaaggatcttttatgactcatgagatttgtatgaaattcaaatgtcagcatccataaataaacttttaccagagcataaccatgcccattcatgtatgtgttgtctatggctaagtttgtgctataatggcagaggtgaataattaaaacagagactctatggcctgtaaagccaaaaatatttactatctgaccatttggagaaaaactttgccaacccctgctttctacatggcgtatttcaatggctgtatttgcgatgaaggctccaggagccttttatctaaagaaatcactattgcctcattgcttacagtccagaacaataaagcatctcagacatccttttcactgttttctgggcttaccatgatgagaggttttgtttaccgaagctggcatgtgagttttgccgctgtggaattttctcattatatcctttgctatctaagccaactgcatgttgttgttgttgttgttgttgttttttgaaaaccagaaaatctgatctcttagggttaacagtttggcccatctgaaataagtccatacaattaaaaacatttctttctattgacagggactgagggttgagggaaagcactgcagattttccaggtgtatttttttttttttttgctccctggattttgcctgaaccctcacttttctctttcagggaactttaagcacacttagtgaaagactaaaggtcagagagcacaccagccacattccctgagtccaagcagggagccagagaggagtggtttctggccagccttccctgttcagttacctcatggaacccttgggaccagggccttgatttacaaatagagtggccactaggtaaaagttgcccatggccagtggtagcaggatcgaccctagtgtctctgaatcattaagtacttcctttctgccctcttccatttcttactcaaaaacaccagctacaattttgagtctggtctgcctggaaatttccaaagggactttggtgccttaataaatattttcaaattgctcaaggttttggaagatagcagagccataattgtgaaatcgggttaaagaatgattgctgcagtacttgcgtcggccctgtggccatgctgaagtggacagggttgtggacactcacaattgctcactgcagatggacagcctttgcttttctggtcatacatatgcttgatcctgaaattctctagatgggctacttctgagcagctgcttggagaatgggaagccaaccctatagtgtaaggtttcttaactgaagtaccattaacactttgggatagataattttctgctgtctgtggggccgatcttttgcattataggatgttagtggcatccttggtctctatccattaaatgctagtagcacaccccactcttcattgtgacaatcaagaaggtctccagacattgccaaatatcctttggggaaaaaaataacccctttgaaaatcactgatgtagtataacataaaggttacctgaccaaatgtacttcccattcttttaccattagggatttatccctttaagtcttcactctcatcattagggattaatttctttaaatgtcaaagtcttttttattttctagaatccctcacgacaatattgatttaactaacctgcacgttgtgcacgtgtaccctaaaacttaaagtataataaaaaataaaattaaaaaaatggtaaatccttaagcttgggatggcagatggttttcagctcctatgtgaactctaactgatagaaagtgtccatctatagtgccgccgtgggaagatctttgaagctgcattttaggtgttggagaaaggacattaagacagattagagctgtcttccatgggcaagagatgagggagttggcatacacgtgtaaggaaccttcttacctaacatttctgcggagattcactatagtcaggccttaggctggtgctgtagttcagccttactgctgagccctgtgccagggcactgttcacacaaggtccctgtagccttgtgtatttgttagggcaattttccagcaggttttgaggaaagggcaccttttctagatcacagagtgccatatgggcgagcagaggtgctgtactctgttgatgggaatagaagtcagggaacaaaaagagaggggcaaagaatataacttcctgtctgtctctcctgcctgactgtaaacttcttgaggccaatgactatgtcatattcaccattatctactctccgcctgtcacaacacattttgcatagtgtcaaagcaagtttagtgacttttagcagagttcttgttctgtatcttggactccttagcagtcttgtggaacctatgggtcgcttttcagaatagtgcttaaatgcacaaaataaaatatttaggattaaaaatataaccaatgaaatttatatatagtcagcaaaatattagaaaactgtgatagataatgtgctttgattgattgatgtacagtcagcaaaatattagaaaactgtgatagataacatgggatttgattgatgtacagtcagcaaaatattagaaaagttaaagataacatgcttttttattaagtaaaatctagtggcagttctaatacttactctaattgcaaattattggtgaatgtaagtgatattttgagctgtctccaacaactgtaatgttatataaaaagtctgtgattcctactcctaataaagtcatggtatattagtccaatctcacactgctataaataacttcccctgagactgggtaatttgtaaagggaagaggtttaattgattcacagttctgcatgtctggggaggcctcaggaaacttacaatcatggtggaaggggaagcaggcacatcttacgtggcaacaggtgagagagatcatgtgtgtaggagtaactgtcaaacacttataaaaccatcagatttcatgggaacacactcactatcatgagaacagcatgggagaaactgcccccatgatccaatcacctcccaccaggttctgcccctgacacatggggattatgaggattacaattcaagatgagatgtgggtggggacacagagccaaaccatatcatataggtactaatgatctacctggggcttgtgcttacattcataactgaaggcggtgctaaatgttagctagggggtggtaaaaataacctttagctgggtaccctaaattctgtcttatccccaaacgccctgaattctcacttctttcttttgtaactgggcccctgctctgatggtttcctcctttcctttgcctgatgctacctcttttaccttcttggggttcttccccagcaaatttttctaggttctttcttctgcattcactttccatctctctcagctgggttgtgtcctttggccgctatctaagttctcactccgcttagcatgggaagggaagcttctaggcccagcttggggttaccctgagcttcagaggagagagggaggttggcacatcacagatactcactgaatgctttttgaatggaaacagttgctttgccaacttcaccttttttatcaggggctcttcttggattcttggactgtgtttgagatcagttcactcttgatatctcccctccgcatggaaagcatccacaaatttccagctagagcatgaacttgcaatttggtttgcctagatcctggaagtctacagagttagaatctttcctggttctgaactcagaagcagcagtgagcagtgggactgctgggacctttaccagcaatcacccaccacatgcaccagcttcaagcagctctgcagaagccgtccgtcaccctccccgttgcacaccttggctgtgaaccgccagggcaggggcatgtgtgggaagcaggcggcctgcagattcattattgctacaagtgaatttcataataaacaaacaaaaatgagccatctctagtttagttccctttgagcatataggccatcaggtcccaaaatgttcagagttgggttagtatctgtggctttcaccaggtaaacacatcagtgttcttcctaatttggactgttgtggcttccctagttcttttttcccctagattgttataaaggttctgtattagttttccagggctgttataataaagtgccacaaattgggtggcttaaacaacaacaattttatcatctcatagttctggaggctagaagtctgaaatcaagatgtccagctagattggtttcttctgagggttgtgaggaaggatctgttccaggcctctctcctggacttggggatggccagcttctccctatgtctcttcacatcatcttctttctacatatgtctgccggtgtgtccaaatttccccttttcataaggacaccaatcatgttggaatagggcctaccctaatgacataagttgatgacttctgaaaggaccctgactcagaaatatcctgaggtactgggggttaggacttcaatatatctttctggggacagggtccttgcatgctgtcagatgatacctgcatctcgcagtgatggtcaagcgtaccctactctgcttctggctatggcagtagaaattgtgtcccaggggaatggctaaggggcctgtaaacaatgggtgccatatgccattaatggctcaaacctctgccttgtctacacactcatgtatcccataaccctctgtctcctgtcaaagccttttatcaggaaaggcatagaaccacatttcacgctaaggcatgagtgttaaacataccctcacctagccagttaaaaacattgggcaaagctgtaaactacatcacaggagttcaaaatgtcaacagagctgcccccagtcctgtctgtgtttttgcttaggacccagtgttgtgtcactactccccattgataataaacaaaacatgcctcatatgttcacagttatttagagtttacagaattctctccttctatcaatttgtttgtgcctgaaggagcaggaaaggtattattttctgcattttatttcagagaaaacagaagctcagctgagtaatttgttcaagatcatccaggctgtggccggagcccacatcatccatgtctctatgtcagctgtctttccactgctccaagccacctgccctgctgccctccgtttcccctccaggtcactgttgtgcggaccatgcaacccgagtctcaaagactcacggatccccttgctgtgctctaggacccagtcctagcacctcctaacctccccaagagggcaaaaagcagcctaggtctggtgagggtggccaaggccagaggattctgttagtatgcagatcaaaggaggagcatgggcaaagtgacaaggtttgtgatggagcagaacagtgtcaggaagtgatgtgaagctcagcgtggctcgtggatgttgagaagtgaggttgatgggcagggggtgctggaccacagaagaccaggtgttccaagtggggcaaagatgtggtctgtgagaggctgagagccactgaagacctgtggtttatcagagactgctgtggtggcagagtggaggcaggatgaggcagggagctgctccaggttcctgactgccggtccctgccagtgctggtacattcctcaaggcttctcagtggctttccattatttccatagaggggtcacctttagttttggggagtttatttttgagatggggtctcactctgttgcccaggctggagtgcagtggcacgaccattactcactgcagtcttgaccacctgcgctcaagtgatcctctcacttcatcctctcatgtagctgagactgtaggcatgcaacacgatgcctggttaatttttttgtattttttgtagagatggggtttcaccatgttcccaggcttgtctcgaactcctgggctcaaacagtccacctgcctcagattcccaaagtgttgggattacaggcatgaaccaccgcgtcggccaccattaggtttttaactgtttaaggcattctttttatactgaaacccagaagaagcatcctccccagcttcagtggaaagccttagagctgatggaaaaccagtttcgagttggaatgtggaggctatttctggcctttgtgacatcctgttcaactttcagaggagcctgggaagaaaggggtgactcagactataagcttatttttagggaaagctaagaattcagtcagagccactcggattccctattgcctgccatacagaatgtgctgttggtggagagattgatgggcagaaatcctatgtttatcacctgattgttacccagcacctcccatgtgccagtataaggtttactgatttgaaaagaggatggagatcaacacaaacacacttttaaatcagaggagcatatttcaaggcatttatatttaagaactaattttagggccaaagaactaatattgtaagagcttctgtgattaggtacttaatatatactactgttatggtaagtgtttagcaaatactaccgcatttaatggaaacaataatactctgttagaggaattcttatcactgttttaacagaagaggaactgttaacttgaggaggtttaacgttagcccaagaccgggtagctgagtccagattcaaactcagatctgtctggctccaaacccatgcaaatgacccctccgggtttggcaattaaacgactcacatgttgccaccctttgttcctatgtatcactaattgatcatggaattatttcttgctcagctcagatttgacctcaggatcctttcaacacaatgctacaggtagccactgctcccaactgagcaatggtagtacttgaagtagcgtctacctgtcatcttagctttatctttctctgtatttactcaaaatagaatctttaaatctacaggggtttgttgttgtttatttctacagatgtatttgtaaccttttattgattaaacaattgtaagaaatggagtattcaatacaatttccttttatagtcactggaaactctgcgtgctttaatagaggatcctaactgccttggagggaagaatgacgtcttaggactcaaagccttgatacaggcaactggcttatgtgtcagtgtggtagtgatgagtgggagatggggaatcagcctgaagaactcaagctgtatagcagtaaaactttcaattagcccagtctggttaattacaactggatggtgagttggggttgggggatgtggtgggaaggctaaagaagcaagataacagggtagatttgggggttgcatacatacacaccttcagttgccgtgaaacatttcagctcagcagacagacctgttgtcctaaaagtatagcaccatgtggggctgtgggtccctccagggagaaaggagttccttaaaagcaaactcagacaagagaatggggaagatacccccagggatagtggtgaagggagaacctagaacccagccttgcaggaggatgaggtagaaattggtccaggaggaagtctatggacaatatctaaaactggagcatcaagaaatagtaatagaaatatgttgcttagaaaggtggattccagatgattgagctgaaatggagttggacagtcacaatgtatggaaggtagtgcaggtgcatcaccaacacagattcattcgataaaattaaaatgtttttgttttactttcaaaaaaataaatagcaaaaaagcaagctcaggccagtggtggctggtggcctgtcagcatggagcatggaccttagccacaggccagggctttaaagccaggactccaggacctgggatgggtcattctgaaagctgattatcagaatgctcaggccagagctgggccagctgcccaggtgttgatatgtgtgtgtgtgtgtgtgtgtttgtgtgtgtgtgtgaagggctgagaactgcatctactaacatactccttgtgtgatgttagggttagtgaattgacctacagtggtacttggcctgcaggaaggggataaaaatgggcatcatggtaagaagttgggccagcaagcagctctagtctcacaaagccttttcctggactaatgagagggaccatggggaggggtgatccccccaaaatcaaccagatcaagttcctgatgaatgggcaatttatgactgaccagctggacacaaaatgccattgaacaacccaaatgaacaacacttctcagtcaaaatgctgctttggagagtctgtgtatgcaaatatacctcatatattcttctcactgtgggatggagcaagaaggccctgagcgtgtttctctaaaaatgcatagcaataatcctagtcttaattttagcctcttctgggcatctgaaatggggttgctacagttaaaataatgctgtataactaacatgatattgggtattgaggtcagagcagggctggcttcatcagcacgtgatttctgtagtcacataggttccccactttgttaaatgctccatagccatattgaaattcttaataacttttggaccaggagccctgcattttcattttgccctgggccctacaaattatgtagccagcagtgggttgtcataccccagagtcccagacaccagccagacatttgctgtgttgaaattatataggggaaaaatataatttagagcataaataaacccccatactttcagcaatttaacagtctaatgcaggtattccttgccagtggacagctttcctccatgtggtttctactatttctgactctgctatctcccagggcctcagaatcctttgcctccagcctgtcaaatgagagaggatgaagaggcacactcacttcttaactgcctttgtctggaagtgacccacatcattcttctcatagtctggagaactagtcatatgaccacacctaggtgcaaagaaagctagaaaacatggtacctggctgggtggttactttccagggctgcctccatcctatgggaggaagagcgtaaatttagatggatcattagccttctctgccacatagattgttcatgaaggaatgctgatgcaaaagcaggtatctcagtgcagactactgtgatggatcaggaaaggtaggaatccgggtctttttaacacagatgccagtctcttagcctcatcagttcattattattaagatgcttgctagttccagaataggaagaaactagaatcagaatagtctgtgtttgtttgcttgcttgcttatttatttatttccaagaacaggtttttggggaaaaaaaaagaaacactaacacattaaaatgtacacattaactgtaagatgcattgctatttcagtaacattataatgcgagaggaaacacaatagcatatcttagaattgacgaaatctagtaattgtcactgtgaattattggtttagtaatttttcacaaatccttttgctagcttcataaagtcctttaatagtgctcataggggatagccatgtgttggcacttggatctggtaggttctgcctgaccattttaatcaaaatgctgttaaccagggtaggcaccgcctgttgaatagcacaccttcttggtgaatttgtctcatggagcctcatttctggatgtgtcttaggcaaactaggagccctcaagatcatctagacccacgctggaaagaggtctaccttggagatgcatttatattcccccctgagatgctggtgattttgcaagtagtaataatcagagacctggaaaacttcaagagttctgtaggaaatatgtcctggtcagttctcatcagctcaacaaactgatgtggctcttgagggaaccagctgcaggaggcaggaaagcaagttagcatcaacacaagtgggccagcaccatagtcccaattctcctctttcatctgcttctcctccaccctagtagacaccttgggaagacaaggtagagacagtggcttgaaattcctagtgtcttcctttgatgggtatgtgctcctgcagagttaagggagtagatgaggttaactgtcatctaaacaaaggcagtggctgtaaatatattccttggagcttgggagccccatggctatgttccaggccagagagtccaaagaaaatcaaagactgccacctaacagcttttttggccatcctgaaagtccccaccttctcccaggtagctccagagaaagacaactcccagccaggctctgacagctgaatcgaatggcccagtggtggcacattccccagagggcttcaggttcaggatgcagccaagtttcctgctttatcctgagttaagcagagatcatcacctgcctggatgttgttttgtctgtgtcacctcatcactggagaaaacagattaccatctcctgcagtttttttcacaaaacagagcatggcatggaggaaataagatagtcagcatggcatcttggtgggtcaaaaataatatcatctgtatactttgattacattttaaattcagtttgcacacaattggggttcatttaattaactctaagctgtaatctcagtctgggtttgaatggatctgaattttaatagctttttcctccaaaatattatttctatggcaaataagcagcccttccttataatgctgaaatcatagaagttagttgttttcccctcattttttgacaatcattctttttgcggtagtaacgaaatcaagcagttttcatttggctttttggtagttgaagttaatttgtcaatttcctgctagtcttctattacgtacacatttttctggttagctgacaaatcagaatgctaatgatggtggggaaaagaagactggcaaattttacttctgtgggttttaccaaaatcataattggttgatttttcctttagaccttccaggataaaggattttttatttttaataatattttcttcattctaaataagaaagtgaaatgtacaaaacagtggaaagaataaaataacttaaatgtgcctgtcatggggccttacactcaatcagtatgttaacatttttaaagaaaaataaatgcccataatctcatcaccaaacacatgtagggaatttttttggcaaagattttatatatttgtagttatgctctctataaattttgcatcaagcttttttcatttcacattttcataaataatttctcatgccgttataaactcttcataaacataattttaattggctacgtaattgttttttaggagtacatttggctgcaagtgcctgaaaacctgggaagaaacagcttaagggtttttgtttgtttttttcatggaagaagacattgagacaaggggataaggggtcattgagaccatcagagaacctcctcctgcagctctgtttttcttagtgatggtggctgcaagccaagcacagggctctcccagagaaaacagggaatcactcccatctgcagactaagccatgtgatcaccctagctcaaaaatatctgggaaggtgggctgataactttccagcctttgtagtggaggaatatgggtttcttaaaataaaatgacctgaattagaattactgtgtcaaagagcagttgatttttttccccgaaattccagtctgattgcttatttggtgaaaagcaggatttaaaaacctgtgctccatttactaccatctcatttggcactggaaacacaaatgtacaactagttataaaagtaggatcaagtccaaaacctgtggctatcagtttcggggaggcagctgtcaatgcaagataaggaaaaaattcctcaatatttagagctgccccagtttggaattaactacttcatgggatggtgagcaacctttcccaagatgcagcgactgaatagatacttggtatataggcagaagaggtaatttacgcatttggtaaagtagaccgggtgacctgtaccacctaggcatctccatgattttaaaattaggatacatttgctaaaatatttccccaagcacccaggatatcctttgcatggtggaaccttgttctgatgttgcttcagatcaaacatagtagcctgaaatgtggctgtagtagagtagttgcctgagatgggaagaattcacctcccaggctcctgactccagggccatggaaaagctctatcttgggtttgagaccagccattacctgggtcaggcccacataccagccccatccaaggttacatatctgatttcctcactgcctgttaacatgactttattatttttcctgatgccatggatttcttcttttgtatcaacaaaatgtgcatgttccttatgtaaaaggtggtataagttctatctttgacattacccaattataaaatgcagtaaacataaaaacaattttctttttgatttatttacaaaagtggtctttccaaaacagttttactagtttaactcattttatctgaactccagcttaaagctatgaagtcatgtgtgataaataaacatgcatctgagtttatgtaattcagccaagaaatattttttgaacattttctatgttatagatatatttgtggatgctgagaatgttcatggtaaatacaagacagtctctgccctcacggagcttgcattctggtgggagactagggaagaataatttatgaataaactattgaatatatactatgtttgtatagtttgtagtacagagacttggttgtgctggggagggggataccttcatagaatgttcaagaaaaaccttactaataagctagtgttggagctgtgataaaaaacaaagagtgagccatgtggatatctgggggaaacacacttctggtggaaggaacagcaagtgctggcctgagctgagatcatacttagtgtgttcaaaaagcaaaaggaaagcctagtgtggcaggtggggagtgggtgaaggagagtggtaggtgatgtgaccaaagaggtggtggctggggctggattatgaaggcatctatataccgtggtaaggatgttggcctttacttgacatgagatcagaatccagtggaagatttggagcacaagaattgcacaatctgacctattttttaaaaagattactctggctgatgtggtgagctgagttagtaaggaagtgggcaagcgtggaagcagggagactagttgggaggatattgtggtaattcagagggaaaagagatacatgtgggccaagctagcagcagaggagatggggaatcctggattgatgttgatagtatagttcaggggatttttctcatccagtagatctaagtggaatgtgagagagagaaaaaaaagtccagaatgtgccaaaggttttgaggtaagcaactagaaggatggagtttcactggaatgaaatggggatcaccatgggaaggcctgctgtgaagggaaaataggaattcaattctggacatgttaagttcaatttttggagatgttggtctgatacctaggtggaagtgttgagtggtcagtgtcttagcctgttagtgctgctgtaacaaaatgccatagactgggtggcttatatacaacagaaacttatttctcatagttttggaggcttggaagtccaagaccaaggcattagtaggtttggtgtctggcaagggcctgtttcctggttcatagatggaaccttctatatatatatgttcacatggtggaaggggcaaggcagctctctgggaccttttttttttttttgtctgaaagaattccaatattatgagcatgtaatataaacaaaggtagtgctttaatctattgggaaaaggatgaattatttaatcactagcaatgacatggagggagaaaatcaatatgaaccaatggagcctcttttataaaggcactaattcaccccctgatatggtttagctatgtcccgacccaaatctcatcttgaattgtagttcccataatccccacatattgtgggaaggactatgtgggagatgactgaatcatgggggtggttacccctgtgctgctgttctcattatagtgagtgagttctcacaagatctgatgattttataaggggctttttcctgttttgctgggcactcctccttcctgccaccatatgaagaaggacatgtttgcttgcccttctgccatgattgtgaggcctccgcagccatatggaactgtgattcaattaaatgtctttcctttataaattacccagtctcaggtacgtctttattagcagtgtgtgaacaaactaatacagtaaattggtactggtagagtgaggtgctactgtaaagatacctgaaaatgtggaagcaactttggaactggtgaacagggagaggctggaacagtttggagtgctcagaagaagtcaggaagatgtgggaaagtttggaacttcctagagacttgttgaatggctttgaccaaaatgctgatagtgatatggacaataaagtccaggctgacgtggtctcagagggagatgaggagcaaaggagactcttgttatgttttagcaaagagactggtggcattttgctcctgccctagagatttgtggaactttgaacttgagagagacgattttggggcatctggcagaagaactttctaagcagcaaagtgttaaagaggtgacttgggtgctgttaaatgcattcagttttatatattcacaaatatatggtttggaattataacttatctttaaaagggaagcagagcataaaagttcaaaaaatttaaagcctgatgttgcgatagaaaagaaaatctcattttctgaagagaaattcaagccagctgcagaaatttgcataagtaacaagaaagccaaatgttaatcaccaaaacaatggggaaaatatctccacggcatgtcagaggtcttcatggcagcccctccaatcacaggcccagagggcctatgaggaaaaggtgtttttttgggctgggcccagggccttgctgctttgtgcagtcttgagacttggtgccctgtgtcccagccatggctaaaagaggccaatgtagagttcaggccattgcttcagagggtgcaagccccaagccttggaggcttccacatggtgttgagcctgcaggtgcacagaagtcaagaattgaggtttgggaacctccccctggatttcagagtatgtatggaaatgcctggatgtgcaggtagaggtgtgctgcaggggtggggccctcatggagaacctctgctagggcagtgtggaaaggaaatgtgggattgtagcctccacacagtgtccccactagggcactgcctagtggagctgtgagaagaaggccattgctctccagactccagaatggtagatctactgacagctttcatcgtgcaactagaaatgccacagactttcaatgctagtccatgaaagcaactgggaggggagctttaccctgcaaagccaaaggagcagagctgcccaaggccatgggaacccacctcttgcatcagcgtgacctggatgtgagacatggagatcaaggagataattttggaactttaaggtttaatgactgtccactagattttggacttgcatggagcctgtagccccttggttttggccaatttctcccatttggaatgggtatatttacctaatgcctgtacccccattgtatctaggaaataactaacttgcttttgattttacaggttcataggtggaagggacttgccttgtctcagatgagactttggactgtggacttttgagttaatgctgaaatgagttaagactttgggggactattgggaaggcatgtttgtgctttgacatgtgaggacctgagatttgggagaggccaggagtggactgatatggtttggctgtgtccccacctaaatctcatcttgaattgtagttcccataatccctgtgtgggatcatgtgggagatgactgaatcacaggggtggttaccccatgttgctgttctcattatagtgagtgagttggttttataaggggcttgtcctctttttgctgggcacttcttcctgccgccatatgaagaaggacatgtttgcttccccttctgccaggattgtgaggcctccccagccatgtggaactgtgagtcaattaaacctctttcctttttaaattacccagtcagctatgtctttatcagcagtgggagaatgaactaatacacccccgaaggccctacctaatataatcacattgataattaggttttcaacatataaatttggctggtggtggtggggaggtcataaacattcagtccatagcatgcagataaatttaggagtctagaattcaaaagagacgtctgggctggctgtataaagatgggaatcatcaatgtttagatggtacttcaagctaggaggttggatgaaatcaccatgggagttaaggtaggtagagaagaggtctgagaatagagctctggactgttacaggagatggtgaggcactaggaaatgaaaataagaagggctggccagtgaattaggagaggactaagagaactagggacctagaatttaagaaagtatttctagaaaggggcagtgaccatccttatgaaaagctgctgatatgccacgaaatctgaggccagaggattgtccactggatttagtagcaaggaggttactggtgccctgaactggagctgtttagatggagaggtggaggtgaacactgggaggtctggatttaagtgagaatgagatgaggcagcaggagtgttgactccttcaaggagttttgctgtaaagaggaatagaaaatggagtagtagatgagggagattgtgggcttggaaggggatacttttagagatatgacagtatgtttgagggctgcagagaatgatctagagcctgagaaacattgatgagggaggagagagatgagacaactgctagaaggaagcacttgagttgggaaatgaggaaggcatcgagtgcacaaatagagaggctgttcttgtgcaggagtgatagcagagcccacagaatgagtgcaggtgtgcgggagcctgtggtggcttggtctgtggatgaaccttctgactgcttccgttttctcagtgaaatgggaagcaaggtcatcagctggcagggaggaagggggaagaggtgttggaaatttgaggagagaagagaaggtgtgaaataatcctctcagacagttcaggagtaattgatctaaggcaatgcagtcagatttctggatacctccaacggctcccctgtgattagggatcttgaatttaaataagagcagacagtagaaatcaggtcttgggtgtgtctccagtgttttcaactcaataggtgcaagtacaggtaggcaaagtattggatttaatctgagttgggcttttgccagctgagtatgacagagagagaggggtgcaagggaattgagggtgtggactgtgggtatgatgatggttattgatcatagaatctgaaagctggtcagagagggacatgaggtgggtgcggggcagtgaaggggtggtagaaagagtgctatgctttatttgacttaacaaactggactccttattataaattcaatcacatttctaatgcatggtggaaagttagtatgttaaaaaaaatagtacatttttatatgttaaatatcctatataatagtaataattatctgctgtgttgctgtttttattatattctttttctttatgtttttagagatggagtcttgctctgttgtccaggctggaatgcagtaccatgatcatagctcactgcagccttgaagtcctgggctcaagcaatcctcctgcctcagccaactaagtagctgtgactacaggtgtgtgccaccatgcctggctaattaaaaaaaattattttagagacggtggcttgctatgttgctgaagctggtctcaaactcctggcctcaagccatcctcctacctcagcctcccaaatagctgagattataggcatgagccactgtacccaggtatattgtattttcttaaagcaagtcatggtatacctgaaagaaaccaaatataaggcactgtagatgaatcccagtgctgttggcagaagggacagggaggccacatgtgaaccaggggtcactggccctgccccaaaggctggacttgaatatgcagctggtgccactggctaacagagccacagtctcggtcacaataatagaactgttgacccatgaggtttctggtcataggggcagaaactgccaacagggagagggcagctggccatctgaagccaggatctgtcccatccaggaaaggagaattggcaggagttggggacatcttgccatgggtgaatactcctctgagaagggagaagggaggaggcagcttacagacagaaccatgagggagggacaacatggagcccaaagccctgctcctgagttgctgggtctggatctcggggtcagggttgtttgtgagattggagaggcagcagaagtagcccagatgaaagggaagaacctgggttggtctctttgctgggcaaactctttgcaccacagtctgggctggctcaggcattggataggagtgagcctgagggtgggggtactgacccatccagcggcacaatttgggaaaggaaggggcagaagaagcaaggcgcggctgatgaggaacatctgctctcttcccacagtgcagatggaaggcctaaatgccagcacaccgtttatttcactttggcaaaatccatgtttatttcatccctcacctcattgtctagacttaacataaatcaggacagtgcaaatggaaaccacaggtccttctcttggccttgccagctttattcttccctagggcaggtgcgcatgttgcattagtgtcataaggtggcatgagactgtaccaggccattagtcctgattctgatccagcagcatcactgccttgctccgtgatcttcccatgtttgagtcacctcatccttgatatggaaggggcagtacctgttctctcagtagcataagataagaggtagggaagtgcttgggaaaatgcaataaaagacactgctggaagccttcagcagtaggttgggttacagaggtcttggccttgcaaaatgaagtgaggtcagcacagattaagcagaccaaatcaaatctttgatggttgagtgatttttaaaaatgattgcaggtctgcacaatttaacaagactgcccatagcagctgaaaacatttccagagcagatcagataaagccaagttagaaattggtcattgctgtaaatcaagtggcagactatcaatgacctagattaccccagttttcccacaggaagtgaaaggaaaaccactgtgtggctgctgaggcttgatttgtcaagagctgagagagctacacaacattaaaagattgcccatttctcagcttgccctaatgaattgggactcatttaattcagaagctgatgagatgtctaaatcacatctatagaataagtggtcagatttaaactccagttgccaacaatctgtaacggcctctggttgcgttgttcatctcttagttaataaatgcttggctttttgctgaagctgccgctttttaatgtctaacaccatgacgtcagcatttttcccattttctgccctccctttaaggaggtagggatgagaaatggtaagaagatagggcttgttatgggtcttgacttggaagacccagagcatgggtcttgaagtagaaccttgatggctcttttctgtctgtgctgcaggtttaggggcctgcatttagactggcccataactatgggagctgctcccagccatcctagacttctcaagaagcccataactcttaggaagaactaagagcctaactcgtgttgtcctggacttttcaagaagccgataactcctaggtagaaccaggaacccaactctactcgtctgtcctacgtagggtctacaaggcagtgtaacacaccacgccctgcaccctaactgatcatagtcagccgtggtgaccacaggatggttcatccttcttgctggttcccagcatccttcttgctggttcgcatgtgctcttttggcacttatcactcccacattctggactcctggccctgcagttgactttgaccctacctttggccctttgaatttgtgcaaataccactgctgagctgacttgactcattctccagctcccactaccgtttgcagtgaaggtttgtaatgcccttgatgagaatgaagctcccagtttcacattgggacacagtgggtaagcaaatgccacacaaaagaaggcacatagtgcacacttgtaccatcatctaacgtctgcatggttctattgcagggctatactttcttatcggtagatacatggaaatggaaatgcacctgcttttaaatatatacttaatgcacaagtgtcaatgatatagttttcacctgaagaaaatctagagccatcaaagtacagggcgagacatactatatgagcctgaacgattgtggcaggattctaagaatctggatgatgaatctgaagaactctgtaacaaacagatgcaaagatgccatatttagacctcagaggaagtgagcctcctgtcactgggagaatccattcattctcctgattcactcatatgcagaataagtgttgatggccttctgtgtgctagggattcaaggacagtgcagtggaaaagatgggctagtacggaggatttagaaggtggtgtgggacaataagtactctgatagagaagcatgtggtgctctcagaagtaacttgtccatgatcacaaaccagtaagtggcaatttaattttgaacacatgtatatctgacaccaagactcatctatcaaccattaagctatatcattgcataagcagttccctgtaactggattggaaggtttgagataatggtgagaatggtgagaaagaatgatggagagatggactgtcttgtatgccattttaggtagagtttggattttatcctgtgggtcatgggaatctctcaggaagtgatctagttggatatgcatttttgagagagtactccactgtagtatatgaagtaatttgaattgggagggatggggagtgggcagtaagaccactcagaggtggctatcttgatactgatccaagaatgaaatagggatagactgacatgagagagtggctgtggagatggtgaagaaggcatggatttgatagttatgtggttgaattgctggaacttggtactgattgagtaaagggtgagaggtatggagaaataaagttgatagccatgtttccagcatagacaaggggatggttgatgttgaacatggaaagagggacatattttggggaaaagtgatgagtttattttggacatgttgagatcataataccttcggaatatacatgtgagatgcctgataggaaataacatgtaggtatggaattcaggaaggagatctggttttggggacttcagtaaatctgcatcaaatagtaactttagccatggatgtgaatgaggctatccagggaaagaatgcaaaatataaggtcaacctggtgactcactgtgctgagggaagccagggaagcagaaggggagtcagggtagacagaaacaggggggtaggtgaagatgaaagaactttccaggaaggagggagtgatgcatggtgccaaatgccactgacaggcaatggtacacattctaaaaagtgtccattgaacataccaactagaaggtaactggtggccctcacaagaatggaaaagcaggttcagtgaggttgtggagtgtggagttcagctgagaggaagttggggattaaatgaagtctttgtctccctaagtggtgtggctgtgaaggaaagaagagaagtaagtcttagctagagagggcataggatttgcatggattgttttaagaagaggaagtctaaattcttaggtgaaggagttaggagaaaatagtgaaagaggtgaaatgcaggtgagtggaggataaatgatggtatggggtccctgagaggtcagggcatgatggaattcaaggtactggttattagcctttttatgtacaaacaaaaaagatattgatgttctatttatgctaagtatgggcttgtcctggggagaaagtatctttaactgaagctagagagttgacaaggaacatgtacaaagatccctggacagtgttgagagctcagataaggttggagaccacagatttgtagtgtcgttctcctacactccagggcaccttatgtaggtgtttgatcttgggaaatgagactgtgcttagctctcatttgggatttttgccagatacctggatgtagccaaaggacgaggaggcaagattgttgaggatataggaagacagtgcagtgattggaatggattgttcacatgatcttaggcgaaaagacataaaaatgaagacaggagggctatgatggactgggataagatagaggaagctggagattagaagatttgaaaagacccaagagcagaggtgtgaggacaagccagtgagagacagggaaagaggcgaggctgtggttggagtctgggccgctgcacctaaacagttccacatttagtgatgaggccagatttcagccctgagtgcagatcgttgaggagagtgaagatcaaggtcatcagagttgaggttttcaggaaactgtgggaatagggttgaatgagtcatgaacacaaacactgaagtcaccccggatgatggtgggatttcatatagctcctgtgagccaaggaatgaagtcatcagtggatgtacggaagtgaccagaagatcagctggggacagagttaaggagagagggaacaagggaacagatgagactttttccatgagggcagaggagtcatggtctggaaatgacatgaaggagaaagaaaagtgccaaacccacttcctgatcctaatgccatctggcttaagagcccatattcattgagtctgaaatgcaacggacaactaccagtttgtctggaggcggtacaaatactcttctaatatttttttaaaaactataggatgtagtctattttcaactttattcaaccagatttatttacccctaccgagttttctaaatcagtgaatcagtattttaaggaataaatcttaggcacataaaatgataggaataaaatatgtattataaagcttctttaatcaatacaagctattcttataagtctattggttaatgtctagattgccgtgcccacttaaaatgggaaaacattccagttggcactttgtggatgttgagttgctacttggacacagttactggccttttggtctgatcagaggccaattttgagctaggagtttcccatgcatatgcatgatgtcctactatctgtgatacatgctgggcatctgagcctgcctggtatgctaatgatcagaccagggaaatgcacatcactgtgagtcacaagggtagcacgtctaatctaaaaaattcaaacccctataattagagttcagatgtcttcatagctctattcctcagatttttttgatctgaaaaacaaaagcaaacaacaaacaattgtgtaaaaatagacagtctaggcttgtgtaaatttgcagtggaaatctgcctctctgatgagccatacagtgtctatgggttgaaaaacgaaattcagaaagcaaatagttggtcaccttagagcccagagggatgctcagaattccctaacctcacagcggtgactactgaaagtttcattctgttttatgacttgacttgcagcgaggaaggtagcacagctgtaaaccagctgtattttatttacgcttggaaacagggcccctttgttccaaatgttcctggccccctccctcaatttcatggatttaggttgttagtggaaaagtagttgttgaaatatcagttcactcttggaacctgccactcaccaggacttctggcaaccagtgagcctttttgtgatatgcagcaaggtaaagaagtcgttaagtggatctcccacatgttcctctgtgacttcattcatagaaatgcgctgataactgagttacattaagcgcagtcttcccagctgtctgaggacataagggatgtagcgcctcctagtggagggaatttcttagcatgtgttcaaccccgcacatatttttggaatgaggcaaggtatttaaaaatagtgtacgctaatgaatgtatttattatatctgggtagcagcgaaacagaaaaggtataaataagcctttcgaaaaatgtacttgctacacaatctctttttttttgacaagtcagcccttgaatacaaataatcttttaatggtgaaaaaaatgactgaatcatagcatcttataaacataggagctatgggtatcaataacatggaaactgaagctgtggttatttttgagtggaagaagagggattaaaattggcgtggggcacatggagaggcttctggaagtggctagcaatttctatttatttttaactgggtggtgattacaaaggtgtttgccttataaaaattcatttagctaaacattggttttatgatgcttctgtatctgtattgataagaaggtaaaaaacataaaaacttttcattaaacatactacctgctaaatttgctttttaaggaaaaacctcaaaaatgctaagccatgtatactttttatttttagagatggagtctcactgtgttgcccaggctgaactcaaactcctgggattaagggtttctcttgagtagttgggactacgggcgtgcctggcatggttttgacactttatttcactgtactttcgaaataagacttaggtaccagtgaacacctacattgacaggcctggtaatatcattaaaacttgagcttttatgttgtctgtggcacagactctcttctttctagttcttcagagaactccaaattcagtatttcacttggaacatccagttgccatagaaatgaccatgtaggttacaagttcatttttgtaaccagtcaaaaggagaaactaagaatgacacgaaggcatctttccattggaaaaaaatcctttgcagagtcccaatttgagaaaaaatacattttgctttagaagtgagaggcgaacagatgaattagtaatgctgaaatatttgactccttcccccacaggtgaaaactcctgcagagcatcttataagaaaaattattttagagcaatataggtgatggcaaattgacattgggttgtaatattctatccaacatagtttaattctgagttattcaatcataactaaatttattcaagacatagaatacatttaaaaattcatcttaaaggaaatttcacaaaggcttttacattcgtgtaatccagatgagaaatgaagatagggggcgagcaacaaagttgaaagacccaaattgattccggaaggacttgccaagtttctataatgcctcattagctgcttatgtggcagggagacctgggaagagcaataactcttttctaggttctcaggttagggaatgagattttgacgtggccaatatgatcttatatgtccatttatgtcttttaccttatcattttcttttaccttatcatggacagagtggccccccagaagcacaggatgcaagacaacacacatttcagtggctgctccttctgcatacatcattgagctctgccaagggtttgaacacacacacacgtaaataaaggcctaattatgtgtgtgtgtgtatgtgtgtgtgtgtgtgtgtgtgtgtgtgtattatatgtattaagctctttttcctttctccatagcactgcatatacaaagatcagccaccctgagttgaaataaactgtcatgatctgtttggcattgtgagatcaccactcatcataaaataagctttttaaaatgttaaaattgaagtgagagcatgagcacaaagaaacaaggaccagaaggtgtttataatcatgaaaaattgggaacaattcaataggaaaacaggaaaatggttaaatatgatatgttcggagtatggaatatgatgcagcagttacaagtagtaaaatagatcagtatgtactgacatgaagaaaatagacttacacataccttatgtaaaggaggtgaggaaaaggaacaatggtcttttctgtattattagaatttgaatatcaaaattggattcatatattacttatataattaaaaaattaagttagtcagacttagaactctttgaaatctaatttttgaaagttaatttatgccatctggaggcaaacatgccaatgtgattgaagtttcagtggtaacctgaatcctcagtctcgttgcacatttactctgaagacattctcaaaagagaattggagaggaaatccacccagtgtgtcccctcatgtatgtctgtctgggatgctccagtggtgagatgccgtcacctcagtccattgtgttagtttattgcaatgttctagggttcagtctcagccccattcctgccaactgttagcttaaggcccttgggcaaaggagataaaattgttcagggccaacagatctcagagtttcttggaaccttaaaaggagatgacccaaacatttcttattcaagatgccaccagctccagtcactcacagtgacttgccacaggggctggtgatgttagctgcttccttggcgtctgagttctggcttgtgagcagatcttatgcccaatacatcagaaactccatgtctccttcagttgtagtcgttgggagaatccatgggttgactggagcctaaggaaagcaccaaaaagtcactagaggcactggagtggatatgaccttttcctttgaacagcagtttgcacaacatataccggtggctttgtagatctggttttcattaccatttctgtcctggggcagccatggaagccacctggatatttcaattagtgcagcaagctggaattcatttactttagagtctactgcctgaagcttctcccagctgggcacccaactacgcccaggaacttctagatataacacagcatcctgatttcagtctaataagtagatctattttagtcttctcaatttccagtcattttgaaagtgctcccctgtccccataccaggcatgggttccattcccaacttctatcactgtcagtggaggtggcagccttgtgagctgccaggtgggaccaggtgcaacccacagcaaggccacttgatgtctcagtctgtagagtaggtgcttaataattgtctttgacgagttaatgggtgcagcacaccaacatggcgcatgtatacatatgtaacaaacctgcacattgtacacatgtaccctagaactgaaattataatgaaacaacaacaacaacaacaacaaaataataataataattgtctttgaatggctgactgaaagcacattcatattatctagtcaaatgaatgtccaccctccactatagagcctttgtaactgagctactggggtctacctcatttcagaatccctcagagtccatggtgtatccattcatgcattcattgagcaaatattatgtacctgttctgtgttagagaatatttgaagtggtgggaatatagtggtgagaaaggcatgtttctgccttcaagacatcaccatatgaaagatactctgggatggatggagggtgttaatagaaccccagcaaattgacaaggtggctccccctgtgtcctctggctagtaagggactggtggctccatgaaacagggagctgccctgtgctgcccaaggctccagccctgcttcctcctcatctcccccctggacgtgactctgcctcatggggagcccattctcttagggatctttgtaaactgatcttcttgtgtcaaaaacatcaaatgcctcagattccattgcttataataagcactttgggaccaaaggaattttttgtaatgaaaaaaacagtttttcataagttaatgtttttcctttgagacctggatgcccttctcttattcatccactgcccatgcagctaatcagatttgaagggtaaaataataccagacttatcattgcatgttacatgagaaatgtattagttaggagtctggggttctaaggcatagagacagcatgagctagctcaaggaaaaaggggagggaattgttataagggcacaggggtgccccacagaatcgaaaacagaaatgtgactaggcctaaggaaagcgtcaaaaagtcactagattttttttctctctttcatctctcttcccatcttccccatccatctatccatccatccatccatccatccatccatccatccatctatccatccatctctctttccttctctccttcccagctcctgcctctgtatttcttcctccttttttcttccaactttcatttcaggttcaaggggtatatgtgtgcatttcttatatgggtaaattgcatgtcacggggggttggtgtacagattactttgtcacccaggtaataagcatagtacctgaaggtactttttggacctcacccttttcccaccttctaccctcaagtaagccctggtgtctgttgttcccttctttttgtccatggtatactcagtgtttagctcccacttataaatgagaacatgttgtgttggtttttggttcctgtgttagttcacttaggacaacagcctccagctctatctatgttgctgcaaaggacatgatctcattattttttatggctgtgttgtattccacggtgtatatgtaccacattgatgtccaccattgatgggcatttgggttgattccatgtctttgctgttgtgaacagtgctgtgatgaacatatgtgtgcatgtgtctttatggtagaatgatgtatattcctttgggtagatacccagaaatgggattgctgggtcgaatggtagctctgttttaagttctttgagaaatctccaaactgcttgccatagtccgcctctgtatttcttcctccacctagcttcctctgctttctggtccatgaggtcaatcaaatagggttgccccatagtgtctaagttttcatgtcaccagcccagccacatcagagagactctcgtcagatcagctatggccagaggtcatattgttccatagtggttcctggatgcagattaacttccagcgaaaagggacacattttgagcaggacagacatggccaaagctatctaatatgcccaagtctacacacacagacacatgcccaaatccctctcatggctacacatccaaccagagatggtcaaatggaccctgccctgaacccacatgggaggatatggttctgacttgagctgcaggatcccagggcttgtgttgaggtgggaacagccctggacctgagccagaatactggggctccagtcatggcttcaccattaaacaactctagagtcttaaacaagttcttagcctgtctgagtctttattttctgtataaactgggagtcacagaggcagctttcaattatttaaaggaccactttatgggagggggataggtgtgttacctgtctagtgttggaaggtgaaaccacagtggagaccacagagtggcaatttgtggctggagatacagaagaaccttctcccaatcaggctgccccaccatgttcaacctgcctgccttgcagagagttggctctccctgttactgtgggaaatccaaggggtctcagaaaacatctacagaatggagatactggcccatttcctagcaggattatctgtgtttgtctgggggtgaggggagtaaatagaagtttgagtgctacatacaaatgtgtattttttgcattgtaatcttaacaaacagaaagaagtattttgctccagtttgtatattctttcaaagcctttgaaccacactttatttttttagacaggatctcactctggcgcccaggctggggtgcggtgttgtgatcatggctcactacagcctcaacctcccccagctcaggtgatcctcctgcctcagactcccaagtatctgggactacaggcacataccactatgcctggctgatttttgtatttttgtagagacagggtctcactgtgttgcccaggctggtctcaaactcctaggctcaagtgatcctcccatctctgcctcccaaagccctaggattacaggtgtgagccactgtgcccagctgaagcacactttttagtgtgtctgccacaagggtttccaaggccactagctggcagaaggataaggtggaaatgtaaatgacatgcccctctcttcatgaaaacaatgtcagttgttcctctcagtccccaccataacagtttctgaaattctttctcacctccttcacttatttatcctttctgctccctgctagactgctaggggtggggacaggagtgatgtctgatcaccactgcctctgtgaccataacctctgatactgtcatttcttctttccaaagtcttggctatcatttgaggagctgagacaataggatagttctgctttcacagagcatattagcaaataccctgtgtgaggccctaatgacatatttggccctttccatctttggggctgtaatattccctacagatggaccctttggttaagtctccttatgttgcttttagttttcatcaatctctggttggtttttagaactactaaatggagccattaggtcattcaaaaacaggcagatgtatgtatgtttgtgagccatgatagggatccagaaatatttacataattttcatctattaagagatttaacagctgtgtctgccatgtagttactttaaaatataaaatgcaaggtcagatctcttggggatactgttttgtttttcttttcttatgattgctgttaacgatgtcatgtttaagtaaggaaagaaggttttgatattcctctaagagttaccagcctgtggaggagttgtgctccaagaggatcgaaggcttagaattcaaatgtaaaagtgtttaccttcttaggccagtcatctgatcaacacgtaatgtagctgaattagtacacatttccaaagaatttacgaaacaagacaccttgcaaaactagcagtcaaataaaacagaactctaaaattgaatttaaagtacagttttgtctggctagccatatgtagaaagctgaaactggatcccctccttacaccttatacaaaaattaattcaagatggattaaagacttaaatgttagacctaaaaccataaaaaccctagaagaaaacctaggcaatatctcattcaggacataggcatgggcaaggacttcatgtctaaaacaccaaaagcaatggcaacaaaagccaaaattgacaaatgggatctaattaaactaaagagcttctgcacagcaaaagaaactactatcagagtgaacaggcagcttacagaatgggagaaaatttttgcagcctactcatctgacgaagggctaatatccagaatctacaaagaactcaaacaaatttacaagaaaataacaaacaacccaatcaacaagtgggcgaaggatatgaacagacacttctcaaaagaagacatttatgctgccaaaagacacatgaaaaaatgctcatcatcactggccatcagagaaatgcaaatcaaaaccacaatgagataccatctcacaccagttagaatggcagtcattaaaaagtcagggaacaacaggtgctggagaggatgtgaagaaataggaacacttttacactgttggtgggactgtaaattagttcaaccattgtggaagacagtgtggcgattcctcagggatctagaactagaaataccatttgacccagccatcccattactgggtatatacacaaaggtttataaatcatgctgctataaagacacatgcacacgtatgtttattgtgacactattcacaataggaaagacttggaaccaacccaaatgtccaacaatgatagactggattaagaaaatgtggcacatatgcacaatggaatactatgcagccataaaaaaggatgggttcatgtcctttgtagggacatggatgaagctggaagccatcattctcagcaaactatcgcaaggacaaaaaaccaaacaccacatgttctcactcataggtgggaattgaacaatgagaacacagggacacaggaaggggaacatcacacaccggggcctgttgtgggggtgggggtaggggggagggatagcattaggagatatacctaatgtaaatgatgagttactgggtgcagcacaccaacatggcacatgtatacatatgtaacaaacctgcacgttgtgcacatgtaccctaaaacttaaagtataataaaaataaataaataaataaataaaatacagttttgttttgtatcatgaatattgttgctacttgggaaaaacatgtttaatcaggcactaaaggggcagctgaagtgtttgatggtgattctcaaagggattcttggacccctcaagagttttagaagatagtgatgctagtattttattatgtataattatactgtaaaatacatttttgatacattataattacttctgtttatgacttaggtagtttttgccttgcaaaagggagatagggaaagaaagtttacttaaataattggaagcaaagggggaatgaggagaaagctaatgaagatgtgaatatttgtgaggaaaattgcctgtaagtgtgaatagggtgtgaatggagagtggatgtgtctggcagcacctcttcttattcttatcatcttactggggtgattgaagttgcaaacacatggcccttcacttcttttgtaaacggacataattgatccaacacagcatgattgctttctagtgcagcaattttcagaatactgccttctcaaagatatggttctcctgattgattatgaaatgagataaaaatataagtccttggtttaataagtgatgaacaagcccataaaatactaggtttttacttttgctagagtaatctactaagtgagttattaagggcctttctgaactcaagttagtgtgtcaccatagactctaattagtctgaggactctaattagttctgctaaaaagtctcactgctattcggtgacaaagctcctataatgtggcatgcatgtaggcagttgtagtttccaaaaaagaaagaagtaggtggagcataggatgctcaaagtagacaatgatcaaagacttttgagagtcatcagtctaggaaagttattctcaaccctggctgggtatcagaattgtctgtagtgcttctaagaattatgagttatggccagacgcggtggctcatgactgtaatcccagcactttgggaggccaaggcgggtggattacaaggagtttgagagcagcctccccaatatggtgaaaccccttccctactcaaaatacaaaaattagccaggcatggtggggtatgcctgtagtcccagctactcaggaggctgaggcagaaaaatcgcttgaacctgggaggcagaggttgcagtgagccgggatcgcaccactgcactccagcctgggcgacagagtgagactccgtctaaaaaaagaaaaaaaattatgagttgctggactgcatgatgatctactgaatgagaatccattctccccccagtaaacttttcctttatctcctttatctcattggcaggcactcattcacaggtccactcaagacagtcacggacaaaaggaaacaggattgtgaggatttagccccatggggctagagcactgctactgaaaaaaaaccaccctaactatatttgcagctttacggtgtgtaaaacttcagtttaaaaacaaaagggaaaaaaggtctctgccttcaaagattataagctattcattcaaaaagaccaaacattgtaagaaataactggataattaatccataaagggcaagagaagtagagccagcttttattgagtacctgcctacctgtgtgctgtgtgctgtgtgctgggtgagtactttatatatgtcacttcctttaatcctcattttaatcttcagaggtcagtagtgtcactggcattctacagattaaaatactgtagttgagggaatttaggggatttgaattgcatttcctctctagaatggggtgagacagaagtggtgtccttctttcaggcatctaggtttgtttctttggggtgtgtatgtgtgtatgtttccatgtgtgtggcagcttaccaggctatgtcccaattaataaggagatgtatcatcctcattccagtttttcaaatgtgacttgaccaaaatgcattctattcctattctttgagtttatatgccagaaatggagtgggcatgtgtgtcttctcaggactaatccatgcatgaagctctttgaatcagcacaatattgtacagcctagttgcgttctgttcatcaagcatcggtcgatgatttattgacaatgcaaacaagtggtctgttcatgtgagttcatgatgatttgtgagtgcttcctgcccatctgctctctcattttaagtgtgctctgtaatataaaaatgatagtcatacaataattctattggggtagatctgtaccactacccagagatatttgtttgacttttactattattttacaaaatgggaatttctttcacaaagaagatgagttcattgtactttggctttttgtaagagaaagtgaatgttgtgacactgacatgaataaatgaattcatgttttctgatcccgtggaaaggaaagaatagaataatatcagcacgtggatctcataatgaaaggggagtaaagtgagtcttcagaaacagacttaaaataagctcaattcattgtaattagaaaatggatcttgaaagggccttgccaaaaggcgatgatgtgatgttggggtgtagaagttttttgacagtggactcttttatcacagaatgtgaggtgaggcagaggaaatatgattcatgttatagtgctttagttattgattacataggagtttgctttctccagctcttgttcatagctgctaactggcatacagaggaaatattgtttacttatttaaataatttttaagatagtgaaaattctgtatgtttggttaaattatacttggttgtttgcataggctgtctctccctgagacgctcacctcacttctctatgggtcagcgaaacacataccctgtgtaatcacctcccctataaaaccccatggcaacctcttccaacaattcatcctttgcattccatccaagtatgtcttgttatatccatagcatttagtgcatttattatttcctctcctgctttcctctactagattttgagagccttaaggactagagagtgactgattcatccttgtttccccagcaccctggagcaaagagcccagcacatagtagttgcttgtggtgaatgtaattcagggtgtcttaggactatcctgctcattatgaatagaggataaaaacagatttctaagttctccatctgccataaaattctgggaagaaaaaatatgaagtattcctttctgcacacacagaagtcttccattttgcaattttctatctagtctgctgtcctttctctctcttctttatcagggctacacatcctctctcctggccagagcgtcatttgaggcgtgcttatgcagttctcattgtcttcaattaaggtttgggactgagattaccagcttggcttggtaaccctgttcacttattaaaaaatcagtcgatccttcatttttatgaaaagatgcaatgcaaaataaccttgatttagaatttaatgaggctgacatttaacctgagttcagttaggaagacaaacaaaaaacacagacaaagttgagagaaggaaaataattacctacttgaatagtgtgggcaattctccatccatatgccccaggagaatatgaggtgggagatgcatgaattacctgaaatttcttttagcctctgtttatgattttagtctttcaagatgcaggtatgtttttcaggccttgtggtccccaaacacaaggaaactttctttatctgatggtcaaaagaagtgacgacctagtccttagtaggagaaaaatgtgcctgcatggactctttgtgagacagtgttgttggatactttatgaacattttaagggattctcatgagtaattttgattatagacgatttttactttatgcattgactaggaaccaaatgcaactttcttagagagacacaaaattcattgtccaaatagaccatagggtcagcaggctttgtaaacatgttttgtatgtgcctaggggttgagagcaggggcgggagaggttctggtccgttcatcaaaccaggggctggtgttaatgtttgatcaacaaaacacatgtaggcctaggctctgatctaggtccaactgccaacatagccttttcatgcctgcctttcctacttcaggtagagagaggagaaaaaacctattgaggaaaaaagaaagaataatattagcccaagcagtggttctactcacttaaggagaatggagtatgtttatttaattttaactgaaaagtcctggccaatatttctaagcctggcttgggataacagaatgaatggccttgggggagagggaggagaaagaagatgactgattttagtgtctgctttatggtgtgtgctgtttaatcctcatgacaatcctaagtggaaggaagaactccccatgttaccagtgacgcagcggaagcccaggtgctactgaaggtcacgcagtcagcattgacgaagtctacactagaatccaggcctgacacaacccaaagtctgtattttttccctctgcagtctcttaaaattggcaaaaggtaaaccttcatgcgaccctagatttgattggaacagcagatttaggggtcatgcaacaggagaatgagtggattataagtttttgagtccccagatctttggggagaaaacccaattctgttgaagtaggagctgttcaattggaggtgagatttttagtagggatttctaatgcattcttttttcccattgatggttgttaatacttcccctacacacacacacacacacacacacacacacacacacacacaagcataaatagggcacacgtattctcccatgtaagggctgctgtcccttctccctcccacttatagcgatgtgtgcctctctgtagctgaaggttgccttgtattaggacactgactgatgagtactccccaccagggtccggagagtgtgcttcattcacctttcagcctctcacagttctggcacaggggagataaagatgttgatggtttgaggtgctttttggtaaataacataggcaaacacttgacacccctaggctaccacctgtcctgttgtgtggatacctattcagtgaagccagataacttttacaaatcacaatgaatacatcctcagcagagccagttgcctgagggaggttactgaatcttctgggagtcgtttgcaggcctttagacactgggctcctttctggaccatgcccaaactagtgacagatgcagtcagagtagcagaataaggaagtctaaagtcacccaagcctcttagttcttgataattgacatgtccagcatttcttgaccatcagtagaaaatactaaactttacagtacataaaataatcaattcattcctctgatggggcaactatttaagtcagtatggaactctatctttctgattgctgcattagtccctttttttttgtttattttgcttcttagtagaaaagaaaaatctaaaagattctcattttaagtgacttgagctatcagttaaattttaaaagccaattattttgaagcagtagagccttacgaattctaaagtcacacactggaagccaaactatctagagtataaatatttccttttgagggggatactgacagattcttctattttatcccaattccagttcctgacctccactcacagacagggaggcaaggggaaggctcactaattggcaaggctggacaagcataaaggattcagtgcataaagaatcaagcttctgatcctctcaagaggtcacacgcagagtgtctatgtgctggacagctttggctgtacacaccagaagtgttccaggcgtaaggtttttggcaagtctcgttgcctacgttcaagtcctctctgagtcgcttactagtgtgtaaacatagctgagatatataatgtttctaagcctcagtttcactgtctgtaaaatggcaatgacaataactgtacccacctcacaaggatgctgtgttgtgaggtgtgaacgagccatttgtgtcagaacatagcacagtgctgggctcacactaagcattccattcatgtcagctactagctctttggaacttttcaactttggtccctagggctacattaaccctctttcctgccagacaataatctgaggttggttgctgctttcagaagaaacagtgtttgaaagctaagaaaaatgtacctagaaatctaatttctaatttcattgtcatgccttaacagaacacccagatgccttaaaagacttttacaaaatgcaaatttctgatccagaaaacttctcagccatagtgccaaagaacattatcagacccaattccctatatcccaacaaaaccactccccagtcacagattatccgacacaatttcattggggttctcaaatggcaagagtttgtttaaaatgcaaatctctgagccccaccctcagagaggccagcggggcagtggaatatgcactgaacacttcgggcactaactcgtgtgccaatggttgcacttggacatatactactctaggcctttgggctcctttcgtccctgcagcaccttctgtcctcaagacaggggctctcttgttttcctcatgcgagagctgttgcccagctagtccatcccactgaggacaaactctgactcaccttttaagatgtagttctctggctaggcacagtggctcacacctgtaatcccagcactttgggaggccgaggcaggtggatcacgaggtcaggagtttgagaccagcctgaccaacatggtgaaaccctgtctctactaaaaatacaaaaattatctgggtgtggtggcacacacctgtaatctcagctactcaggaggctgaggcaggagaattgcttgaacctgggaggcggaagttgcagtaagccgggatcacgccactgcactccagcctgggcgacagagtgagcctctttctcaaaaacaaaaaagaaaaaataaaacatgaagttcccaaccatgtgctgtgtagtgagcaccatggtggccctgcagtgtacaaaggtgaattggccatggtgtgtgttggcatggagctcccagtccagctaagaatacccttcagggccaagctgactccaccctgtttcctgaggcccagtcagcggtcccagcttctggtctgtgggctcacctagtttaaagacccccttgagcctcaaaggatgttcgaagcatgattcagttggggagttattggtcaacatggtgggacaattcttcactgtgtgggactgccctaaacagtacagggtacttagcatgtctgccctcccaatgctgagtaccagtggtgctccacagtcactgtgacaatcaagaaaagtaatgattgccacatgtttctgaatacccctgacctctggggaataatactgccccaagttgagagcctctgtccggtttaggtctttctcctcagtccatacctctgctacctccttaagggaccagttccctccaaggggcatgctttcttagaaaagtcatttgatggccgggcacagtggctcacgcctataaacccaggacttcgggaggccaaggcgggcagatcacctgaggtcagaagttcgagaccagtctgaccaacatggtgaaaccccgtctctactaaaaaaataaaaattagcaggacatagtggcatgcacctgtaatctcagctacttggcaggctgaaacacaggaatcgcttgaacctgggaggtggatgttgcagtgagccaagatcacaccactgcattccagcctgggtgacagagcgagactccatttcaaacaaaacaaaacaaaacagaaaagaatgtcatttgacagtgtacaaagtttatatattttaacatacaaatgaagttgacatggtatcaaccaaagggaaagaagggccattttgtaacaggcagaaaccagttgggatttaagaagcattttaattacccttactttttttctataaaggaaaatacttttatttctttcactgatgtgccggtgagagtcttagcaggcttgcctttgtaggtaaatatgatggcacttcccaatcatcatgtattgggatgtgaagttgtgtggagtctgaggctgacccctggtagtgtgaggaccttgggggattgccttggaaaatacagggtccagcccaaggctctggctttcagggtcgggggttgagatgaatttgtcacagctccgcctgagctcaccacactgggaagtcaaacagaggcaacagcttctgtttgctaagtgttaccacatgctaggcactgtgttgagtatggtgaaggacctcttaaatcttcagaacaaccgacgtttcagcattttacagctgcaaaaactgagtcttagcaaacatggtcttagagccacgagaatggacctgggacttaaatcccaagtctagagcctggacttgaccacagcagcatccagcttctcacccatctttcgctcaattcatccctttaatcatttattttaggattcagtttgattcccccaatctcaaaactttcaaggatgaacaatacttctcacacaaacacaccttctaccgaatgccaggaggggtctgcacttagattcctcagctgtcacagtgccattgagtctgaggctgcctgactgcttggttgtggttttttgacacctggcatttgtgtttaacagccccagtggttgagaagcagaggggacccacactggcagaggtggagggaaagaggagagggtgtagggaaagaggagagggtgtagggaaagaggggagggtgtagggaaagaggagagggtttagggaaagaggagagggtgtaagggaagaggagagggtggagaggtagaggggagggtgggggaaagaggggagggtggagagatggagaggagggtggagggatagaggaaagggtggagggatagaggggaaggtggagggaaagaagagagggtgggggcggttccaagatggccgaataggaacagctccagtctacagctcccagcgtgagcaacacagaagatgggtgatttctgcatttccaactgaggtactgggttcatctcattggggcttgtcggacagtgggtgcaggacagggggtgcagcacattgagcattagccaaagcagggcgaggcatcgcctcacccaggaagcgcaaggggtcagggaattccctttcctagccaagggaatctgtgacagacagcacctggaaaatcgggtcactcccaccctaatactacgcttttccaatggtcttagcaaaaggcacaccaggagattatatcctgcgcctggctcagagggtaccacgcccatggagccttgctcattgctagcacagcagtctgagatcaaactgcaaggcagcagcaaggcttggtgaggggtgcctgccattgctgaggcttgagtaggtaaacaaagtggccgggaagctcgaactgggtggagcccaccgcagctcaaggaggcctgcctgcctcagtagactccatctctgggggcagggcatagctgaacaaaaggcagcagaaacctctgcagacttaaatgtccctgtctgacagctttgaagagagtagtggttctcccagcatggagtttgagatctgagaacggtcagtctgcctcctcaagtgggtccctgatccccgagtagcctaactgggaggcatcccccagtaggggcagactgacacctcacatggccggatacccctctgagatgaagcttccagaggaatgatcaggcagcaacatttgctgttcagcagtattcactgttctgcagcctcggctgctgatacccaggcaaacagggtctggaatggacctccagcaaactccaacagacctgcagctgagggtcctgactgttaaaaggaaaactaacaaacagaaaggacatcgacaccaaaaccacatctgtacgtcaccatcatcaaagaccagaggtagataaaaccacaaagatggggaaaaaacagagcagaaaacctgaaaattctaaaaatcagagtgcccctcctccaccaaaggaatgcagctccttgccagcaatggaacaaagctggacagagaatgactttgatgagttgagagaagaaggcttcagatgatcaaacttctccgagctaaaggaggaagttcaaacccatcgcaaagaagctaaaacccttgaaaaaagattagacaaatggctaactagaataaccagtgtagagaagtccttaaatgacctgatggagctgaaaaccatggcatgagaactacgtggcgaatgcccaagcctcagtagctgattcgatcaactggaagaaagggtatcagtgatggaagatcgaatgaatgaaatgaagtgagaagagaagtttagagaaaaaagagtaaaaagaaatgaacaaagcctccaaggaatgtgcgactatgtgaaaaaaacaaatctacatctgattggtgtacctgaaagtgacggggagaatggaaccaaattggaaaacactctgcaggatattatccaggagaacttccccaacatagcaatgcaggccaacattcaaattcaggaaatacagagaacgccacaaagatactcctcgagaagagcaactccaagacacataattgtcagattcaccaaagttgaaatgaaggaaaaaatgttaagggcagccagagaaaaggtcaggttacccacaaagggaagcccatcagactaacagtggatctctctgcagaaactctacaagccagaagagagtgggggccaatattcaacattcttaaagaaaagaattttcaatgcagaatttcatatccagccaaactaagcttcattagtgaaggagaaataaaatcctttacagagaagcaaatgatgagagattttgtcaccaccaggcctgccctaaaagagctcctgaaggaagcactaaacatggaaaggaagaaccagtaccagccactgcaaaaacatgccaaattgtaaagaccatcgaggctagaaagaaactgcatcaactaacgagcaaaataaccagctaacatcataatgacaggatcaaattcacacatcataatattaaccttaaatgtaaatgggctaaatgctccaagtaaaagacacagactggcaaattagataaagagtcaagacctatcagtgtgctgtattcaggagacccatctcatatgcagagacacacataggctcaaaataaagggatgggggaagatctaccaaggaaatggaaaacaaaaaaaggcaggggttgcaatcctagcctctgataaaacagactttaaaccaacaaaaatcaaaagagacaaagaaggccattacataatggtaaagggatcaattcaacaagaagagctaactatcctaaatatatatgcacccaatacaggagcacccagattcataaaacaagtccttagagacctacgaagagacttagactcccacacaataataatgggagactttaacaccccactatcaacattagacagataacgagacagaaagttagcaaggatatccaggacttgaactcagctctgcaccaagcggacctaatagacatctacagaactctccaccccaaatcaacagaatataattattctcagcaccacatcacacttatttcaaacttgaccacttggttggaagtaaagcactcctcagcaaatgtaaaagaatagaaattataacaaactgtctctcagaccacagtgcaatcaaactagaactcaagattaagaaactcactcaaaactgcacaactacatggaaactgaacaacctgctcctgaatgactactgggtacataatgaaatgaaggcagaagtaaagatgttctttgaaaccaatgagaacaaagacacaacataccagaatctccgggacatatttaaagcagtgtgtagagggaaatttatagcactaaatgcccacaagagaaagcaggaaagatctcaaattgacaccctaacatcacaattaaaagaactagagaagcaagagcaaacacattcaaaagctagcagaaggcaagaaataactaagatcagagcagaactgaaggaaatggagacataaaaaacccttcaaaaaatcaatgaatccaggagctggttttttgaaaagatcaacaaaattgatagaccactagcaagactaataaagaagaaaagagagaagaatcaaatagacgcaacaaaattgataaaggggatgtcaccaccaatcccacagaaatacaaactaccatcagagaatactataaacacctctacacaaataaactagaaaatctagaagaaatggataaattcctaggcacatacacccttgcaagacacatacacccttccaggaagaagttgaatccctgaatagaccaataacaggctctgaaattaaggcaataattaatagcctaccaaccaaaaaaagtccaggaccagacggattcacagccaaattctaccagtggtacaaggaggagctggtaccattccttctgaaacgattccaatgaataggaaaagagggaatccttcctaactcattttatgaggccagcatcatcctgataccaaagcttggcagagacacaacaaaaaaagagaattttagaccaatatccctgatgaacatcgatgcaaaaatcctcaataaaataccggcaaactgaatccagcagcatatcaaaaagcttatccaccatgatcaagtgggcttcatccctgggattcaaggctggttcaacatatgtaaatcaataaacgtaatccagcatataaacagaaccaaagacaaaaaccacatgattatctcaatagatgcagaaaaggcctttgacaaaattcaacagcccttcatgcgaaaaacactaaataaattagatattgatgggacgtatctcaaaataataagggctatttatgacaaacccacagccaatatcatactgaatgggcaaaaactggaagcattccctttgaaaactggcacaagacagggatgccctctctcaccactcctattcaacatagtgttggaagttctggccagggcagtcaggcaggagaaagaaataaagggtattcaattaggaaaagaggaagtcaaattgtccctgtttgcagatgacatgattgtacatttagaaaaccccaaatctccttaagctgataagcaacttcagcaaagtctcaggatacaaaatcagtgtgcaaaattcacaagcattcttatacaccaataacagagagccaaatcatgagtgaactcccattcacaattgcttcaaagagaataaaatacctaagaatccaacttacaagggatgtgaaggacctcttcaaggagagctacaaaccactgctcaacgaaatagaagaggacacaaacaaatggaagaatattccatgctcatggataggaaaaatcaatatcgtgaaaatggtcatactacccaaagtaatttatagattcaatgccatccccatcaagctaccaatgactttcttcatagaattggaaaaaactattttaaagttcatatggaaccaaaaaagagcccgcattgccaagtcaatcttaagccaaaagaacaaaggtggaggcatcacgctacctgacttcaaactatactacaaggctatagtaaccaaaacagcaatggtactggtaccaaaacagagatatagaccaatggaacagaacagagccctcagaaataataccacacatatgcaaccatctgatctttgacaaacctgacaaaaacaagaaatggggaaaggattccctatttaataaatgatgctgggaaaactggctagccatatgtagaaagctgaaactggatcccttccttacaccttatacaaaaattaattcaagatggattaaagacgtaaatggtagacctaaaaccataaaaaaccctagaagaaaacctaggcagtaccattcagcacataggcatgggcaaggacttcatgtctaaaacaccaaaagcaatggcaacagaagccaaaattgacaaatgggatctaattaaactcaagagcttctgcacagcaaaagaaactaccatcagagtgaacaggcaacctacagaatgggagaacatttttgcaatctgctcatctgacaaagggctaatatccagaatctacaaagaactcaaataaatttacaagaaaaaaacaaacaacccaatcaacacgtgggcaaaggatatgaacagacacttctcaaaagaagacatttatgcagccaaaagacacatgaaaaaatgctcatcatcactggccatcagagaaatgcagatcaaaaccacaatgagataccatctcataccagttagaatggcgatcattaaaaagtcaggagacaacaggtgctggagaggatgtggagaaataggaacacttttacactgttggtgggatgtaaactagttcaaccattgtggaagacagtgtggcgatagctcagggatctagaactagaaataccatttgacccagccatcccattactgggtatatacccaaaggattataaattatgctgctacaaagacacatgcacaggtatgtttgttgtgacactattcacaatagcaaagacttggaaccaacccaaagtccatcaatgatagactggattaagaaaatgtggcagatatacaccatggaatactatgctgccataaaaaaggatgagttcatgtcctttttagggacatggatgaagctggaaaccatcattctcagcaaactatcgcagggacaaaaaaccaaacaccgcatgttctcactcataggtgggaattgaacaatgagaacacttggacacaggaaggggaacatcatacactggggcctgttgtggggtgggggtaggggggagggatagcattaggagatatacctaatgtaaatgatgagttaatgggtgcagcacaccaacatggcacatgtatacctatgtagcaaacctgcacgttgtgcacatgtaccctagaacttaaagtataataaaaaaaaaaaagaaaaagggtggagagatggaggggagggtggggggatggagaggagggtggagggaaagaagagagggtagggggaaagagggtagggtgggggggtggagggaaagaggagagggttgggggagagaggggagggtggggggatggaagggagggtggagggaagaggagaggatggaggggtagaggggagggtgaagggaaagaggggagggtgggggatggaggagagggtggagagaaaggagagggtgggggggtggaagggagggtggagggaaaggggagggtggaaagatagaggttagggtggagggaaagaggggagggtggggggatggaggggagggtagagagatagaggagaagttggaaggatagaggggagggtggaagggtagaggggagggtggaaggaaagaggggagggtgagggggatggaggggaagttggagggatagaggggaggtgggaaaaaaagaggcctggagctggtgttaggaggccagggtctaaaccccacttgaaaacctacctggtggatgacatgcacagactctctgggcctcagtttcccattcacatataagatggggaggcctttatccacttccctaagagggttgttgtgacaattcagagcagtgttagagtccaaagtcgggtgaatgcccctggggagtgtacaggaccatcctttatagtgtgagtagaaagtcttagcatttttattttttactcaacaagaaattaggctttacaaatatttgatgtatggatggaccatgacatccacaatcagctgcgtgttctgggcatgtcctcaaagaaagaagggactttgcaaacgggaaggggttgggagctctatcctcattcattcccttgcagcctttgtgatgtttgattgcaatttgccacttctggtgaggcgggtacgcagaatacattatccagcttaaactcaacaaaccctgtttcaacaaactgaagaagtggcttaaaaagttttcatgaattaaaagctaattaaaatctataatgaacaatatccacataaaccaaaaaatggcagagttaacacttcactgggaagaagtttttgttgtcgtcgttgttgaatcagccccagtaagatgtgaaaaaaaaaacagactaatgatatctgacaagaagtcggcccaagaagttcaaaattatcaaggtcaggtgcagtggctcatgcttgtaatcccagctctttgggaggccaaggtgggaggatcacttgaggccaggaatttgcaaccagcctgggcaatatagtgagattccatctctactaaaaatcaaacagttcggtggctcacgcctgtaatcccagcactttgggaggccaatgagggcggatcacctgaggtcgggagttcgagaccagaccgaccaacgtggagaaaccccatctctactaaaaatacaaaatttgccgggcgtggtggcgcatgcttgtaatcccagctactcaggaggctgaggcaggagactcgcttgaacccgggaggtggaggttgcggtgagccgagatcgcgccattgcactccagcctgggcaacaggaatgaaactcggtctcaaaaaaaaaaaaaaaaaaaatcgaacaattagctggatgcttgtagtctcagctactcaggaggctaaagaggatcacctgagcccaggactttggtgctgcagtgagctatgatggcactaccgcactctaacctgggccacagagtgagcccctgtctcaaaaaaaaaaaaaaaaaaaaaaagaagaagactttttgaattaaagaaagatttacatctcctctcattaatagcactattgatttttatttgatttaacacattatttcattgttattacaaattatgtgttttaaatgcctattttgatgtataattctataatgtacacttagttcagtagtacatgtgtattacttgtatttatcatgtgtgaatatatatatatacacacatggtatgtgctcaaaatattttacagattagagtatgtgaaaaaaatttgaagaccactctgcataataaatgtgcaggggctggcccatgagacatgttcagtaaatgcttgtttccatcctctttctccctggaaataaagtcgatagtgtgtgtgtggaccttgcttattaaaggaaagtggctgatttgatttctggaacaaggtgcatctcaaactagctggcagcactacctcggcctggccccatcccagctgttcacaccgagttccagacatttgtaggagcccggacgaggccagctggctgcctatcagtggccttcttctgtcagcactacacagttgtcacggctcacatccaaccgccagacagccaagaaggagacgccaagatttaaatctgcagttcctgacctccgcaaccacacccgattctttggttggtcctagacaaaaacaacggttttgcagatttgggttctctttctcaaactgccttttgatgatttatttgtgagatatgattgctcctcttgcaaatcagagctggttgcagtagctaactaacatttattgagcgagtagtatacccaggcttcagctaagtgctttctggaattatttaattttcacagcaaccatgtagagtaagttctgccactggcaccactttacagataagcgaatggagacttagaaaggttaagtaattttactagaggaacataaactaacagtgaaagtgagaaatctcagagtctcattggtctgacagctatgtaaggaactgaggggatgtaccattgcaaatcgtcaaaatggaaataccccaaatgcaatgcaggactctggatgcgattctggaacaaagaaagaacacttgtgggggaaaaaaaatagtgcaacccagagtctttatttaacagtattgtatcaatgttaatttcttagttttgacaaatgcatcctggttatgtaagatgttaggattatgggaagctgggtaatgaatagatggagagtttctgcactatgtctgtactgtttttgtaaatgtacaatgattccaaaataaaaggtgtatttaagaaacagaaatgccaagtgtatatgtgtgagtacacacgtgctctcacatgtgcatgtgtacagttgtgcatatgtaagtctttgtgcatatgtaagtgccccttgctgcacaccccctgctgttctgtgtgtgctgctccactcaagcccctgggacttacatggatgtcagcgagaaggaagcctacacaactcacatgtgacatgcccgccatgctctcgtcatacctcacctgtgctgtagaacccctgggtcacaggtggcagtcttgttcccccataacaaatgccagaaaatgatgtgtgtgtgtgtgtgtgtgtgtgtgtgcatgtgcacacacgcatgcacgcacacacgctctggtaggggggtttcaggaagtcattcgtgaagatgcagtgtagcatccagaataaaataaccaatttacaccttaaacactcttctccagtaaggccactacagctgcctctgcttactaagtgcatttgaagagtcctctgctttatccgtactctatcctcctgaaaagaggcactgacctgaaagggaagcccaggagcttctaggcccagacttttgctttgtttctcaccatgtgctgtgtcaaaactgagagaatattttgatcaccttttagctaagagctatctcctgggcagcagcttaaggctagagtaaggacatttcacagtttaagagagagcagtcactccgccaaatggctctgaggtggccacaaagtgcttgacttgcaaaaaattgctccattaactagattcagggattttcaggatttatgggctaggctgtgctaatattactgtggtgcttctcagtataattgctagaggcctccagtgagcagaggaattgtgtgttcagtctgtcctgggtgacccttactgcgtagtcctagggagacaaagaaaacccactcaatccaggaggctacagaaatgatgtttgtggagatctcagtgggtatctaatctgtaacctcagggggagaactctagctggtctcagtctttgctggaaacagaacttactggatgtgtgtgtttactcactcattcatttatttgtttatttatttactgtgacagggtcttgctatgttatccaggctattcttgaactcctgagctcaagtgatcctcccacctcatcttccaaagtagctgagattacaggtgcatgctaccacacccagccatcattcatttacttattgagtgtctaccatgcaccagatgcccaggttaagcataaaggatatagagcaggacaatcaaaaagtctcagattcagaaggaggagatggataaaaaccagcaagatctaaagtagataatttgattatgataagcacaaataagcagagaatacattgatgtgatacagagggccatgtggggggcagtgtgattcctttagattgggtgaatcagggtgatggcttttcagttgacattggaagaatgaggaggaaggaggaagaagtggcagccgggtaggacagcaggtcttctctgtcccccgagttcttctgatgtcctgcacagaaacctgaggggtagagtagcaaaggagaaatccaagctcaggctgggaaagaagctcatggcaccaaggttagggcttgtgataacagggacctgcttcaagagaaagggaggtgggtggcagattggtctcatggctgccacccacataattctaaaggtctcccaatgggagaacagccaccctggtaagtgtccagcatcatacaaggagtctctgcccattgtgactcttgcttgagcccccacacttagccctcaccaagctgtgtgatttaggattcaggtgttagaacggagaaggcaccaggcctactgcaccatatcaatgaagcctttgctttggggaaaacagagctgggtacaaataccagtgccacccattcttccctccatgctctggacattcaacccatctgagccttaatcccttcatctgcaaagtaaggaccatgcagtcttcctggtagtgttgtaaggctcagatagaataaccagacagttccaggtgcatatggcactcagtgagaatccacttgctttatcctccctcactcccttccttcctccaggaataaagagtacactagttgaagaatatttctttgccttccttctttagcagctccaatcccagcctaacagcacaatgagcatcagatgtgcttttttgatgtttgaaatttatagtctctgttgaatgttggccaggacagcacttcgtcatttgaacaatttccattttccacaagctctctgtgattgatgacctaaccaggcacatggcattccgttccaccagcaatgtggccagtggggagatggctatgtcagtaacacctgtttgtggtagaccaacaatggcgccctaaaagatatatccgcatcaaatccctgggacctatgtgtgtgaccttatttggaagaggggtttttttttgcagatgcaattaggaatcttgagatgcagagaacatcctgtgctatccaggtgggccttaaatgcaatgacaactgtcttcataagagacgtatagggagatctgacagatagaaggggagaaggcaatgcgatcaccactaggtagaggttagagggatgcacccctaagtcagggaatgccagcagctgccagaagcttaaagaggcaaaggatgaattgtcccctagagcctccaaagggagtgtggcactgcttatgccttggctttggacttctggcctccagaactgtgagagaataaatatctgttgttttcgatgggcgtgatggctcacgcctgtaatcccagcaccttgggaggccaaggtgggcagatcacaatgtcaggagatcgagaccatcctggcgaacacagtgaaaccccgtctctactaaaaatacaaaaaagtagctggccgtggtggcgggcgcctgtagtcccagccactcgggaggctgaggcaggagaatggcgtgaacccaggaggcagagcttgcagtgagccgagatcgcaccactgccctccagcctgggcaagagtgcaagactccatctcaaaaaaaaaaaaaaatctattgttttaagccaaccagttcgtggttatttgtgtagcagccctagaaatgaagacagcctgcgagcaccttgccccacctggctgtaggtgacttttggtgccaccatttttgactcttgtggataaagagcagactatattctttttataagtaagtccaccttttacagaaaaattaatagccaggatcatggttttagaactcatagaatacactcctctcatcctctcattctttcccccacccattggcttataaacttgttcctatgaaataagtcagctgagttgagtttgtaaatgcatcttgaataaatgtgttgggtggggtcacaaacatgcagacacctgctggtgagtgttactgacctgcactctgaaaggcccctatattgatgatacttcttaatctcctatggctcttcttcagccctgggagcaggggagtgcagacttttgttcaacccctttcacagatgtgcacactgaagtcccagtgtgtccagtgacttgctcaaggtcatcagcactgtctggtggagctgggactcgaacccagtcctcctgctctcagctgtgggaaatggagacagcagttgccctggaagatgtttcctgtgctgcgtgtttgtggttgtctcaggatttgtgagacttactgttttcttgtgtcccctgtccctgtgacttatctttgtgcccactcagccatcaccacttccaacacacacccacacctgtggagagaatgcagcctcctagagctcatgtcatggcaggactgagggaagtagtcagttcttggtgctctctaatagggctctgaattgcagcctgggccgtgcccattcatttatgtattgtctatagctgcttctgtgttacaagaattgacagagactgggtgtggtcgctcacacctgtaatcccagcactttgggaggctaagacagaaggatcgcttgagcccaggagtttgagatgaacctgggcaacatgatgataccccatctctacaaaaaaaaaaaaaaaattagttgggtgttgtgatggaggctgagatgggatgactgcctgagcccatggggtcgaggctgcaatgagctatgattgtgccactgtctcaaaaaaaaaaaaaaatgttgacagaacaagttgattcaattatagacttgagtagttgtaacggagactataaagcctaaaatatttatagtgttaactttgataggacaagtttgccagctcctgcactagaggataaagattaacaggattgactccacatagaggagaggagaggaaggggcaaggatggaagcaaggagggagaagggttagagagaaagaaagagggaggggggtcactcagagacttcacaaagtatgttatttcctaaaaactgtaatgcccagtatctagtgattacctgtggcactgtcagccttctgcctgggaacaggaatcttgcaaagatcaaatgcagggcccagagccccaggactctgcattggcattcgtcagtaagttttgaaggaggcagacatctcaaaaccatcctaagcataaggcacccagctggtgatttgaagatagccatcttccccattactagttggcctcactttaaaaaatgttgtttcttggatagcatttttctttcacaagttggtttgctttcacatgtcaaaaaacaaaaccagggctgggcgcggtagctcacacctgtaatcccagcactttgggaggcgaaggtgggtggatcatctggggtcaggggtttgacaccagcctggccaacatggtgaaactccgtctctactaaaaaaaagaaaatacaaaaattagccaggcatggtggcgtgcacctgtaatcccagctactcaggaggctgaggcaggagaatcacttgaacccgggaggcgaaggttgcagtgaaccaagattgtgccattgcactccagcctgggcaacaagtgtgaaactctgtctcaaaaaacaaaaaacaaaaagcaaaaacaaataaacggaaagagagagagaggagagagagagagaaacacataccatttgccatatttgtggtttctcattcttgcgctatttttttaaacctttcattacattaggcctttatcagatattagcactggttcttcagttttccccctgatcaggaacttccctgaaataaatgctggtaagatcgtggaaagttcccaggagaaggatagaacaggtgtaccccagggaggctgagccagtacagagagacctatgggtttcacgggccctcagtagaactgatttcctctccttgtctcaggttgtcatcagccactgagcaagaccgaataagggatctcgtgaggctttggagatggatgcaggatctgttgcctgcgattcaaagctggtggaggacttgcttaggtcatgttaattagtttttctcagctctcaccaggtgtcattcatggaggttgcataaaagaaactcatacccagggatgagctttttcttaaatattacctttctgaattttgaaatttagtgtagcattgagacatttaaacacatttttgaagcacaaaacttatttatcctagttcaaagccagatttggtttgacctgtcttggtggtgttttctgtggttctgagatccaacccccaacttcgtcccttttgacctagtttatcacccatgtccttgggttgaaaatagtagtgtaatcctaagagaaggggcctgaaaggaagggaagagaaatcagatgtcagctggtgaggatgagaaatactgcaacaagggagcagcattgacccttgagagctacatgctaggtagagtcaagctctacttgccctaagtcaaaaatatcattgacttgtggctaaagcccagactttgaagagcaaagaaagcaaggatttaactgcaaaaatagaaaagtggctgacccaatgctgaggcttttaacaaaatttaccaaatagtttatttcagactgagaaagaaagagctcaaacaagcttaagcagcagcaaatgctatcagcctggaccatgagattgcatgtgccctgcagtgatcttccaccttgactgacattaaaactacctggtagtggccgggcgtggtggctcacacctgtaatcccagcactttaggaggccgaggcgggcggatcacgaggtcaggagatcaagaccatcctggctaacacggtgaaaccccatctctactgaaaatacaaaaaattagccaggcatggtggcgggcacctgtagtcccagctgcttgggaggatgaggcaggagaatggcatgaacccgggaggcagagcttgcagtgagccgagatagcgccactgcactccagcctgggcaacagagggagactccgtctcaacaacaacaacaacaacaacaacaacaacaacaaaaaaaaaaaaacactacctggtagtgtttacagccttgagtgcccagaccaataagatcaaaatctctgaaggtgaggcctgggcttggtgctttttgatgatcctcaggtgatcttaatggtcttccagggttgagcactgtggggaaaattgaggccaagatgtggaggcatctaactggctcgtgcatgttaagaactggatgagatgggaagccagacattagaaataatggggtcagggcaccacttacatggtattaatagccagaggtcttgaatcttcctccagactacagtgaagagagatacacatgttatctacctggtgatagataccaaagggaagcaaagtaccacactgaagcaaagtaccatggaaggactgctccccacttttgatgcatgataaagaccaacctgcctgcatgaagatgatggtgcacttctcctgaacttcaccatcatgatcacagtcaaagccagtgatgatggagtataatcacaccagtaaatgaagttcccctgctgtcttctgactcacttctaagtggcctggaccctggtggttaagaaaagtaaacccccaaagcagtcagtcattgtcggtttgctaacttgagcatcctgaaattaaaggactaagtactttaactgggtcacctctattagtgggtaaaaagctgtgtggtctttgttcacttccttaaaatgctgctatacgtgatggcaagcaacagaactagccacgagaaagcaacatggaaaccactgaagtcaagacttaatcctacctggttccccatcaataggtaaaacaaagtggttctgagcacaaactctgaagccagatgatcagcttttaaaaaaaaaataattaaagaatatttatttatttatattttattttagattcaggtggtacatgtgcagatttgttacatgagtatattgtgtgatgctgaggtttaggcatctaataatcctgtcacccaagccatgaacatagtacctgataggtagtttttcaacccttgatcccatcccttcctccctccttttggaatgcccagtgtctgttgttcccacctttgtgtctgtgtgtacccaatgtttagctcccacttacaagtccatgttgctgcaaagaacatgatttcattcttttttatggctgtgtagtattccatggtgtatatgtaccacattttctttatccaatacactgttgatgggcacccggttgatttcatgtctttgttcctgtgaatagtgctgtgatgaacatacgagtacatgcccttttgatagtatgacttatcctttgggtatatatcagtaataggattgcagagtccagtggcaattctgttttcagttctttgagaaatctccaaactactttccacagggcctgaactaatttgcactcccaaaaacagagtataaatgttcccttttctctgcaacctcaccgacatctgttgttttttgacgttttaatagtagccattctgactggagtgagttggtatctcattgtggttttggtttgcatctctctgatgaatagtggtgtagagcattttttcatatgtttgttggctgcttgtatgtcttttgaaaagtgtctgttcatgtcccttgctcactttttaatggggttgttttttacttgtcaatttgtttcagttcctataggttctggatattagtcttttgtcagatgcatggtttgcagatattttctcccattctgtaggttgtctgtttactctgttggtagtttccttttgctgtgcaaaagccctttggtttaattaggtcccagttgccagacggacagctttgaattctggtcttaacacttcataactgggggatctaggggcaagttacctaacctctctcagcctcagtgtcctcatctgtaatggagggataatagaagcttccccccagggttatagtgagggttgatgaggtagttcatttaaagcactcagaactgcgcgtggcacctgtaaacactcccacccccagtaccttttcacaagtactattaggatgatgctgttagcagcaattatcagcacctctcatctcaagttatattgctagtgacaaaacctttggcatttcagtgtatagctttccaatcttttccataactgtattttttcttataaaagtgagattatactgagcatactctttgctttttaaactgactatattgagaatatctttctatttcatgtaatctacagcttcatttgcaatgactgcataatggtgcagatatatcatagattatttaaccaaacacctgtggtttaatacttaagtctctctcttttttaaaagcaatgctgcagtaaatatcattaagtaaaagcactgctcattggcataatttcccctttagaataaattcctagaagtgaaatgtgttgttcaaatcgcatataaacttgaaagtgtttgctattctatatgactgccaaattatcctctagaaagattctaccaccaccagcagggaataaaaagtcagtttcccctcactatacttgacactgggtattacagtttttaaactgtaatcttttgtatttgttcttgacctaaagctgagctctgctgtttggggcttggcttctctgaacttggtgctgattcttgctttaactggagcttcctactggagcatcctaggtgggctctcactggctcaaacaaccctatgaggctcttcttagtcttctaggactagagcagggctcagccaagcacatggtgctggcaggacacttggagctgtccctataccagcagcaatcttttgtcttgcttatttaattaccttatcctaaagtacgtctttactagaaatttgctgtcctcagtgagaagcagtacctttcccttgttccctgctgaaccaccagggtcactaccagcagatcagagccacttccctgtccctgggggcatcgtcttagactttggtcaccaccaaagaggagacataagaagaagggcaggaagaggtagcattgagcaagagctctggatttgccatcatcagctgaggattctgaattaggaaacatatctatttaggtttaaactacaaaatatgcaagggttcctattccgagcctctcagaaacatccctctggccacaggcaactgtcactggtgatggttattctctcagaagatgctgaggatcagggtgtctaaggagtagctttgctttaatctgagcttggtatattacattttccatgttagcctacctaatagggtgggttcacatagaaatactagaaaacacagaaggatataaagagcaaagatgaaagcattccaaatcctaccatctagatacaacctatgttgatatttagcatgtatgcagaggatagatgctatcctgtagcatgatcatttatatgcatgtgcgtacacatgcatttactttttataaaaatgatataatactgaacatgctattctgtagtcagtttttaaaagaatgtatctttttttttttttttttttttttttttagatggagtcttgctctatcatcaggctggagtgcagtggcacaatctcggctcactgcaacttctgcctcccaggttcaagtgattcccctacctcagcctcctgagtagctgggactacaggtgtgtgccaccacgcctggctaattttttgcattttagtagggacagggtttcacaggttggtaaggatggtcttcatctccagaccttgtgatctgcccgcctcggccccccaaagtactgggattacaggcgtgagccaccatgcctggtgcccccccctttttttggggtgggggaaacagggtctcactgtgtccccaggctggagtgcagtggcacaatctcagctcactgcaacctccgcttcccaggcttaagcaatccttccatttcagcctcctgagtagttgggattacaggcatgtgctaccatgactggctaatttttgcattttttgtagagatggggtttcaccatgttgcccaggctggtctcgaactcctgagctcaagcaatctgcccgtcttggcctcccaaagtactgggattacaggcatgagccactgctcccagccttaaaagaatttatctttaatggctgtgttttatttatacattttcagtcattcattatcaataaatactgattcaggcccagtatgtgttaggcatgattctaggcaagagagagaaaccatgaatgagagacatggtctctgcccttggggagggtgtaatgaagttcgtcagttttgtgctttgtggtttctttctatgcgttatgtttttaaagtcctcttccatcctaaagtcagacaatcactatattttctcatgttttcactttttacattgcctgagtccatctagaaattgttttggtggatgaaaaattttctacttttaaaccattggaggacagcaatgaccacaaaaggattaaatcctctttccttatagacaagtgggcacaacttggctatgcagtaattctaacatcagcagtgcaaagaagggaagtacagtgttgattcttcatgggagactgatggaattataatagacttctgttcttaaggtagaaaattatcatttttttaacctgaaaagatagagtaatagtctatgataaggacaaattaccccaatatgtttttaaaacattgcaattattaacaaagtggtagtttctttcatttaaaacccccttgggccctaaagatatagctaacaagaggaaaaactgtcaaaactcttattaggtggttgagtttattttctgctcacaattgtatcatttaaaaccctgagaaactgttttttggagagcaatttgtccctattagagttttatgtgttcaaatccttgacttagcagttctgctggtagaaatccaccctatgtatggaatcacaaaagtacgtctaagatgaacatagaggaagattcattgcagtcccgtctataattgcaaacaaagcactgagaaccacctaaattatctattagcagcagactgctaaagtaagttaagctacatctgtgaatcgccatgccgtagttgcaaagaatgtggtgggattccatgtgctgaatgaaatagtaaaatctctaagatacatcacgaagtgaagaaagtaagctgaagggcaggtcttttgtgttaagaataaaagaccccaacttatgttggtgtatccattttttcctgtaggatgcataaaggactaataggaattgttgcctgaaggaacaaagctggtagggatgaggtgaagagaaagtcaaatgttcattttattcctgtgtggatggtgtgaatttttctaccctgcatgtttattacttttatttatgttttgtaatgcttactccatttatctaggcagggagattatagacaattggtgtttccttctttatacttttctatattaaaaaatgaatatagatcagaaatgttcaccagatactggcatctaagaaacaaacaaaaacatgatttgtcaaagtcagaaaaggagtgtatgtctctgtttggaattatgctaatttcttggagtttgcgttcctttgttgtcatcagaatgctgcacattgtgttctctttctatttttgtgcacactatcttgttttgtatttccaaccacgacagctatgttcagttgtgccccatcccctcccctgttctgtggcctgcggtgctgagaactgcgagcagccaatgggactgctgcttactgtgaggtccatgcagtgtccacccccgcttcctgccctgagactgcctccaggcctggcacgtcttcctaagacaggcctatcaacccagtggatccttctgccccttcctcctcctgtcctccaactttagggagccatattctgatatccagagatcctggatttagagcatctcctccattcttggtaaattgagaaccttcccaactgctgcctcatctgcagtagttcctttcagatgaaaagttaaaatgggagagaaatattttgcatttgctcttttcattagactattcgatttctatgtaaatgtcttctacagggattgaaagaaatgaatatattggttcaccagacattgctgaaggttccaacacagccttgacctatttttgtttgaaattgagaaatgctcacaaatgtaagaggcctccttttttggagattggagggatttgacatcaagatgttttgcattttcaacagctcatttgccctggatggcttttggcagataaatgtggaggtggcagtgtaataggtttcatgtgtccagagtggaattcacccagagccaaacaaaagctagtagctctgaacatgtctcttttcatggtaaagtactctggagtgagactgtttaagtttcaacccctgtttggccacttcttagctcaagggcacttcccttacagtagctaagtttaggttgtttcatccataaaatggaagattttaaagtatctacctcaaagtgtgatgaggattaagtgaaaaactgcggggcaattcttactataatgcctgacatagcaaggcatcaataaactcagttgccattattattcttaccattatggtttataccactaccatcattgggattattaggttcaaccactacacaactgaattgttgttgcatgagtaaattgcagttgtttagacaaaatcctaagccaaaaacttcgtgctaggtagaaaggaagcaccttcatttattaagtccctgcactctaccaggtgatgtgttagttccatctttgctgtatctcatttcaatcctgcagtagcattttgcaggtagttctatttcagtatttcagacggagttccaattgtttgatgcttactagccatgtgaccctgtctctttatcttcctgtgcctcagttttctcctctgtaaaatggggataatgatagtacctaactcattaggttgttgtgaagattaaacatgttaaatcacacaaaacagtgcctggcacacagtgaccactatgtaaatgtttgctagcattactttataactcaggaagggcacatgtgacagtctggaacgtgtgaagtcgttgttctccttagcactgtggaatgttagtgatgctggaggaaacttagagctaagctggcccaacctactcatttcacaggctggggatccaaggcccagaaacaataagggacttgtctaagtcactcagggagttcgtggcagagcccctacctgatacgagatctcctgactctgctcacgagacttcatggtgggaataaggcaacacacggagagggatgagatggagatcacattcttcgggagagtttgattctgttattcctgccatttgggactttttcagagtcctctaccattctgcctacctgtacagaaagtgctggatttttccaccacaaggggcttatcaatgtggtgtcataaagcgggtcttactttctcatcagagcccatatcagaccacttcccttcttggtctttagaggaaaccaaagtgaagcactcctagcaaagaatttgatgttatgaccatcaaagcaaaagtatagctctatggttaaataattacttaaagggtcacaccgtgggcagaccttaaaaaacagacttaagatataacccatatgggctataaagtatctataaaggaccctaaatggaaactctgctgtgttgtgcatttgacttggcactaataggccagatatattaactgttgggtgaaattaatgataatattgcatctaaattctatgggatgtttcttaaggttttgggtgttaaattaccccttctaaaatccagtattgaggctcgaactaatcaatgtcttctttttcttttaaaaattctcttgaccatattgtttctattacaaatgaaacatgaaggtagaaagtagaataataagttacaagaagtggagaagggagtgtgtgtagtggaggatgagagaggttggttaatgggtacaattatacagttaggtagaaggaataagatctaaggttggatagcacagtaaggtgactttagttaacaacaatatattttagattttaacatagctggaagagaggactaaaaatgttcccaacacaaagaaatgataaatacacgagatggtggatgtcctgaacaccctggttattatacatcctatgcatgtaacaaaatattacaggtacccaacaaatgtgtacaaatatcatatgtcaataaaacaattaaaagtaaataactacagaaaacaatacaaagctggcagttccttcttttacagatagatggcaagctcaagtccaaataatcagttgaagaaaagagaagttatgtagatggaaatgctggtccaaactaagggatgaggaataaatagagttgtggaattatccacttcacctggtgatgttgcgggttaaatgggtacatggctaggcagaacaatgtagaaaacctaccttacttgttcttctgaccaagccttttaaggctgtcatttaaaatggctctgagttctgtttcttagttttgtaggatcagaaaatcacatgccaacttagctttcagctacttatctacaaacccaagtgtctatttatttttcagtggatggacactgcaggggtcttagcaagtaccatctctccatttagctaactacataggaagcctgaatagaaatcaggattatgattggtgatcttgaagacagagccaggagagtgagttttaatatctgatggtgttgagatgagataactgatctcgaacagggatgtgtctgctgagcaaactcagcattacttgttagctggacaggcgattggacaaagctgagtgagcacctcttcaattttttttatgcttgattactcaggttttcagtttttagacagactatttttcttttttttcccctcagatgtataaatagcattgaatctgcagtagtgttagaaaggtaattataacccaaccatgtctgagatgacattgtgatttcttaatagaaaaagcttgttgggtccccacttgcaagttgatttttcataatttaattctcaaaatgtcaccttatttcttggtgtaacccagataaaacctaggtatcctggcaatccagtttcagcatgaagttatattcaaaggaacacaggctagttggccaaagtaatttcagtatccttactggaatcttctggagaacatcagaggggattcattttataagccacagtaaaatatctcaagattctcttttcctgatttcctggccttaatatctcagccttttcattttaaactcttgaactttaaactgtctctgacccctttcagtgctttacttcttcatctcttctttccttttctcgatcatttttccccctaaatagcatccccacccattccctttccaagtgcaactatataaaacagtctgtttctcgcagtttttcagtactttacctctttctctgattcttcatttcaaaagcctaggaatcctctggcaaaaagtcacttaaaaggtttggggcaaggaaacaagattccctttagctcacatggaaggaagtcaaagctgaattatcttcatctagcaatagaaagaataaagattgcaacgtttacaatttaatatattttctttaccctcctcttgtctaaattctgtgatctcatgatggcaagagggccttgagtaggtcttctggtcccttcccactgctgtgccctggggcgcgaggtatcagcgcaagctagaatgggggttcagtggaggaaaggaaacaccctatttctgcttctgactaccttccctgcttagcctctttccctgtctccctgtttctcacacactcagttgggacacccaccttgtccacagccacagcctggcatctcctagtgctccagttgcagcacagtcagcaggagagaagagggagtctcaaggagcaaaaaggtggaaataggctttcctaacaacaggtgcttgccatgtctgtcttctcatcatatttattgaacagaatgtgcttcattctctacgggtgctctttaacaatagtttacgtgttatgttacgaacatgttatgattataacatgttctatcatgttataatccttccagaaaatacttgccaggaaaatatataatttatagaaagtgaatgaaagtggcttgttagccttcccagatagtggaggaatctggaagtctttctaatggattgagatcacgtcattccagatgtctcttgaggcacactgccccgaatggttgctactgtcagctcattatgcttttccctggaatttccacttcccccgcctttctccccagaataagctttccatgattctttcccagaattagccttttcaactctttcctcatatgcatagcaacagtaatttatttcatgtgggttaatgtctttagcattaggacacttctggttttatggactgatggccaatgtgtttttaataatgtattttgcttctattgaagtcatgagtacaaattcgtaattcatttgaatgagggatatggacaaacaggaacacaagtggaagagagaaaaaagaggatagtacactcagagatactcagtaagcataaattacatgtattcatcatacaatattctaggctttagagatgtgtcagccaagatccttgtcctcaaggagcccatagtttgttagagagagaagatgtgtaaatagttaagtgtataaagtgctacagtgcttgaggtctaatgtagaaaaatccacagcctgtggggagggaagagaaaggagggagtgatgcaatctatttggagggaacagaaaaatcttctgtatttgtcagtactctttgagttgtaagtggtagaaacatcactcaaactagcttaagaaaatgggagatttattagtgtatataatttaggaagcctggggatggttctggcttcatgcatgactagatctgggactcaaacaatgtagtaggacccttttttctctttcaactctgcctccctctgcatgttgactttattttcttcaatgtagatgcatttcttttatgtgacttggaaaaattgctactcagaagtacatcatctcagcttaatcctagtggtatgttttttcacttctctcctggtatccgtgtgtctgtccctagaaatgtctctaactggtgtttctcagttcacttagctatcccttggatcaatagctattgcaaagaaacgaggtagcatgattggcctaacctggctcacaaacaagtcctagtggcaggaatgagctaaccatgactggcatttccaccagagccatttacagtgagggtagatgtgtttccccaaaggaaagaagactaggcagatcaaaattgacagatgttcattaaagcttcatggatatttaaactgtgccatcatagatgaattgttttttgtcaaatgaagcagcagtgcacatcgattattgttagaggaagcaataagaacaaaactaagaggacatgaaccagccgggaagatcaggagactgcaagtagtctttgaggttggatcatggtagggggccatggcttgagatgaagctgtgaaatagacaggagcctcactggctatgctagggaacctgctctttgcactgtaggcaatggggagacatccttggttttaggcaagggtcggaggtggtcagatttccattttagaatatcactctggcagcagtgtggagattgagttggagaagccaagaatggatgcagggagactaataaggaaaccactacagtaatccagctggagataagttctgtaatgtgctaaagatgctaatatggaatagtctccatgtccaggtaggagatgaaggaaggagggttaaggcaatactcaaggttatagtggggaagcaaaagatgtggaaactggccagcagaatcaacatgacttggtctttcaagaaagtaagtgtctaggatgacttagatttctgacttaagtagtgtcatttgctgagatgaaacatagaagaaggaacaggtgtgaaggtagagggtgggggattgcttgagatggtgactgcatgtgtttgagtttgggggagtgactatgaatagttggcagttcagtatagggatctgcagctcaaaggagaggtagagttgtagagtggatgagaatgaaggcccgaagagttactggttttgtcctggttaagggaaggagaaatctggaaaccagtgggctatcccggtgaggagcacagctcagacctcagccatcaaacaagtatcagaaactgcaagtgagttccttaatggtgtcctatgcaaacttgttgtcgtttgactcatatctaattctgagcgtaggctggttgcctcttgtccacctagaagtgactttaagaccatcactatgggctgggttcggaggctaacacctataattccagcactttgggagactgaggtgggtggatcacctgaggtcaggaatttgagaccagcctggccaacatggcaaaaccccatctctagtaaaaatacaaatattagccaagcgtggtgacacacacctgtaatcccagctactcgggaggctgacacagggaaattgcttgaactcaggaagcagaggttgcagtgagctgagactgtgacaacagactgagactctgtctcaaaaaaaaaaaaaattcactgtgaaagggagctcagctagtcaaagaatcctgaaatagctgtggatgcacagtgggtccttgtcatggggccaggcccagggtcatcagttagaatgcagttgtaaacatgctaatgctgctgcctggttgtatgtgctaacaactgcttagttccaaattctaacccaataaggagtttcctcaggggaaatgtatgactacagcacaaatgggctcagccttactgctttcccactgttaccccttcctgcaccagcgctcttctggtccgtgtgactaaaagccaaaacaccactttgcctaaccccccagatcctattagttttgagtctcatcaattctgtttcttccatttgtccttctctttccattctgattggtacagctctaagctaggaggcttgttagttcatccatccttactgcacaaccaggtgaatggaacatcctcctaaggcacttaaatgatatttgaatccacaggtcagcaaactaggacccgtgggccaaatctggcccactacctgtgtttgcaaataaagttttattagaacacagccacactcattcatttaaatattgtccaggactgtttttgaactacaatggtagcattcagtagttgcgacagagactgtatgtcccacaaaatctaaaatatttacttttgttttataggaaaagtgtatcagcccctattaatccaccttatgtatgaatgccagattaatgttcctaaaatgccatttcaccatatcattctgtagcttagaaccctgcaatgacattgcattgtccatgcaataaaatctaaacttcatggccctccatggtatagtcctagccaatctgttgagtcattgatctctgttcctaaaggcaagccctacaaccagttagattttcctcctcattgtccctggaatatgcagtgcatttctacccttgttcacctagttccttttgcttggaatgtattgcccatttgtatctacctaaatcctactcattccttttttttttttttttttttgagacagagtctcactctgtcgcccaggctggagtgcagtggtgtgatcttggctcatggcaacctctacccactgggttcaagtgattctcctgccttagcctcccaagtatctgggattacaggcatgtaccaccacacctggccaatttttatatttttagtatagatggggtttcgccatgttggctaggctagtctcaaactcgtgacctcgggtgatccacccacctcagcctcccaaagtgctgggattacaggtatgagccactgtgtgcccggccctaaatcctacccattcttaaaggactaacatgaactctacatccttcatgaccatgtcagttacagtgatcaccaatgagcctgctgcttgagcatgtaaaggtccactgcccatactgcctggtaagttttcttctgctcagagaatggttcaccaatatgatgatgggcaactctggagtgaggactttctgatggaacaaagtcacagctgtgggaaagcctgggaatggtttggaaatgacaagacatgtaatgagaacacatgacactcaattaatatttgtggaaatcttgagtcatcagcctctcatatctatgacatacatcttggttctgtatttaaatgtaggacaactacatatcttgatagccagtgggaatgactgacaaagtccagtaagtctactcttgagagattctagaatgtagagatagcagctggaccaggaagccctagctttatcatgtgccatctctgagatggtggatgtgggctgttcccactgtgcctcacttttcccatccactgtcatatattttatggtcttgcacacactctgggattaagtaacatcaattatgcaccattgattggagttctttggtaaatggtactacattcctaaaatattcatgtgtcttactttgtcagggagattatatccgtgacttagatatcatattctagtggcttaagattatgagctaatattttgtaaggtctgggcattgcacagaaaaccttggttgtaatacacattattattacattgatttgaatagcaatggtacaatcatagccccggaaacatagcgactacataaaataaaagcttccgttaacactgagcacagcagccaggcttccgcattgttgttgtccctaggatttggctgttgtattgtcaaatgccattatgtcttatctaataagtttctccctgcatatgtgagtaaacgaaaatgctccagtatagtaaatgtctcagcaaaccactcctgtacgctttggaaacagaacattaacaaggaaactatcatgagagcagacctttctgttctcatgaatcacattcatatgatgtttattgtccacattggagaagtatagagaagaaaaatatgaagggtacactctaatggaaaggttatagtggaaatgcaaggaaaatatatccctttacaaccagcttctaggcattacctagaagtaaaattatgacaataagactaacagcaaataacattgagcacttactctgtgccaggtattgttctaggccttttacgttacatcatcttatttaatccactccacaactaagtggtttggatgcagttattatctccactttatgtacgagaagaccaagacccagggaggtagaagaacttgtcagaagtcagacaggtagtgagtggtagggctgggagttggacccggacagacagattccagatttcatatttatcgtaacctcagctgccccacccacatgaaatgctaccccaaggctagtggcagcaaatataacccatttcatttgcattgtttggtatgtccaactgggtgatttgtcctacaaaatttgaaacaacgtctgcttatttatgtctgtgattttgatcaaataaatctcacccagaatttcccactgtcttattctatggtatttgcagtttgtaagaacctctgtcttttggattgagacgtttttattctttgtgtccaaattaacactgcacagaacatggttctctgtgtgtgtgtgtgtgtgtgtgtgtgtgtgtgtgtgtgtgtctgtgtgtgtgtgtagaaaccgtcttttcttttggattaaattcttgcagcctggctgagtgaggagaatttctcccactcttcgagcctacagcagacatgttaggagaatgctgctgcttgcaacacacccagagacggtggggcaggtgacactgcgtgtgtgcccggtgtctctggaagtgtctatacagatgtgtgctgctgctgctgctgctttctgccttaaaatttctggagccaacacccacccactcttacagcctctgtctctttattttcaaggaaaaaagaaagaggcagactgaaatagaaggcaagcgacaacagcttgacgagcagatacttctgctgcagcattccaaggtaagcagctgatcccaggaacctattccattattagacatgcagatcacactccggagagctgggcagtgcctgccctgccgtgaaggcgctgccgccaaccaaaccagcctttttcattcaatcaggaaaccatctcttggcttttcttgtgaatttctcaaattcagggcattattacagcattccaatttctgcaagcataagattacagtgtgcatgtggacagggtggagggtttgtgcgtgtgaagtgtggtggctatatatagaaattggatgagaatacttcacagggtgggtgaggcagcatttcaggattgtttctcccatgcataggtgctgggtgtgtttgctcagagaccccaaaagatatatttcacggaacgttctttttattcacttaaaaatattagtatttcctttcttgatatggagaaaagggagattaaacgatgtgatctgataaaagaacaacactgtgtatttcagattattcatttattttatttgtactttaacaattttgaaagtgttctgtgagagcaagcagttggtcaaagatggctttgaaatgatttgactcagacgggtctccatggtaccatctaaaaagagagagagagagagacagcacacaagagctgtttattttttctttaaaacatgatgcacttaagcatcgtaattgattacagctcaggagaaagctctgtcactgtcacaaggaccccactggttgcagaatgttgcttttcacatgttcagagaataatgtgaccacattccaatggccagccgggagttgttgcttgcctttgactgctcctgggctttttggcaggaaaaccttctcctgcttacctcatgttgctgtgacattgcctgcacagagctgcattgctcagaggactgggtgggaaggtggtgctgactttcggggtgatgctcggtatgaattatctagatttttttcaacaagataaacctttatggctacttttcctgtccttttctagaaaacaggattgtgctaaatgaatacccaaaatgagaaccatcagcaagcgagttactgattgaaaatagcagcatgacctatatctgcttagcatgtttatcagtttttgccatttaccttaaccagagaaatgtgcttaaaaggaagaaaagcagcatgatactaaggatattgcctgtttctctctgttcatcatataaattcattgacagatctttctttgtaggagcttgctctgtatccccggtgctgttgctctttccccacaacattcctgagggaggatggagggctaaaattagtatcctcttctcacagagagggggccttaaaaacacctaatagaactgagtgaattgttcaaggtcaatctgcacagagctaggtctctggctcagagtacagtccattcagtacggtgcttgtaagagaccaacatgtactaaaacctcagtgaatttctggttaaaggtgaacttttaaataagaggaccgaatgaaaaaagagaggctgctttgggctagacagcctcactttaagctcaacgtagttctttgcttttgtattccctgaatccagtcagggaataaacatatgtcaaaacatcaagggattttttttctttggtctcccttctcatgatcctgggtgccaaataagataccaagggctcatttattgctgatgtccagtgcagtattagtatattctgttcatattacatctattcatttttttatttgtttgtttgtttgagatggagtctcgctctgtcgctcaggctggagttcagtggcatgatttcagctcactgcaagctccgcctcccaggttcacgccattctcctgcctcagcctcctgagtagctgggactacaaatgcccgccaccacgcccagctaatttttttttttttttggtatttttagtagagatggggtttcaccatgttagccaggatagtctcgatctcctgacattgtgatccacccgccttggcctcccaaagtgctgggattgcatattcatttttcgtctatgcatccattcatccatctttccatccatccatccatccatccaatcaacagaaacaacagtagaaattaacttggtcttgtatgcggaagcagtgaggtttttctcaaggacttggaaacaagggaatcagctagttctttatggctatcttggtaaaattctcacacagttgatgagattggctatctgaaggaacacccaacactcgcaccatggcaaccttgctattgcagggcaggaggtgggtgaggtggggaggactggaggtgatggtaacttactaagtggaggtgagtgcattgtatgtctctgggaaaggcttgtgtggacagaatgagggtgagttatttgccttgaatactgaaaaaggaaagctcagaggttccaaaggtggcagtggttgtctagtactatctgcagagagacccccagctttgggaggtcctgaatttctgtatgctggtgaggtggggtcagtggtaaggtgaggagggtcctcaggccacagtgaggcccaagtgaaacttccctcaggaccttgcctctctttgttctgaattcatcctccctataattattcagttattttgatatgaggaaagggttgcctgattgaaggatatgatcactttaggcactaggaaggaatatgtttcactttaaatcaataaactggtgactgaacttgaatagcatgggactttttccctgtaatcatccagtttgcagcctagtggcctcgcccctggatggaagtacattcgtggaggttatattttcttctctgtgagcctctccaaggagtcagccagttttctcctggtagcctgttagccaccgtcagtaacagtcaccatttttttgagtgcctaacacgtgcctggtactttaaacacataccctcaataatgaccacaagacagttattactctgtcttacagctatgggaacaaactcatgaggtcaagtgatttgcccaagaccatagagactataaatgagggagcctgagagaaactcctgggctgtctgctttcaaagaccgagctctttccaggccaccgttctctttgaaagaaatgtttcctttggaataattcatttagtgagatgccagttaccatcattgctgtctctcttactctaaatatattgtgatggactccagaaaatttagatcatgtggagacatgtcacagtgattattgaagttccttgaagtagagaatattaggaaatatgtcagtaatcaatatttgtttcactaatttgcaaaatcctagatattctctaagaaaaaaatattctccttgcattagagttagttgtcatgtttataagatataattttcatattctttatataattctcatattctatgtcttaagataaaattctcacatgtggcaattatcagatagcctgtggacacttattctcatgcaatgagatgaattatttagacagattcacctgtctgtggtcaaagcaaataaatagaatgcaagatagtagttttggcattcatatatatttttagaagacttacttattgcaatatttaggaacatatagtgagcaactctacaaaatggaatatcatcactttgtatatggacttcgagcaaattccacaatacagtaaaagactaaagtataaaatggtaaaatactaactgctacatcccagtgattaggaaacctcaagatactttgaactccaggccaaattaaactcagatgtatttttaaagcatccttagctatacgtagtgtggtgtaataatttctaagcattacaagtagaactagtaagcaatttttatagctatattatttttgatgattacaaaaggaaagaatgtataatcattgcaaaaactaaattaaaaagtacagcaaaatataaagaaaaaacatatgtactctatacttaccattcagatagaacccatgcagaggtaaatccttctatacttttttccccgatatatttctgtagattaagatatgtaaccatcattcacagggctcaccaacctgtgggtaaaatgaaattatattaacattagcattggaataacattaacctttacctcttttttatgtgggttctttttaatacccatacaaaaacttataatttttataaaatcccatggagcattcttttactttaggataactgactttgatgtcttccttgaaaagaatgtctccatctcaaactcttagctattatgtttcttatacttcaatagcattaattcatctagaatttatttacagacgaggtatgcagtaggaatataactttactttttactgatgctgagctgcttgtctcaatgtgatttattgattaattcatcctttccttcactgatttaaatgtcttctttatcacctacatatttctgacttacatttgagtctaccatttatggattatttttattccattaatctgcccattcctgtgccagtattgttctcatttaatccctatagctttttaatatattgtaatatttcataagacaagaactatcattattcttttgaaaaattgtcttggctttttatttcataggaacaattatttatttttattgtttttataatgagacttgtgatgatatggatttttttaaaataaatcagctactatatcatactagagcagaaggaatttaatatttccttctgtcccttggttgaattgccagagatttgtctattttattggtctgttcaaagtcccagcacagagtaggcactgagtacctactgcaacatgaattccttggagactgtcatatttacaaaggtttgcctgacagagttggccctgtcagaatcaaattgctaataccacgtcttcaatacataaactgcctttgaattacttattcatgagcggggaaccctcactagagttttcttctaatccaagctataaaaattgtcattatatttggaagaccacagccttttcttccaagaaagctgaatgaaaaaagatgaaaggctgaattgtgaccctgtgaaatatttgttgtcaacccactaaggtcatttgctgaagagcctgaaggtatcagaagacttgctacaaagatattacagtgtctttcccggttttgaacatttagcactaattttagactttttcttgttactgggatgtgtgaaagacttatttcaaattttaaaatattgaacagataggcacagtacacagtgtaaagtaaccttagatctcctcccttgtttccatacccagagcttgaatggaagttaaaacctgatttcttctatcagaagtcttgggtcggcttctccctgggtggactgaagcatataacaaaatctcaaaaccaaaccaagatcttatttattgagagtcaagaaagaggaaggaaagagtgggaaggataggggaagagaaagagggacaggacacagataaatgactgaaaacacaaacacagctattgcctcatgctgagtttaacccactttctgttagaaaactgaatttaggccaggcgcagtggctcatgcctgtaatcccaacactttgggaggccaaggcgggcagataacctgaggtcaggagttcgagaccagcctagccaacatggcaaaaccctgtctctactaaaaatacaaaaattagctgggctacttgggaggctgaggcaggagaatcacttgaacctgggaggtggaggtcgcagtgagccaagatcacaccactacactccagcctgagtgacacagtgagactccatctcaaattaaaaaataaaataaaataaaataaaataaaataaaataaaataaaataaaataaaattgaatttagccatattccaaccatcatccactagaatagccaatatcagcttcagccagattacaaatgaatgaaagatccagagtaaaaagtaaaatcatgaaagtacacaaaggaatcacaggtgaatatttttatagtgagggtaaggaagtcttatctatgtatgacatcaaagccagaatgtgcaagtaaaaaagattgccagttatgactttataaaaataacaaacatctgaccaggaaacaacaggagacttattacaagttctcattcacctcctacttccccaatctgccccacccagcctctccagacatgcctcactcttcaccggggtcacctcaaaaagtggtatctaggctgggcacagtggttcatgcctgtgatcccagtacttgggaggctgaggtgggaggatcatttgaacctaggaattcgagaccagcctgggcaacatagattccatctctacaaaaataaaataaaaaataaaggaaagtaagaaaagtgacttcattgcagttaccttagctgtagatgaaaaagattgggttagatgatctctgtgatctttttttagctttagtgatccaagattttatatttgctaaagtacagtgtatgtgcatgattttccaagaattcctcacatgtcagcctccgtggatgaataaaagatacagtcctgactgtgagaactcaggggcaagtgggggagagagagcatcaatatggaacccaccattagaggagctgaaaaatagttttccatgttatgaagtggatcagtggcacctgatgattttgtaaatcctatttgagcaaaaaagaaaaaaggattcttgggtgatcttacacagaggcaagatagtagagtgtacctcttggcttcaaatcccagatctacagctcactcggtgtgataccatggataagtcagttaatgttagcacctacctcatgggatgcttgtgaaagttaagtggatttacatgtaaagcacataaagcagtaagagttctataagaattatcattattgtcaccatcatcacccagtactatggctgcaaataccatttatgtatatatgactgccaaattgagaatcccagtcttccatgttcaactgcttttctgacatgtccgcttagatggatgtcactttcatttagaagcctctgaaacttaacatgcccaaaatgaaagattttattttctgcttttctatcatttgttctactcttccctgtctccagttgatgataccactattcaccctttcactcaaaccaaatatctatgcattgccctaatccttccctttttctcagcccacatctaatctgttacaagtcacactgattctacctccagaatgtaccaccatgccttttgattcttctgtctctcttctgtttcaagctaatattctctgtcacttgaaccatgcaataaactcccatcacttgtactttgtaatcctgccccttgcaatgtgttcttcctattgggcttagaagacacagcaaactccttaacaaggctacagaatcctacctaatctggcccctgccttcttctccatcttcagtttgttctgccctcccaccccaacctcacttattatggtccagccactcgggcatttgttccggtccacaaacacaccaaactctgtcctaccaccaggctggtacatttgccagtccctccacctggaacacccctccggatctcagatctcagcttgaatgttcaagtcatcagagagacctttcccactttaaatgtcctcccctggtccctctttgtcacattgtcctgtctacctcttcctaggcagcatcatagtctgagattatcttgcatccttgtttattgggatgaaggcttgagtgagagtagggacttgcctgtcttcctgagctgtgacttcagggactggcagagttcttggcacctaggaaagggataagagagccactgctcctgagttggggacacagaaggagaggatggggagttcttttagattatggtgtttgaccagccattgagaaagcttgtgtattcttcaagcatttggatagtcataggtcctcatgctgtgctactcaaatcgtggtcctcagtctggcattgccagtgacagcatcacctgggaggtcgttaaaattcaaattcccaggccttatgcgagacttagagaatctgcatctccatgggtgggtcctggaatctgtgtcttaggaagttctcctggtggtccttatgcatactgaagtttgggaaactcagttcttgctttttgttttccaaagctggccaggccagtagagccagaaacagatttactttgggagttccttctgtcctcctttcagaagcccctgtcaagtttccctttgtccagctgccagctccccacctgctccttccttgtattgacttgccatgatgacattcgtttgacaaatgtgaagtttgacagtccttagcaccttgggaggagtttgagaccagcctggccaacatggtgaaaccttatctctactaaagctatgatactatgttagctatgatacttttttttgatgtatgttatttagacaataaaggccacaaacagagaaaagttttttttaattttaatttttttatttctattgagctctgcttccgctaaattctgaaacactgaggcagccaatacaagctagcacagtataggggaccctgtgctttggatggtgcactcagtatacaccattccatttggagacatgttggagacaacataagggggatctggagtcagttaaggaagccttttgaattggtgatttcccctgaaagcatgactttggagccaagtagaaaatcaactatgctttttcggcttcttaaaaatgtctaaacacctttgtgaaacaggattctctgagaccaggcccactgccttttccagttttttttctttctttcttttttttgagacagagtcatgctctgttgcccaggttggagtgcagtggcgtgatcttcggctcactgcaacatctgcttcctgggttcaagcaattctcctgcctcagcctcctgagtagctgggattacaggtgctcgccaccacacccagctaatttttgtatttttagtagaaatggtgtttcaccattttggccaggctggtctcgaactcttgacctcaggtgatccacctgccttggcctcccaaagtgctgggattacaggcatgagccaccacacccagccccactactgcctttgtctgttggagcctctcttcctggctcctcctgttgggatgttcttaatgatgtcatgcctatatcaagaaaagagatggaagtagagggacatgcacctctgggtgaccagagtcaccaggctgctctggccagagctacctgctgatggtggcagctaagttggtgagaagtgaggggctagacccttcatgtgatggcaggaggcactgtgtgaagaacagcagagagaacattccaagagcagccatttacgttgcaagaagttgtggctgcagaacatccctgctggtgtggagacagccaggactgtccatggctgcttttccagaagggtccacaccaacgccaaggcttccaggatgtctatcccccagaatcctaaggtttttactatctgtggtttggacatctttagcacaggaagcaccctgaaagtgtggtccctacccctcccaaataattagagagaaggaaagttgagaatttcccagttcatccatttactcattcattatagggaattgggctacaattccattgactgaatgaataaatggatgaattgggaaattctaggtgacacagtgaatgtgaaggtggataaaggacagtcctagccttccaggaaccagcaggctacagggggaacagatgtaaaaagaaagaatttgaggatagtatgaaagggccatagagtgtgtctcagagccagtagaggtggaaggcttctctggtggtattttacttgttctttcttaggtaaataaagcagaggccaagggaacaggatggacaacaacaatagtaaacatttctatagtactaagtatgtgtgtggcccttttagcctataaactcctttaatcctcataacaaccctctgagctgggcactgctattttctccattttacagatgagaaaactgaggctcagtgaggcgaaggagcctgtccaagctcactcagctggtaaatggcagactggttccagagctcaggctgttagccactgttcagcatggcctcttgcagtctctaccctcttcctgagagtaaatttcagagccaagttatagttcaagaaaagcaaagcaataatcattcttctacttcagaattgctaccaatgaacaatttattttgtgcctacaacagattaagtatctgaataaaaatataaaaacatgaattgattaaaaaatggcctctcataatgtgcaaaacagggtctgtcggggaaattttgagaggtttttgtggagaacaatggttctgaatgttttgtagaaagagcaaccgatttgccccaccctttcccactttccaatggaaaagaatctctgataaagctttgataagcaaccaacgtaagcaaattgtactgccctcttttacacatgattttatactatcatacgatgccctataatgtaaaaactgtacattttaatacctaccctggtggtagatgcacactatttatacagagcacattcaacaggcagcatgtcaccagtgatgcatagctgtttacgcatattgaggtgtgggggtggatcctgtctataatcactgtaagagtatagttaggaataattctatgtgaacaaactcaagtctttaagcctaattattaaaaaattacaggtcaagtaccataaatttgcctatgtgctgcaagagtaatcaaagagatctctacaaacaatgatttgtaatgaaaaggcaagaataacatcaataaaaaccatggtcacctgaacccacactgatgatgtattgtcaacacagagtctctcctggaagtgcaggaattccaggttgattgaacttgctcctgggcatggagcagggtgtctacagcaccagatgacccctggacttctcaatagaatggtgaatcaggaccattagtgaagtctaacttactaatactaagtgttggtaatttttttttgagacggagtttcgctcttgttgcgcaggctggagtgcagtggcatgatctcagcccactgcaacctctgccccccaggttctagtgattcttctgtctcagcctcccaagtagctgggattacaggcgcatgccatcacacctggttaattttgtatttttagttgacatggggtttctctatgttggtcaggctagtcgcgaactcctgacctcaggtgatacgcctgccttggcctcccaaagtgttgggattacaggcgcgagccaccgtgcccagcccagtgttggttatttttaaagactcatcagttcataataaaatgcccttaatgccgcatacaaatgagagtctatggaattgtgcatccttcgctcataagagcttcagggagtgctccaagcctccattccctggctctcagtctttagaagagttctttcctttcacctcgctcaccctgcctgatgagatcaaacgaaattctggacagaggtgatgccagtgagccagggagccaaagagccaggtctttattctgtgttaggtggcttaatagtcattgctcctgctgttcctttcgttgcttactatttctgggaagaattgttcatgtgccctgcatcctcactgtggtcccctctggtgaccactgacctgcccatgggcatggtcactggtccttagccatgatgtacagggtcagtagctgctgccgtctgccatctagggaccatataagtggaacctgaatcaaaattatcctctcacatctacctctccttgctcttccttttagggaatttcaacatgcttttttctggaactgttttcatttcccttctcaaagcagtaattgctgcctccgaaccattgacctgaaacaaaagctttttattccactgtactgtatcgtagtacacttgcaaacatgggatgtatggtttttttttttttttttgacagggtctcgttctatcacccaggctggagtgcagtggcacggtcacagctcgctgcagccttgacctacctggctcaagcgatcctcccacctcagccttcccaagtagctgggactacaggcgtgcaccaccacacccagctaattgtttaattttttgtagagacaaggtctcactatgttgcccaagctggtctacaactcctggaatcaagcaatcctcctgcctcagcctcccaaagtgttgggattacagacatcagccacggtgcccatctaggggcatatgatttttataacatttggagattattactgaagatgattgggagtcattaaagaagggagtcattgaagaagagtcttgacaatctttttaaaacactttaatatggaccagatattaggtggtcttaggaagttttttaattaaattacagttgcatagaaaaatgttcttaatttttagagactcatactgacatattgttgggtaaaatatggttgttatttagtttaaaatcatttgatgagaaacatatgggaaaatatggcaaaatgttcataattgttaaatctagatgaggttacatggtcattcattatacagttctatttttaaatttttttaataatagaaaatgatatagagataaatctccttgggtgttgatctagagggaagtagggagccatgttagtgaggaggtgaaggcagcgattcaggcagcgctggtgaggggtggagctaaaacagcaccactgcagagggagaggacagtgtggactgaaaagtatcatcttgtctgttgtcttccctcacttccacagtccaaagtgcttcgggagaaatggctgctgcagggcatacccgctggaactgccgaagaggaggaagccaggaggcggcagtctgaagaggatgagttcagagtcaagcaacttgaagataacattcagaggtaggtggcttccagcccagggaacccatgctacagtttttcagtgcagtaaccactgctctcctctaggtggcctttctcaatactgttaccttctcctgtacttgagaattttcttcctaaacaaagcacattgatgttgtttaaacttttccagatgacccagagttatgacacagagtactaataattttttatttttatttttaacttttattttaagtttaggggtacaaatacaggtttgttacataggtaaacttgtatcgtggggatttgttgaacagattatttcaccacccaggtattaagcctagtacccgttagttatttttcctgattctctccctcctccctcccttcaccctccaaaaggccccagtgtgtgttgttcccttctacgtgtccgtgtgttccatcattagttctcacttataaatgagaacatgcagtatttggttttctgttcctgtgttagtttggtaaggataatggcctccacctctatccatgtccctacaaaggacatgatctcatccttttttgtggctgcaaagagtactaattattgcactgggctgtaatacagcacagtgatggcttcatgggcccacaaggtgttgtgagcagcttgccccttcactaggtgctccctttgagttcttatattagctttcatctttttcctccttcgggtcaggttgttagctgttattgctgctgtagtgagtctgttttcaaatttgctgtatttggtcaattcgaaatgtgaaaactgtagtcaacagtcttgggattgaaatgaagagtgtggaagtgctgagtgagagcacctctgtaggttatgtgcccgtgctctaaaaattaactttgtattgtctgctttcactgctcagagagtggtttctttatggttctcaaccaggatctgatcacttcaatctgggagataagcgacctgtctgtgggcaataactggccaggctcacacaagagcaataatgtaggtttttacttgggagctatagccactccaggtcccaggacacctagccagagagatatgagatagggatggaaggtggtaagcatagatgccttagaaccaaatctgtccctccaacccatcccaccaaattctacctgaaatctcaccacctggagcttcatctctgtcttctgagcttatgagctctttttttttttttttttttttttttttagatggagtctcgctctgtcactaggctggagtacagtggcacaatcttggctcactgcaacctccgcctcccgggttcaagcgattctcctgcctcagcctcccgagtagctgggactacaggcgtgcaccaaccacgcccagctaatttttgtatttttagtagagatggggtttcaccatgttggccaggatagtcttgatctcttgaccttgtgatccacccgccttggcctcccaaagtgctggaattacagacatgaaccaccgcacctggcatgagctcttttaaaataaagggtaatagctaagctgctaccagccatttataaccaacagcaaattaagactctgagggcacctgtaatagtgtcactaaagggaaaagcaagccaagtaaatcccaaaggcatacgtcagcctatgtccctactttgcttaggtcctcacatgtcttaaagagctttcagagcagcttggctaaacattgtgaaggaaactggccaagaaaaagtttggagggtttgtgtgtacatatacatatgtatactcacacacacccgtgtacatgcacatgctttttcttagaatacaaaggataaaggctaaactgttaccaaccatttatatcatatacatatatatatagagagagagtaggtgttattatagacagaaggcagaaaggatttggaaaataggataaaattagttacatgaccttttctatttttctttttgtttcttttttttttaagagatgagatctcactctgctgtccaggctggactgcagtggtgcgatcatagctcactgcagcgtcaaacttctggacttaagctatcctccgacctcagcctctcaaatagctgggaataaaagttcatgccactgtgcctagcattattattattttttttttttggtagagaaagagtctcactatgttgcttaggctggtcttgaactgctggcttcatgtgattcttcccactcagtctcccaaagtgttgggattacaggtgtgaaccaccgtgtccgtcctattctgtttttcttaagtgtcactgggaaacatggtcttccaatcaaattggcagtttaaccttggcttgaatgcaaatatgttgttattatggtccaataggtggtaactcgcacttgtagaatgagccattgcgtgtggaggctagagtcttaaactgagactcagtttctgggtaaattgaccattggaaggaggtgttgtgggttaggggctggtttattattcaggtggtcatgattatactcaaagaaaagttgttaaagttctttttatcctttacgtcctttacgtcaatggaataaagagcacactcaatgtatgcaggcagtctcacccatttagagctagaatcccaagccagaggaaggaaatcacaatagcctacaggggtggatggtgaggcctggattcaggggccatttcttgtgtcttagtcatgactttgggccaaatgggcactggatgtgtgctgagatgagctgtgctccctggagctgctttctgtaggagcaggactgtggtgagcatcgtttcctctgcagggccttctgagggaggagtttcttctaccctggaagtcagcttctgcttctcttcatcttgctggcatcttctctaccacaatggttattagtgtctttaatcttcaatcccatgggaagaaagagctgttatctctcttcccataaaggacactcagtcacctaagacatttctctgtagttgaacatagcttagttctcactcacagaatgacatttgaatagttctaaaggctcattgcaaacatgagcaccctacggtgttacaaagtccctgtggattggctggcatggctctgctgatagggctgagctcacctacgtgactctaatctgcgtgttgcctgagtccactcttgtttaccctgcactaacaggctaaccatgatgctgtctctttctggcaatgggagaggtacaagagggctgagcagaaacaaggcctaggctcagactgcccacaagccatctgccaaaccaagtcaatgagcaagcccaaaaccaagggaagagacagccagccaacttttagtggaaggaacacagatcagggaagggtgaagaatggggatgaataattcagttttccaggagcatgattgttgaattgaaaactgcaagcattcaggaaaatggaccggcattagggaaactacagaaaagacatttaaaaagaaagaggactggctgggcacagtggctcatgcctgtaatcccagcacttagggagaccgaggcaggtggatcacccgaggtcaggagttcaagaccagcctgctcaacatggcaaaaccccatctctactaaaaatacaaaaattagatgagtgtggtgatggtcgcctgcaatcccagctacttgggaggttgaggcacgagaatcgcttgaacccgggaagcggaggttgcagtgagctgagatcatgccactgcactccagcctggcaacagagtgagactacatttcaaagaataaaaataaaaataaagaggactaactaaaacaatgcaagaatgcagagagaaaggaagaagagagtaagagagaatatgagtgacttcaagatcaaatttgcgatctgatctttatataataggaatcttgaaaactataagatcagatgcagaaccattaaataaaggcattttaagggaaatcttcattactcaaggcaaaacattaatctgtagatctttagatttgggccccctagtctaagtcacccccagcaatcaattagattctcctaaagagatacataaactggttgcaaactataaagtatattagtacagttgtgccctgaaggtattttcgtccttgttgttgaactaagaatagcttgaagacactgaaggaggaatagagaatagtaaccaaagaacaaggaacatttctacaaagaaagactaagggaaattgggccatttagtttagataacaaaaggataatggtatcataactcagaacttcaagtgtatgtaggatctaggccatgtcttaattctttatgtgcaggccattttgaatatggcaaagacttcaaataaagcatgcaaatttctacttagatgtctatttccctagatacctcctagaagaaagaacataatcaccttttaattcttattctgtgattctttacagtgccagtaactgtacaagaagttccaggtttacagacatgtttttttccaaaatgttatttataaattggtggtggtttggaagggcgaatgttgttcctctgccagaattattatatgtggtgcttagcttttgagggcagcccacgaagaaggaaggaatggaggaaggaaggatggaaaaatgtaactagaatattaaaccctgggcattagaatcacttgggaaggtttttaaaaataagaattaccaggcctcattctaggaaatttggatttagtgatccaagtaaggagtcctgtaatctgttttttaaaagggtgttccagataattctgttgtatggtcaggttcaagaatgattgcagtaaatggaaaaaaggatagaccataaatgaaatcccattttaatacctagaaaccccccaaggagagtgggaagtaaatcatgtttataagaaaactggcttcacacacaaggataaaggacaacccaacccttgattcagactgtttctgagccttcctactttgacccaaggatatgtgaaacctgctttggggattcctgtaggtgagagtagctctggcttagagctgaagtctctcctccataggccccacagtagagctaagctttcatttgaagtggattagaaacagccttggtttaccaggctaaagatgatccaggtcaggaaaactgtgtgctttaccaaaggccagaaaattctaccattcttccaagatttcttgctaaaattcaaagtaatgtggtcttgaaggggtgacaccaaagcagctgcaaaggaagaggaaaacccggctgccacagtggagaaatagattgtcattcttttgcacagcttttccctgggtaatgtcaggattatatttttggctccctggaaaccagaattaaaataggctaaataagattggaattgttgaaagcaaaatctgtagacgtttccttttttgaattttttgaatgtccacatcttctgtatgctttgcttctttttggagtgacgtattgagaaagcccaagagattgtttctggcttgggcccattgccagccattgtccgtgccattattgtgtgtggtgggtccctggaggccacatgtggacctcgggttgatactttcggagattgtaggtagttcgagccacactagccctgtttacttcatgtctgccccaagcatcaagtcttgttgtttaccttgtcactttcccacttaagattctctttcatttcactgggttttactaaagtgtttgaaatacagggtttttaacttcctttgattagtgagaaatatggggaaaatttatctcccaaccttatcagttgggggcagaccaaccccagtgaagatgagaaacttcatggagtattaaatgaaaatgggatgagctgtcacaaagccaggatgttaattctagctctgctgatcatttgctgtgtgaccttgggcaagtcttttgctctcttcagtctcagtttcctcatatcttcagtgagccatctctcgggatcttccagctctggtattctgagtttctctaatttgaggagttggttagagatctcttttctcaacagtgtacctgttccgagaaatgttactgttatagaaggaagtggttttggaaacgggtcagagtggaggaaagaggttgagttctcaaaaaactaaaggctaggtataagtaactgattcatcacagagatgactaattcatcagaacagctgtctgttctaaaatatgtcacatcaaatattcattgaataaaatattgaagtctcaactgctaacctagagagagccaagcagcttttaaaaaatcaggatagaagtgtacttttcatttccacattggacctgtgattctctgagtacctgtgtgggtctctggtaaataccagaattcacttaattttccatattgttaggaggctcaaagccaaaggcgtagagacattaggcataagcatatgtatcttattaagcatctgtatgttatgttgtggggtttggcaaccaagaagatgacagttacttacaactgttctagaaaaggcaaccactgaaacattcattgaaatcacaaaggacacttgcttgagattcattgtgttcttcacatttgctatttttaactccatgattcactgttcttttgagcagggaggggaacactccacagtggcattccacatctgtgcacttccagccggggtccccaccccacgttcagccacatttgcagcccaattattgtttccattcttttgtttccttccaaaataaaactatatatgctatgtatacagtaaactatatagtagtgtctctatattgtgtaatatttcctgttttgtcactcccttctgggtagcggcctagcttttctgcctccatttaattcattaattttctaatttaagccttgtaatactcccatgaggtagtgatgatgatgatgatgatgaagagagaagagaagcacaggaggtgaagtaacttgctgcccccccctaaaaaaattcaatggaaggacatacaagatgaatgaaaaataattttaaaaaagtgaaagagcaagtatttgaactcaactctgcctaattctaaagcatgttctcaaaaatcccaacagaagttgttattttaagctaaatttttttgagacctctgatattgagtgaaattacactaacgtgcacctcgtgatgtaggaggagggacaggtaatgtgattctccctcctcaacctccacacatgcttcttcagaaggcggtgcatcagacgcaccatgactctggaggtgccggtcttcagcctattgtgggtggtcatcatgatggtgagactgcccccttcaggttctttcatgaagtgcaggtttcattttgggcttggctcctttctgtctcttttggaagccctttgttcctgattgcactttctagcctgtgtacagtctaaacctctgcgggaaacagtgtgtgcttctgaaaagggctccagcatagcaaactcactagaaagccggacctcagagcttgaccaaacttggctggagtcctagttctgtatttacaagttgtttgatcttggacaagccatgtaaactctctggacttaagtgtcctcgcctgtacattggggaaaactatacccaccttgcagtgctgttgtaatgtgtagaggtcaggtgtgtttgtgaagtgccaagaacagcaggttgtcagtaagaatagtgctgttggctgggcactgtggctcatgcctgtaatcccagcactttgggaggctgagacagatggatcacctgaggtcaggagtccgagaccagcctggccaacatggtgaaacctcttctctactaaaaatacaaaaaattagccaggcgtggttgcaggcgcttgtaatcccagctactcaggaggctgaggcaggaaaatcacttgaacccaggaggcggaggttgcagtgagccgagatcgcaccattgcactccagcctgggcatcaagagcaaaattttgcctccaaaaaaaaaaaaaaaaaaaaagaatagtgctgttcttattgttgtttcttccatccccctacagcagagtttcttaacagctgtgctattgacatttagggctggatagttatttgttgtgagtggctgtcttgagtattgcaagatgtttagtagcatccctggcctctacctagtggcttccaggggcaccattgccctttcccagtcatgataataaaacatgtctccagacattgctgaatgttgccttgggggacaaaatctctccaagttgagaactactgctcaaaagcctggcattatgtgtattgatactaagatgagaatctcaccaccgagtagttccagaatacagaaccctaaaaagatttatgaagataacattagtgattctcagtgcaaaatgacaaagtgtttcagttacttgaaaataaaaggcttctcttatgcactgagccatgaaagtctgttcagagttaaaaagaaatagttgcttttttggtttttgcattcagtattgtgctgcttttgcaaaggcaataattttatgacagttcataaaaccatggaatcttagagtatgcataactgacatgttatgcggatcaactcctatctgattcttgaatttgcaatgaacgtaatgagtgggagtgaaaaaacagtctctccccaaagcctgaaagtgacaggaaactcatttacttgcaaaataaaacccaagtatatactggaacaactctaattattacagaggatcctcctttgggatgaaagttttgttccctgcagctcctaccctctctctggtccctgccctatcctccaaggaccacacagaaaaagccctcttcactgactgaaaaaatctagatgcttagggtttgtggtcagctttgcaagctggcacaggtaagggaggaaacactctgaaattgcagtgcagcatttcaacatttcatgtgtgttacttagcaacaatagcaggaggcctgccagatgtaccagagtcatcgtgcctcgctcaggttttgtaggatccattataatcatctcattattggtctggcaaattgggtttatagtgcccagaactatgaaaatagtagttgaatttcttccatacactgaggccatgtaagagccatatttgggaaatacatgcatttcccagccctcagaacaattgctgcaatggaaggaattctgcaaagtcaacttttttggtagccagttccaggctttttggcctatgattgccacaccccaagttttctctctacaaaaagctttgataatagtctttttccaattttaggtcaccttgcatagcccctctggcttgtaacgtggtcatttccaaccgttctacattcttgatgaaatgaaaacagcaagcttcctgttgacatactcttccacagttttcatgaattatgcattttgaaggcagcagacaagatggtgtctcagtcctttccagcgattctccagcatggaggtcttatttggtacatccatcacaagggcccggagccaagatgatctcttgagcacaatccccacttcgtgtttccccttttcactgtgtaggccacagggaagagtactgtgggacccgaggctgcttgatactcatcaaggcccgcttcctccagccttcctagcttctctttccctcaggtctaggcgtggagccctccaggacagcgaacgggtgataaaatatacaaactgtctctgattatgggattttggctccttagccaatgcatgcaaggatggtagaaaaaacactcatcttccttctactatcctaaaagcaacttccgacatcaagaatttttttggatctctcatccaaaggtataaaccttaacagtgggaaattcagaccaggtgagaggaaagggttacacactaagagatgacttaggtttgggtagtttcatcaggagaggtctgcctgcatcctggttcctgtccttgttttgggaaactctttttagcatacttggagtacatattcagttaaacttgcaaagtgaagaatcagagaatggaggcctaaatgtgattcacctgaggccacacgcagagtgaggagataccagtgtgcttcctgcagaagcatctcccacatctctgccaagcctttttatctcctttgaaacagaatctctaatggaataaaccactccagggatcctagagtcttgtgtttgttcctcctatgcagaaaggcaaaggaaaaaattaaataatatctgaataccgcccagtgcacagagagtacctgtgaaattacagggacattcagccagcaaagaatgtccccctggccagggtgcctggaggaaggcttttaagcattaccatgctgtacagcatggggctgccagcttgaccagattctagctggaaggatcaggcatctttaaagaccggtagcattcagggccattgctgggccacatggctcctttgtgcaattagaaaatgcagttccacagggtaggcagcacttagaaagccactggctggacttcacctccctttgttcccttggctagcatcttgggcaacaacattctgtacaagcatgcaccatggccctgctggcttcttggtctccacgtgcctccttcttgttggtcattaaggttatgccattttcccccattattaagtaatgtcaggtaaggtctgaggagatggagatgaagacttttacaggtcgcaggggaacactgacatgtcactcatcattttgtgtgtgtgtgtgtgtgagacagagtctcactcactctgtagccaggctggagtgcattggcagaatctcagctcactgcaacctcccatctcctggattcaagcgattctctcctgtctcagcctcctgaataattgggattacaggcacccgccaccatgccaggctgatgtttgtatttttcgtaatgatggggttccaccatgttagccaggctggctttgaactcctgacctcaagcgatctgctcaccttggcctcccaaagtgctgggattacaggtgtgaatccccgtgcctggccatcacccatcaatttttaaatggtggagtagctcccatgatggatgttatgaaagggtctatgggtgcatatgaaagggagtggtcattactactcagtccaggtaaaactccctggatggagggtgaagacaatgtggtttgagttgttaggtaaatgtttccttatcatttttcattatatgttacatttacattctgttcatccctaagatataactccttaagattacatctctcagatgtaaactccaccagagtaaggactgtcttggttacctactgtgttcatttcctgagactgatgtaacaaatttctacacgttcgtggcttaaaacagctccagaggccagaagtccaaaatcaagatactggcagggctgtgctttccccagagcatctagaggcaaatccttccttgcctctctcagcttagtgggtccagacattccttggcttgtggctgtgtcgctctaatctctgcctttgtcttcacatgggcttctcctcttgtctctgtgtcttctcctttgtctctcataaagacccctatcattggatttagggccctcctaaataattcaggataatctcttctcaagatccttaaattaattacatctacacagacccttttatccacataaggtcatattcataggttctgggggttagggtgtggacatatctttctagggccatcattcagtgtactatatctgagtgcctagattactgttttacacctaggaggttgctcaataaatagttttcaatttaatttatatgtttcagccttagtttatccataagcttgccatgaggttcagaaaccatcatttatatccagagatggtataaggcagtggttaggggcatgaacatccgcgtaatacttgctgggttcaagttcagaatctctgcttgctgcctgtataatttgaggcaagttctttagcttctctctacttcagtttcttcttctataaaaagaaataataataataataaagatcaactttattggggaggggtgactattaagtcaagatatgcaaagagtacccagaactgtcttggactttgtgcccaataggttttggcttttattataaaaataaaagaatgatatgacaatgtacaatatataaacaatctcaaattgtttgattttatcagactccctctccactttcagaaacagctgagagggctgtcactgcactgagattagcatggcattccagaactcgggcccggtaagcatccaggtccaagggtgccttggaggggtacacctcacctttgcagtccagggcagaggaaggcagggaggctaggagtgcagcactgagagagcagtggccactgccttacaaggccaagaagcgtcccatctccccaacaactgtcaggttccttcctgccctgggaacagctctaatctgtctgtttaccacctacctgccagccttcagcaggaattccaggactgctgggcctatcagctgaagtagaggatgaaaaagaacaaatccaaaggcagaagaaataggacaatatgatagatggatttgacaagaatccagaccaattgtgggcagaccaagttgaaaagcgtgagaggctagagttatctcagcaggggtttcgttttgttttgttttgtttttgagacagtctcactctgtcgcccaggctgaaatgcattggtgtgatcttagctcactgcaacctctgcctcctgggttcaagtgattctctcgtgccttagcctccagagtagctgggattacagttgtgtgccaccacacccagctaatttttgtattaacaccgtagagatggggtttcaccgtgttggccagggtagttttgaactcctgagctcaagtgatccatctacctcagcctcccaaagtgctgggattacaggcatgaggactgtacccaaccatctcagcagttattttaaaaaatgtttagccttctgatgagaacacgtggacacgtggtgcggacaacaaacactggggccagtcgagggggctgcggggagagagatcatcaggaagagtagctaacacttaggtggtgggttgatctgtgcagcaagccaccatggtacatgttcatctctgtaacaaacctgcacatcctgcacgtgtaccccagactttaaaataaaagttgaaggaaaaaagttcacttttctgctttccagttgcttatttaaaaaaaaaaaaaaaaaaaaagaagcatctggctgggtgtggtggctcatgcctgtaatcccagcacttcgggaggccgaggcaggtggatcacctgaggtcaggagtttgagcccagcctggtcaacatgatgaaaccccgtctctactaaaaatacaaaaaattagctgggcatggtggcgggcacctataatcccagctattcggaaggctgaggcagggagaactgcttgaacccaggaggcagaggttgcagtcagccaagatcgcaccattgcactccagcctgggcaacagagcgagactccatctcaaaaaacaaacaaacaaacaaaaatgcatctaagttgtctgagtgatgtcctgctcaagtccataagggacttgctttattacagaaaagtggccaaacccagtaatattgaaagtatggtccagggactgcttctggtcaggcaactgtttattaccagtctgtgacaaagacagaaattgccagtaaggtgtttagaaactttaatagcaatatgatatcccaatgggtgatcaatggacccatcttactgaatagggtagagacaagtttgagtgtcgttgcactcacgtggtgagctgcatgtgtcgtgggctgagtgctagtattggtctgtgatggattgggatcagacccttgtccatgaccataaaatcttgagcaatattgcagcaagccaaatggcaaagatgactatgtgccccaagaccacacttttttttcctatagtttttttaagagagacacggcctcgctctgttgcccaggctggtcttgaactcctaggctcaagcaatcctcccatctcggcttcccagagtgctgggattacaagcataagccactgtgccaagcctccctaaatgtttaaatcttgtcattgccaccattctgcaagatttacctttgaatctagaaaagaacttggagtctttctactaggcctatccccacaccacttcccatcatagaggtgaagaacctgaggccgggacacaccacaggactctcagaatgacacagccagtcagattttcctggcacaaaacccagtgttctttcaaagccaccattcttttcctgtaactaatgcaaaagcaaatcttagcccatgacagggaatcacagattccaaatgagtgccctcagaatgactggtttccttgaaagcagctgtttcataaacatgactttgcgggggcagctcaggccttccatgcagtggagtctgctggtcttggggctgctctgttaagcaaaggatgggaaccaaaggtactgacattttaatattagccacacagatgtcttggcttgtaatctggagaaaatcagtcagtgtcccagctgaatctgtaaataggaacgacaataagatttgctctctctcgggacatcctaagaatttttgtcaggctagaagaggcagcctggagagatttgtttgatctgggaaagcagaagtcaaacttggtttttcattcggtaagatccactgtggttaaaatgtggtcagagggctcattcagcctcctacttcaggtcgaactatacttaccttctcttacttttaaagaaggaagggagattctgtaaatgagtggcttttcttttagtcagtgctgtcatatgccatgacaatattgtatttaagtctgttctcacagtgctaataaagacatacctgagactgggtaatttataatggaaggaggtttaattgactcacagtttagcatggctggggaggtttcaggaaacttacaatcatggcagaaggggaagcaaacacatccttctttacatggcagcagcaaggagaagcgctgagcataaggggggaaaatctccttgtgattcatgcctgtaatcccagcactttaggaggttgagttgggtggatcgcttgaggtcaggagtttgagaccagcttggccaacatggtgaaaccccgtctctactaaaaatacaaaaaattagctgggcatggtggcaggcacctgtaatcccagctacttgggaggctgaggcaggagaactgctcgaacctgggaggcggaagttgcagtgagccgagatcacaccattgcactccagcctgggcaacaagagtgaaactccgtctcaaaaagaaaaagaaaaagaaaaagaaaccattagatctcatgagaactcactatcacgagaacagtatgagggtaaccactcccatgattcaattacctccccaccaggtccctcccatgacacatggggattatgggaactataattcaagatgagatttggatggggacacaacgaaaccatatcaaatattaatagagtctggcagggaggaagcatgacttcatactggtggtgagtcagaaggggcatcttcatattttaaggaaggtggcacttagattccaagtgcgtcctgtgtgcagtggagtcatatgcagctctaataaagaacattattcaggccaggcatagtggctcatgcctgtagtcccagtttgttggcagcctgaggcgtgaagattgcttgagcccaggagttcaagaccagcctgggcaacatagtgagacctcatctctacaaaaaatacaaaaattagccaagcatggtggtacatgcctgtcgtcccagctactcgggaggctgaggcgggaggatcacttaagtccaggagtttgagtctgcagtgagctatgatcatgccagtgcactccagcctggacaacagagcgaggccctgtctccaaaaaataattaattatttaatttaaatgttcgaaagaacattatgcagatgcttctcaggcttctcttcagatggcaaaatctcactggttttcaaatatcctaactgaaatgttcagttccagctatcttttgcttcatccagtaattagtttcaagtttttttttgcctctttttagatatgaatcccatgctaggtaacaaattatagtgacaggaaaatgtggatttttccataaagtttaaatattcaccactcaaccttttagcagaaagctctgggaccaacctagcataagtatagagttgagggttaagagtaagcattcttcccttcgtcacttatgtggccttgaaccaattagttaagattttgtgcctcattttcctcatctgcaaaatggaaataatcataaggtatactttggggattagtgtgaggggcaaatgagttaacatgtataaattgcttaaaatagtatttggcagccaggcttggtggctcatgcctgtaataccagcactttgggaggctgaggcaggtggatcacgagttctggagttcaagaccagcctggctaagatggtgaaaccccatctctactaaaaatacaaaaattagccgggcatggtggcgggtgcctgtaatcccagctactcgggaggctgagacagagaattgcgtgaaccccggaggcagaggttgcagtgagccaagattgcatcactgcactccagcctgggcaacagagggagactccatctcaaaaagaaaaaaaaaatagtatttgacaatgacgatagctgctgttattatcatgacccaaatgctatatttgcttcaagcaaatggaatgattctcagaccaaattttttcaccaggcatttattagaaggaggtttcatgtaattctgaattatgctccgaatcatattcacttcattcaatatgaaaagcaagtatagatttacagtttaattgttttgagacagggcaggattcctaatcacatttttagaaatgacttttgtgtctcatattgttcatctcctctatcctctcaccaagattccactgtgtttcataccagcttgttcagttgaacaaggtggagaagcccatttactgtttggattaaatttttttatcaccagtgtatgaggatttgcattaaataaattataggtaattacattaacaaaccaagaagacttacagttaaagagggcaaaaatataatttacttaactgctctatgaaatctatttgtggatttctctcttctcaaaggagaattaatcagagaacaactttgttgttattgttgttgttgtcgtttaagaaaaaaaagaaagaatgaatgaaagatcacatagtagcagtggtaccctattcaccttgcaacagttgtactctgcgcacctgccccaggttatagcaacatcaaggtcaagctcccaatatttcaagtacaaataagacttcacctgtgcacaaacatgtgcttacacacttccatcctcctgaattttctttccagactgttttacagataaggaagcagctctcaaaagacctctctcagacatttgaaaacacattttttttcagagtgctaaattcatgcttcttattttatatatgttagaaataaacacataaataataaacagtcttgcctggactggttcatgttcaattcataggcactgagtattctttattaggacatactcactattgtttgttgaattattgcacttttaagaaatcaatctgaagattaaacattaggagtctcgataaaaaacaagtctctatactttatgaagatcttaggaatttctaactgactttggaacagccatttgttaaaaaacactttcccatcccaaactccactgactccatttttcttctgcactaactctcccttcctcctcccccatatttggagcagcgtctctatgtcccattcactctcctacacctgccaaatcaccagtgactatttaggggctaagtgcaaaggagacttctaaatcctcactttcatcaactgttgagcagcaacggaagctgctgaatgctccctatttcttcttgaaacacactctctccttgtttacttgagatgacactatccttcctctgtccatctgggaaatattggtgctttgaggttcttgacttggggctcctttcttcacttctcccattctctgagtgacattgtctgttcccatggcttctgaaatataggcattctttgatctaattttttctccagacctacccatatagccaactgccccctaaccatatccatttggatccccccagacacctataactcagcatgctaaaaattcattagtcattactttctctgattgattccttttcattgattcttaatctcattgaaaaacatcaccatgcacccagttgcccaagtctgaaatcaggacattgtccttgcttcttttcaccctttcaaatcctctatctaatcagtaattttatataataaaaggattcttgattccttctacactttttctttcccacttccatgacagtagtccaggccaccattatctttcatggggattgatgcaagagcttctcacctagtctcccttcccctagtgttgtgtccttctgacctaacctctgccacccagcagaagtatctttcaaagttcatatttgatgatgctactctccagcttcaaaccctttacctgttttccttggactataagataaagttcaacttccttaatttagcttagagagtcttttatgatgtgacctcctcttacttctctggccttgtctctcataattgtgtcattccattgctgaccactccagcaactacctgccattccttggatgtaccaagctctgtctgtgtcccgttctttggatctactgtcccttctccaaggaacgttcttcagctgctctttatgtggttaactcctactgaaccatcaagtctcagctgagataccactttccctgagccctaaaccctggtttaatgtttcctgtgggcatatttaccttagagcttactgtgtcatagtacattggaagctgatttttttctctatcctcctctagcctcagctgcctaggggtaaacacactacagtgttcacccttgtattctcagatcttagtacactgccaggctcaatgggttttcaaacatatttacataaagaaagaaaacaatgacaaaagtgcagatgacatgcccatggatactctggacataaatgcttgtaatatttctctctgtaagcgtttccagtgggaagttcagcttttgtctcaattactctgattggcatgcaatcatgacaagaaactaaaggaaggagattgttttcttgacatttactgagaagtatagacaagtactgccatgaacaaacattcttgctaacaattcttgctctaaattggttgatataacatccacttgagtcaaaatgattaagtaggtatccattgagtgtcatgcatcgcaatggcaaagcattggagttacagaaaataagtaaaatcatctcccttgctcttacagatctgacagtctaggcacccaatagatgggtaaacaagtactgagagatgtcatacttgtcctcaagatagtagaaattcaagaaagtagtgaccatggaggaccttaggatttgggcttttaccccagtggtgtttggctgagttaatctttctaaaatgtattcatcattcaatcaagtgcttcttctggaggccaagcataattagagatacagagatgaaaatgacagtcattaccctcacaagacctataatctacccaataataatgggaggcaagcctttagagttttttaatttggagttttcagagatttcctgaagcttctggactgacgtttctattgtacttgagtcccatcatttgacattagaagatctccttccaagaaatatttcttaccaccaaaagacagttaactttgacttcagacagaacattctggtctgcacccagaacctttaatacctgaatcttttaaatcagtgatggtctcttcttctaaaaagtaaaaggtaaatcaaattcagtatgtctcaattaattggaagggagtttcaagctcataggaaatgaactacgaagccatgttgggatatgaactgaatggttgctattgagatggagcaaatgtacctggatatcattaggtggaaccagactggaaaatgggggtccttccttgacctcagtgaagatttggccctttcagcctcaagtagtatcccagctccagaactggacctgagttactggataatgctgtcattaggaaactgtgaccacctaggagttggactgctaaatgggcaatgtcagcaggttgttacagatactctatgcagaccaagcttatttggctcttctcagctcagccacctgttgtaaacagctgagaggggcttagctccacgtggaggttgtcactatctctggtatgttgtctctccctgggaacggacatgagtgtggaaacagggaggacacagttgattcctgctttcactgagtcactctgtccattaggagaaacagtccaggcatggccagccaaagggaggttcttcgcaggatcttctgtctctttgaagatgggataatctcaggcctaaccacagaagcagttctggagaagagtcagaatagcagattggaaacagctcacaggggcctctgaatgctaagtggagggacttagaatttatcccagaggccacagaacactattagaagtttcagaggtataataaaggccgttgtgaggttaggatgctggttcaatgtcacaattagagcaaggcaggaggtagagaagtcaagggcagactgggaaccagctgggcaggccactcattttggttgaatttggcaagactgaggaagacaatctaccaatagaggatggatgagaacaccagaaagcaaataaaacaagtcattcaaaaatcccaagatcatcgtggctgggccagagaaagaatcagacagaagcagcgcacggctctggagagttgcagggagaagcattgctgcatccgctgtctccttttctttttctttttttaaatatcagcaatatcttggatctgaatagagttctatcacagattagggtttctctttccccagggttcccaaagactgagcaggatcttattacagatgcagcgaaaagggtacgtttttcagtatcagactgacctcatctgaatctcagcctcacatctcattaactacatgggaccttgggcaagctacttcacccatctgcaaagtgggaatcaatgatatgtatctcatttggctgttgtaaatcttaatcaagttaatatatgtaaagtgtctcatcagtgcctagcgcatagtgagttcccagcttctatagcaccctttcatctttctctccttacagcatcagagagcttgtcctctgtggctcccgtttctctctggccagaggcagagcctccatgggagcatgggagggatataatcagaacagcagcattctttcattatgacgtcaattcagccatccctcaatttactgagcccctgaaaggccatacagtgagccatcattgtaatgaagtaaaagtagctggatactccaggaagcccttctagtggcactttgttaggtgagatgtgtcagcattgacttcttttgtaagtgctacttctgttgaattcaatgcgttgaaaggtggaatgcattgatgaatgtattcagtgccttggccacttctcagttagcttttagagtagaggacctcatggccacatgacagagtctaactgtcagtttccagacatttactgtgcccttggccctgcttggactttggaaatccaaagatacatatgaccgacgcctgctctgggaggaattccctgtccatgtggaacacatctatgcccttctggtccaagtgagaagagaacatgaaggagcaagtgtgcatgcccataagtgccggtccctactcagttctcactcagtcccacagatacccaggtctactttatgtaggtccttgtgttggtttctggcattgctgagatgacagaggccccagtctctggagcctcagagatttcatggacacctttttctgcttgagctcatgagccagatatcactcctggcccaggtcactgggttaccagatgcacgggtgaaagagctgctcttgagcaaagggcctgggacacacatgccggagaagcatggtgagccagccgcagggaggaagagcactttgcaggagcatgctgtgcggggtcttgctgctgcttttcagaagcaggagagccatgagccttggggttcacatcagcaccgagactggcctttggtggcagggaggatatgcgtaccgggaggggttggccatactggaccacagggccactggttgggttgttcataattgatctttggggacacttactgcaacccatttattaggtgccccctctaaagtgatgatctcaatgaagatggttcacataggcccactacttctagaaggcccgaatccctggaccttcccaaccactttttctccctgttcctgggttacatggcttagctggatatttttgcacacagcattaagggcaagtgcactgttcctttgaaaacaacaagggaacaaggagttcagtgttgtggacatttaatgaactttctcctcctaagtacacaataccaaatcagcagaatcacagctgtctcctcccagctttacctaaattcccacatgtgctacctcagttagggaactatgacttcacctgccactagatggccctccatgtgcacataagccgctcccacatagcgaacttgcatcagattttctggatttttttttttttttttacatgtagacacacatgtgcatacacaatcttaacttttaccatccttgaagccaataatcaacactttagttttccttctggcattcaaatgatagaatgtattctcattctctggaaaatcagtttaacatcagaatctacagatattcctgaatattgtgggccacaaagcacatattaagatgaatttgaatttattctattaaatagtatgctttggtttatcttataaatgctgtatttaacagacttgtttctaaattaaatttttttaaagcactggaagagaaaggaagcacaaacatttgaatagtacttgctccatggaggcgggcagtgttctgaggtattttaaacattagctcatttaagcttcataactttgatgtaggtattccatatgcatcattataaccattttatagattgaggagaaaatcagattgcagcatgaaaggtgtttagattcccttttgccttcctgtcaattttcttacctataacatgggaataaaataatccctaattgctgtgaaaggatgttgtaaactctaaagcattacacaaatgttgttattattattatgacttgggtttcatgggaatataattttcttatgtgctcaggaggcttgtgatcattcattcattcacatgaaaacatttatgcaggtcccaggtcattgcctctgcatgagacgtctcataccgagatgcctgtactatttctaaaacaaatctagtctgtcttgaactctcttatagctgagggttccagggaagttgctgtgtgctttcagcaggtaattctcccttagtctcaggatttagaaatgatggatgtggtaggacaacttcaggggtgggacctctgctgaacacagaggtggccggtgctgatttcacataagccaagccagcgggaagaggcaggctgttttttaaaattattattctggagcacgatgtactatctctgtatccaagagttcacatttcaagtggactatcagatcatctctgtgacagagggctttaattaaaagcataagtctctgggtggattttaagtggcattgtttttctttggacgttatgcaagccacttctgtgctgtaaaagggcttttaaaatttggcttaaggaaatttgctttacccctcaggctttgatccctgcgtgtgaatcattttgtatctggaggttccaatttgcagtctcctgggtgtaaggaaaattctaccctcacagaacattttggatttgaaaactgagaaatctgcatcattctcgacataatagctgttgtaaaatagaattagggctgttaagtctatagggataaagttcaccaaagaatattttaaactttagttttagttcctaaagtttttgtctccaactcccataataaatgtactgggacagtgacctacccactcaacacctgaagctcagtgttctctgcactcaggccaggtggactcagccatcgaggccattgtccctgtccagcctcccagggggcacgcatgagccagggccaggatacagatacttctgcctcaacaccatctgtaccaccagaaaagggccccaaaggcccttctcactgccatttgtaaggcaaaatgtctctattttatctaagacaggaaaaaggcagagagatgccagagagaatgcaacgactgtgcccgtgagaaaccaacagtgcagggtggcgatctacccgcagcacatgcaggatgcagcgttagatgctgactcagtttctcagccatacaggagaaaagtttcagcatttctcaaactccatgaccatccttcagtcggctaccccaagccccgttttgctgcagccgggtgagggcagtaatgcagctcagtaggttaaggggccaggctgtccttggacttcagatgatatcagttcagtccctgggacatcttaaattagggcctcaagcttcaaattcatgccttggccaacacgttaccataaatgatcacagggagaagaaacagtcaggccagggatggtggcaggttcctgtaatcccagcattttgggaggctgaggtgggaggatcacttgaggccaggagttcaagaccagcctgggaaacatagcgaaaccctgtctctactaaaaataaataaacaaataaacttttttacaaaaaagagaagaaatggtcagtttacgttgcatttccttcttttcctcaagaagaggtgccccgtggtgcctgggacagctgggccatcacatggaagtggctgagaggtgggctggaaagaagaggaaaatccagggctcccaccaaccccagccaatctctagtcactgggcaacctcaatctacttctggtcatagttttacaattttgcgggggtaggggggatggaatcttgctctgtcacccaggctggagtgcagtggtgcaatctcggctcactgcaacctccaactcctgggttcaagcaattctcctgcctcagcctccccagtagctgggattataggcctgtgccaccatgcctggctaatttttgtattttccgtagagacggggtttcatcatgttggccaggctggtcttgaactcctgacttcaagcgatccacctgcctcagcctcccaaagtgctgagattacaggcatgagccactgtgcccagcaatagttttacactttaatattgccaactttttttcagcccagcctgtgcagccacacaaatgcaaaaaggttagcttaggaagttgtcaacatcattatactataaaaatcaataaatggaaccttcttgcttcccacagtagtccatgctaagcttggcttcaccatcccttgcttggacaactcctaattgttctttatggtttcactctgtaaccctttcatacatccaaatccgttcttttcacatctgtccacatggtctttctagaacatagccaatcctatcactgacttaaagcaaacacataaacaggcagacagacaaacaagaaactcaaatggctttctgttactttccgaatcagactcattagtgtggcattcaagagccatcatatcctgagcctgatcctccctgtcactttctttccctcatgagtgcactcagataggccagtcctacagaggtcctcattcactcacttgagcctgccttgcacatttctgcatcaaagcccctttgtccatgttatcatcctagcttgaaatgctgtctgaacacctctatgccttgatcatttttctcttcaagatcctactgacatgttccaacctcctgaaatcctgccctgcctccccacaagcagagttactcagactctcttctttgcattcctgcagcattttggtcttgcaatttgagctctactgtgcactgcattgtaactattcatatagcttcctccctcatgagatgatgaatttctcaaaagtagagactgggcagctgttactgaatatagcccaacacttgcttgataatgctcgataaacatgaatgagtgacccagaacatttcaaacttcccttccaagacctgaaagactcatatttctgggtgttttaagctctgtgatttctgctctggtcacctgggccaggaactgcctgcctctattttcatttcaggcctttctctctctgccagatgccttgatctctgagccgagtataccttgacccaaagccatgatgcagccctcagcttctgagaggaaggggtagggttcagtagttgcgcctctgagaacatgacagagaacaatagcaggaagcagccaagcgggaaacaatcagcccggcacaacccatgtggaggagcttcctgattggcttgatctggtgggagcaggaactcttacaataactctggaattatcccagtgggatgacaaatttctccactgaggagaagctgtcacctggtaatgtcaagcacggaaaacacagttagcaaaaaacaaaacaaaacccaagacaaagttctcttgaggaagagcagtttggatcagttggaagcctcccagccactgccatagcaccccatgccgacctccttcctagtctctgtttcaggtacaattaagtcgtcatctctaccttccggatagatatcattctgccgtccatggctcaaaggtcagaggtgctgtttattctttggtgtccttttgggtagtttagggaaatccatgctgtaggtgaccacaagagagaatgttcccttttagaactatattgattgagcacaggctgtgtgcaaatactcttctaggcactgtggatgccatagcaatacatgctgtttctgctttcatagagcagtgatttccaaatcctgtgtatcctatggaaagaccaagccaggcaaggggtggagtgacaggagctcccagtcagctttctccttaaaccacagcagctccctttgatcaagatgttggaaaagaaaaatctaccccaaaaagaggaaatgctgaaaacatttggattgggagtggtttcatttgctcttaggcaggacacactgcagggtagcagttaatattctaggctctagctacaagcagacctgggtttgaatcccagctctgccacttactggtggaaggtcataagttgcttgaactctctcaacctcaagttcttcatctgtcaagtgcgaataacagtagtagatattttaccaagtgcaaagaattgaataatgcttacaaaccatttagcatatcatctggcattgtctattacagtaaatgctcagtaaatgtgaactattttacccctgttgtttgacgttaattttttttcaatgaatgactcattgagatactaactcatgcgtcttgaaaacactaccagtctctccagagtaacctccaatatggacaacaggcaaaaatatggtgattattcccagtttgggcatttgtgaaagatgtggctgaggctgtatggatgcgtgtgcacacacacacacacacacacacacacacagaggccgatgggaaaatctaactcagcaggaaagctatcacagagcgctggatttaggcacaatgagtaaacagggatttggaagagaggaatgcaccacataaacaattttcacaatctggtatgaaagcccagatgcttcctgcatgaaggggtgaactcagagagcgtcacagggcaaaatgaagtaaatgctgagactgtccatcattctggcccaattcctacatatctgtgcatcttctacttatggttttatttaggtgagaataaataagagtacctcatagtagataagaatagtacattacacacgcgcgcacgcacacacacacacacacacctggggttagatgaaattgtatatttggggaacttggggtaaagagtacagagccacacagcagttaccttctgcatcctcctgcttcagagaaagcaaataagaccagtttctttttaatctgttgtttttactaagtccaggattgatgttaatttgaatttgttcttttaagattcatttttgactgaaagaactgagccggaaggtctgcttgaggctacttccagttgagaaacaatttatgtgttcattgagacagtcatttactcaaccaacacttactgagaactttcaatgaggcaggttccttgctagatacaggccagctagatgctagaagccatcatcaaaggaagatgaaaaagtgatggtaattatcctctagaggtttgtaaactggagttagggaagggagcccaaaatccatgaatgagtgattaaaatacagtgggataaagttggtggtagaaatatgtccatgagatatggcagcaaagaagaagagcaccttcatgggaaaagtccaaagaagacttccataaagagatgatacctgagcagatgctttaaaaatgagtagtaattacccatgggaaggggaagagagagaacaagggcaatccaggcagaggggtggtatgagcaaagtcattgagccaaacaaggaaatcttcatttctgcaggtaaatgagaggctgggagtgtgtcatatccatgagctttagcagagagcccatgaggggttttcagcaggggagtgctattgtggtgtgtctaggcacattctggattttagggtgatggggctgcatagaagcagagagattggttagaaggttgttgcaggcatttaggagagagcctatactagggctgaagagaagcagctatgaaaagagatttgtggggcaaattggcttggtggctaataagacacttagttgacctggtgactaataagatacatgtacgtgatgatagtaagcgagggtcaagccagaggtgaagacaacatctaggtttccctcctaagtagaatggattaacggtggtaccagcatctgagctagagaatagggaggagcagctctatggagaaagatgagtttggtcctgtatatgttgtgtatgtggaccatccgggtggagacattcaaaatacaattgtacataaaggctggagttcaggagagatgctgaagatatagtttggatagatttaagcatgttcggtaggaattaaagcatgaggctggacatgagtagccaagaattaaatgttaatcaataagaacaataaaacaaataaacctttagtggtagagtaggagaagaggtgcccatatggagaacatggcgtcatggtctcttcatcatggaggaagagtgatcaaatatgtttttaaaaacgaagaagtcaaacagatccacaccaaagagggtccgctggacgtggcagtcatggacttgactaggagcagacgcagcagggcatgagggcagagggactgaggctgaggcatggacttgactaaaagcagatgcagcagggcggtgagggcagagggactgaggctgaggcatggacttgactaggagcagacgcagcagggcggtgagtgcagagggactgaggctgaggaggggtcaggatgtgaggatgttgaggcagtaagagatgactggccttggggaagtctggaagagggattcagcagcaactagaacaggatgcagggtcaagagaagttcacttatttttagtatggaaagagataattcttgtttattgactagcaggaaggaggcatcttggagagaggtgaagacacaggggagaggggatagttaatggggtatcctcccagatcagtctgcacaagctcaggtgcaggggtggaggcgctggccttcaacagacagtctgagtcagaggctggaggtcagaaggtgtggctggatgggactttttctcttcctagaaaaaagggacatttttagggggaaaaggagggggtttaagctattgagaaaagtactgctttgaaatgaaataatctcactttcctgtaatcaaaactctttatttctgatgaaacagactcaaataagaatcacaacaaagaaatcagtgctcagctcaagcctggaaatgatttcctacacggaaatccacttgcacagattctgatagtgtgagtcatgtgattccagatggagtaaatacacatgaaaaggagagaaaagctggtgtctccatgggctgaagcacacttatggagagagaaattttcatttatttgtatttgggcttcaatatgattacatcaccatcaataatgaaaagtgctgccatgtcccagctgtatacttagatcaagatataaatcagtccaatattgttcttttttctcactgaatatctaaatttgtatatttgaggggaaagtagaaaaaccaagccaagattttaaaaattacatttactatcaccatctccaagttacattcactatagaatcctttagaagcatgttcttgggtagctttgctttttatgcactcaacaaatatttattgagcatctgtatgtacagggaagaatgtgaggtacagtaacacaaaatatatagtcctatctcttaataagcctgcacttgggagaaggtatagatagggttgggaaggataaatatatttttaacactctaatacaaggcagagtgtaccaaaagttagaaatgctgtggagaatcagaatgaatgaacataccaggctgggttggggggctgggggaattatggaaaacattcctaaagagatgtaatttgatttgggcttttattatgatatctgttttcagacaatggagttgagagtggggagtccttcctggctttgtcaggagcagtttgaggtcttggctgaagacaggaaggcataaggctggaaaggggtgggagcagaacatggagggtgtgaacttccagccgaagaagtttgatggggtttgggaaggaggtgagagggagccaccaggaaaggatgtgagctggacctttggaattcttaaagggacccttgtcttctctgccatatttctgtctcagggatgacgtgaggaaaaaaaaaaaagaggaggaaatgggcttgagtttccactgacaccttacagtcaaggaaggccctgttctttcataaggaaaagtggaaatcctctgtttacttaagggccattaacatgttttcatattaaaataccaaatgatctgccgtgactccagatagactcatctaaataaaaggaagctgtttccttacaaattgagtcacaaaggataaatatttgtggagtgccatagaaacaaatgcgctgtcttcctgaaatgtggaaaatgaattttgtagcattgatttgcatgaaaacaatattcttcccagtgttctacctagaatattgaaatggaggtattaagatagatgatagataggacagatagattgctagagagctagattagatagatagatagatagacagacagacagacagataagatagatagatcgatgaggttaaatattcttaggatggaagaaggggtcagataatcacatctcagacagatctggaattccaggcagcaggaactaatgaagtggtctcttcagagttttaccatgggacgaattcacccccgattagtttttattctttgagtcacttctctcaagacaaagatctttgggcaagagttcagttggcctagcttagatatgtttctactccttggccagggatgtgagccttctgaccaatagtttcaccaaatctacaaggaaccctagagagacttttttcccagtggaggagctggatgttgttcctaaaagaaaagggcagagggaccctgggcaggcaaaattttcagctgcctgccaccttagcccctgtccccacactcacttctgaaccacatgtgatcagtcttctcttcccaccacataactgaaacttcaaggtcatgggtgagctctatgttgttaagtcttatttataggagcgatcagctcgctgcactgcaaggctggaaaggtgtttaaaatgtatacttaggcatgtcttggctctttctgatataattcagctggcaaaggctctggcaggaagccagacggacacaaatagcgcaccaaagagatgctaagacatgggtgattataattgtgcaaggagtagaaacttctctgctgagactttggatgtggcagagatttggggagtagaaggggggcaaagcacagttccagccaaccccatttacaggcgttgattagcagtaatgaattcacaaccttgcaattgctcatttttttttcttctgctgctgagtcatggataagactctaagctctgattagctgtgatccctaattctcagcacaattctaagagcattccttcaaattcaacaatatgtggtaagtgtcttgtattaattaggattccatgtggatgcaaggaacagagacccacaataacagtggcttaaacaagatgcttatttctttttttttttttttttttgagacggagtctggctctgttgcccaggctggagtgcagtggcgcaatctcggctcactgcaagctccgcctcctgggttcatgccattctcctgcctcagcctcccgagttgctgggactacaggcgcccgccactacgcccagctaattttttgtatttttagtagagatggggtttcaccatgttagccaggatggtcttgatctcctgacctcgtgatccacccacctcggcctcccaaaatgctgggattacaggcgtgaaccaccgcgcccggccaagatgcttatttctcccttcaataaaaatccacaggtctgcagttatgtaaacatccacaggcatgcagttaagagctgtttggtggctgtgccctgtgaattccttagggacccagacctgttccactttaaccctaaagactgatccttgtcaacagtgaccaagatggcagtttgtgcctcagctgcatacatgtgcatttcaggcaaaggatgaagaaagaactggagaagaaagggctaaagaagattctaggagctgacatatagcactttcacttacatgcctttggccagagcatgtggctacaaaggatgctgagagatgtggcctttactctgtgtggccatatgcccagctcagccacaggaatgacattgctttgagagaaggggaggatggaaattgagcaacttagcagtcccctttccacttttacttgtgctgaattcataaacatgtgggcagctttcctctcctctgagcagcaaacacttcttctgaggttcttgttttggcaggttggccagacaggcaccccacttgactgctcaactatgaaactgcagttccagagaagagaacaggtctgaattaagcaccttaagccagttggtcagcatctccttttattcggagagtagttactgagattcaaacccatgtcaactgagtagcaatgtgtttggctatagggtagggcgtaaccctagtctatgtctctcaatagtgagttatttcataaaggctcagcccatcgtcaggaatatgctggtcttgcgtaagcctttttcagaagtgttcatagggtcctgagaattttgtgagcacttctttactgcttctcttgcctcctcttttagttggtgctgagttcactgcatgaagggtcccaggagtcctctttccccttggtttttctactcctttccttttctgctctttctaccacctcctactgctggacctctttgtatctgtactccaccatggaaaataagttttgtttgccccagatcttcccatttcccagagtggagcctttataattcatgatgtttactaaacttgatctctgccctttcaagggatggaactcagataatgaaagatatagggagggatacattgcttaaatctgtgagtgggcattacgatgggcctaagtgtcccaagagggattggcttgccatgggaggtggtgagctccccatgtgtggagaagttcaagaaggtgtgaaataatcgttgggtggaggacagttcaaggacttcatgtttctggagagcaattaagttcaatggcttctactcccagtctgacctgtgcttctgtgagcttgaaaaatatatattgtgttgcaatgtgcattctttagggaatgaaggtaaaagggcaagtggtcatgggaggatgtcaaggataggggcaaagggtactggttccccagccagaccaccagggtccaaattctggctgcacatcatctctgcaaccctggacaagtcagtgctctttctgtgtatccatccatctgtgtcatgggagttgcagatttttttacttcatgggatattgtgaagattaagtattataatgtacgtaaaacactcataacagttccaagcacacagtaagcactcaataatcctaatccttatgattattattgttacatatattactgtatctagcaaaaacaatattagaattgttagtattataataattattatcatcattgatggggaaggaaaaatgaagcccacctgagttcacagacaagaccctctccaaacagtaaaacaattaaaaaccaagttgtatttgtctgtgctcctttggattcaactgaccaacacccaggcaaagggaaaatatattggcttgctttttttttttgagatggaatcttgcactgtcgcccaggctagagtgaaatggcatgatctcggctcactgcaacctctgcctcccaggttcaagcgattctcctgcctcagcctcccatgtagctgggattataggcacctgccaccatgcccagctaatttttgtatttttagtagagacggagtttcaccacattggacaggctggtctgaaactcctgacctcaagtgatccacccaccttggcctcccaatgtattggcttttgtaagtaagaagggcaaaggagtagctgaggatctgggaagcaggaactggagattgaatggcacgggtccccagcagccagcatgctctgtcttcccttctctttgtttgggccttgcaggaaggtaggctctcagcagagccttgaaggccaggtatttgagagccaggcaagtgaagcagaaggagagcatgagtgagccattgggagtggggacggaaacggcgagaacctatccaaggcaccgtgctgagctatgaagctggagggcagcgcaggctgtgacccaaaaaggccacacaaggccacatgctcctgagtgacaggagggacatgtgatatgctgggccttggcccatgctgtctcctctgcctggctcattttctcctcttttctacctggtgaatgcatccttcaaggcccagttaattcatcatctactttgtcgagtttttctcaccacctgtatcagttgagaattgcattcagctatgatcacaacagaggcttaagcccataacaagcaatctggagccaggcattccagaagtggtgtactctttccatcgtgccctctgggacccaggcaatgtctctctttctgcacactcagacatactattgcccctgtggacataggattactgctctgcctatagcatcatatcccttgcagtaggtagaataatggacccccagagatgtccacaggctaagcctcagaacctgtgaatatggtaggttccatggcaaagaggaattaaaattacagatggaattagagtttccaaacagctgactttaaaatagggagatcagtatcctggattatctgggtacactttgtataaccacaagatccttaaatgtggaagagggaggcagaaatcagaaggaggggtggctgcagggaaggtcagagagatgcaacagtgctggttttgaagatggaggaagggacccacaaggcacggaacgtgggtgacctcagggagctgaaaagggcaaggaaatggattctcccctagagcctgcagaagggaacacaacgctgccagcaccttgattctagcctggcaaaccccgtgtcagacttctgacatacagaaatataagataataaatgtagattgttgtaagccactaagtttgttgtagttgttatagcaggaattggaaacgaatgcgtctctttagcaccaggtccctgtacctggcaggaaggaaggaaaggcaaatgtcacttaagccaacgctcctttccttttttttttttttttttttttgagacagggtctcactctgtcacccagactggagtacagtgttgtgatcatcactcactgcagtcttgaactcctgggctcaagtgatcttcccaccttagcctccagagtagctagaactaagggtatatgtcaccatgcccagctaactttttattatttgtagaggtgggggtcttgtcttgccacgttgctcaggctggtctcatcctcctgggctcaagcaatcctccagcctcagtctcccaaagtgctgggattacaggcatgagccaccgcacccagccctcctttcccttttagggagttgtgtggaagtcccttcggatcatttttacttacatctcattggccagagctgtcccatggccagctttatcttcagtggaagctaggatacataatttttttcaggtgggcatgttgccatccccaaccaaataaggattctgttagtttggaagagggggagaatagatattgagaagaccactcagcgtccccaccacacactcccaggcagaaccaactattctacagcatgttgttctttcctctattattgctatttttggtttgtattgtaatttatgtgttcacatggctgtttgcattacttgaccaagaagtctcatgagcagacactgtgtctgatttatttctccatccccagtgctcagcatagtgcctgatacagagaaggtgtttgcatgaagttagatggatgaatgtctaaataaactttgaaataagagcatgatcgatgcacttcccagagcgagagttcctttctgttttcttgtgaggatgatctattggggttaggtacattttataagaccatttggccatgattgcaacctcatctccagtaaattaaacctacacagctgcagtgtgtcacctttccttatggcttattacagtttgctttttgctcagaaggaactgagcaagcaggttagaggctgttatgtgcacctgccacagcctacggatcctcaattaaccttgcgtgtaaattacacttcctgcccattctttatttttagcacagcaacatctacttggctcttccagagaagactgcattagatttcagtcatgaaactacaaaacagtggcgtctgcagcctggctgggatgactgttgttaaccccatgacactctgttccttgcgaagctgctttgccccaggactcaggttttcctgagaaagagagcagcctggactgaccacaccctcagagcctggcccaaggccacatgtgaacttatagaaaaatctgctattggatctgacataaactctccatttccttcattcattgcatttgggttgaaactcagttgttgttatcacaaaggtttcatttcgttccttttttttctctccctctctcttcgttccttctcagttacacagtatcatgacccaaatctttagcacctgaaccatatagcgcagagccttgaaacccatagggccagggcaccccgtggagacaggccagccagtgggcatcaggtcgcagagaattcttaaccacttaaggttgcttcactggaagaagtgagttactgagagacagccattttcggttttagtcagccatttttatcacgatcttgtttgttttagaatcccctgtagtgcctagctcggagtccaaccaaacaagctccataaatgttgattttgaatttaaatagatgttggggtgctcccatttccccttcactagacacatgggaagctgaggccctggcccctctttcatgccacagcctgggagatgctgccttctcagcagaaagcctcaggaggtattttgaaaagggaatttgttgttttcattctggttagataagttacaaactaattttttaaactgggaaaatattgaaaattgttttttaaaaatgaaatcacctttaattccattactcagagacaactatcactgacatttttctgttttttcagtcttaattctcatgaaggtgtgccctgtttccctccagatttctcagaggattcaggattagggaagggaggagagggtgccttatgttctttctaatcgtttagctttgggtattattgggatatatataaatacattaacacacatataaatatatgtgtatatatattatataactggcatatacattattgggatatatattagtaggatgtatatatatatatgtgtgtatacatatgtgtgtgtgtgtgtgtgtgtgtgtgtgtgtatatatgtaaaatgtatacacacttctatttgacctgtaccagttcattattaccacaataatgctaactaacacgccctcaaattcagtggcttaaacccaaagtcatttattcttgcccacacttctgtgagtaggctgggtatttgctgatctaggctgggcttagctgagtggctctaatttcaggtgcttctgaactatatagctgagagccctgaaacccatagggccagggcacactgtgcctatctatgggtttgcctcaggtctattccatgtgtgttctttctgtggtccaggctgaaggggcagcagctgcccagataagttattgtcttggcattggaaggggtgcaagaggacaagctcaactgggcaagcacttttcaagcctctgcttgtgtcttatctgctcacatcctattggctaaagcaggtcacatggctgcggccagtgccaagggactgggaagtgtaacccatctaccataagcctagagcaaatcacatggtcaagattgacatcagtggcttggggaagcatgtactcttcccatggaagtaagggaggaaggaagggaatatttttgagaataatgtaatcttttttttttttttttgagatggagtcacactctgttgcccaggctgaagtgcagtggtgcaatctgggctcgctgcagccttgcagcctctgtctcctgggttcaagcggttctcctgcctcagcctctagagtagttgggattacaggtgtgcaccaccatgcccagctaatttttgtatttttagtagagacgggctttcaccatgttgatcaggccagtcccaaactcctaacctcaggtatacgcctgcctcggcctcccaaagtgctgagattacaggcatgagtcatcgcaaccggcccaagaataatataatctactgcacaccctaaatatctgctaaagtactctgtactttgagatttaaatcaaatctgctcaggccaggtgtggtggctcatgcctgtaatcacacctcaaataaataaataaataaataaataaaacctgctcagagcccacctggttggtagtatcatccagtctacacagggaacctctagtccagagctcctctactcattgaattaattcagtttctggataatgtgactgtctcgtgtgttgttcctatttcacactcatgtctctttacttactccccccaaaataatttacacagatgtgtgtagaagattttgctgaacatctggaccagcaaagaagttttacatctttatgttcgtatctctagattggccagccccctctccataaattctctttgcgtctcgcccacacacagcctctcaagttaaagcttgctgaagaattcactcttgtctccaaaattctgaaagtcttatcttggctgggccacacctttgcgcaacttagctcagctttttaaattcattcaatgtaggtgtattgagcatttgtgccctctgtctgaggaatttataatctagtaggggaaattaataatgtatgttactatttggggccagaaaattctttgctgtagggtgccatccggtgcactgtgggatgtttaccagcatccctggcctctacccactatgtgccagtaacaccagtcccacccccttgagctttggacaaccaaaatatctctagacattgctgaatatcccctgagggacaagatcacctcagttgagagccactgctctaatatatggtagacttgataagacttctgataaaacaaaataatgtgctaagaaatgttcagagggaagcgatgttatttcctggcagtgaaatctgtgaacacctcatgacaggtggcatctgagctgagacttcaagaatggttgggagtttgagttgagtttcctagaggaggaaaagacatggggtacatgtgggcaaataagagtggctctatttgactaatgcatgaagtgaaataggcatgttgttagagtggagctgataggtactgggaggctagataccatggggacttataagctgtaggacttctacttttaccctgagtgaaatgacaaatatttcagagctgtgttcatttggaggaggttaatttggatatagggcttgccttcataacccaaagtaattgctgcaaagattatccctccagaggtcacttttctgacacccaggaaggaaacagaaaggccatctgaggggcacagtatgtcgctaaataaattcatgcctggatcttggtgttccttacctttcagaaaaccccactctgaactccttattttaggtctaagtctaatggccagttcccgagagcagattaaaagatggaaaaagagggccaggcacggtggctcacgcctgtagtctcagcactttgggagcctgaggcaggaggattgcttaagcccaggagttcaagacccacgcaggcaacatagtaagacctcacctctacaaaaaaaaattaaaaattagctgggcatggtggtgtgtgcctttagtcccagctccttgggaagctgaggtgggaggattgcttgagcccaagaggtagaggctgcagtgagctatgatcgtaccactacactccagcctgggtgacagagtgagactctatctcaaaaaaaaaaaaaaaaaaaaaaaaaaaaaaaaaaaagatggaaaaggaggaaggcaagggaggggacttatataggcagacacagactcagcagcaaagcttccagcacaacagaggggaaagagaccaaaagaaaaaatgaatgaatgagtgattgaatgaatgaaccaatgaataaattcagatcaaataattcaagaggcacagcaatctagagttttagcaagagaacatttatcccttcattcttcctgaagacattgctgcatatcagtgccatcctactctgccaatatatgtaatgtttaacaaggtgggggatgtggagaacactttagatcccatgtggtaagagttgctcaatggttaggaacagggtctagagtcagagcacctggcttgaatccttgcttcaaggctctgtggcactaaagcctgctttactaggttacttcaccttgccaagccctactgatctcatcggtaaaatggggattccctactcacagggtcattgggaagtttggataaaataatccacatgaattcttagctcagttcctggcacagaataagtgctcagtaaatactggtggtaattattatcatttcactgaaagaatatggctgttgagactttccccaaatcatagctgcagctgctattctggaatatttccagagtctcctggcagtgctgaaatttcccttttataaaatacataggatggctgtgaaaattgaggaaagttccaaaaggcaggggcagttgcatctgtcttcttcatttcccttctttttggcagtagaatccagaccacagagggagaggacaccaggctcccaagggtactggccaccagctatttcttggcaacatacttcctttgagcaagaatggccctttactttttgaccaacctgagagagcacttactctgagccggtcaggagaatatgaagctattttccttctgatgttatgtcctatgctatgtaaatataatctccctccaaataagaaaggtgcacatgcatggtgttggcagggaaacatcgaaacatattgcatagtggtggctgtgaaccagtggaggcagtgctgtgttgatttcccttgaccaatgtctgcccagtggcagagctggaaacacaagatgctgtgtaatgtaaaaccttggcctggctcctcagcgtaatgtaaaacaaaggctgccaggaaggtacaaatcgcccaacaggaaggagctgctctcttgcccgtggatggcaggacaataaagtaacttgtcctttgtttgtgtgttttccaggctggagcaagaaatacaaacgctagaaagtgaagagtcccagatatctgccaaagagcaaatcatcctagagaaactgaaggaaacagaaaaatccttcaaggactttcagaaggtgaagaaaaccaaaacgatttctcaaagttatttccatggggaagtagggcctagcaaaatggtgctaactgggaaacaggccagtgggcattgatgagaaatctgagccacgaactctatgaaatgaggggcagatgtgtgaggaccaggggccatcctgaagctaagcatgacatatctttgggtgtgggaccatctggcctgctgcaaggcatagggaagagtcattagattaccccatctgcctgctctccggatccctgatatgccttgtgcctgaaaagccttctcttattggactctagaattctaaaaccaattctgatgaagcagaataaacatgctctttgtggctttaattatagtttgctttttgagtctttcattataaaaaggccagaagcaacaccttatgaagtggacaagaattccaaatacaaagagtgtaaatacatgacattttactgtatatagaaacagatggtgcctgtaatcccagcactttgggaggccggggcgggtggatcacgaggtcaggagatcgagaccatcctggctaacgtggtgaaaccctgtctgtactaaaaaatacaaaaaaattagccaggtgcggtggcaggcgcctgtaatcccagctactgaggaggctgaggcagaagaatggcataaacctgggaggcggagcttgcagtgagctgagattacgccactgcactccagcctgggcgacacagcaagactgcgtctcaaaaaaacaaaaacaaaaaacaaagacaaacaaacaaaaaaacaggtggtgccgtgtatcaaagagtagagtccgtaaaaccagtaggctctgaacaaacatctcaggacctccctccattttataactgtttctgctgtacctatgagtgacagaaaagcaatctaatgaaatcaatttaggatgggattttctgatatcattctccagcatgaccaaggatatttgctagatcattgaaataaatctctattgggagaaatttagtataaattgggaattataattttggaattctaaataaattgtccagaagaaaagagatcgttgcgtttccccagcacagtcaaattctgggctggggcatgggagaaagatgggttaagtctttaaagatgggaaaagatgggattgtacccccacatgtagagtaacgctctgccttgtttttgttcctacagggtttctccagtacggatggaggtaagtgctctctgccccgactgtagatgaatgttttaatcctggtcagcttagggggtttcattaacaggggcttaaggaagaggtactgtgttgatttgtaaaggcatcagaagaagtagcagcgctggttgcaggccactgaggaggtccacattccaagccttccctgcctctcttcttcaggaactatctcttggctcactgtttctcctcttacaaaattggcctggctcttctccttcccattagtcccaacactcactgcttgggcctctcttgaaaggtacccagcaaagaagagtactaacatcaggacctggtcccttgtagggatgagcccatttgtcttggtggttaggtcctcaggttgaaacatacgtgagaagtttaagaaatttggggaaaatatttggtgtttgggaaacctttctacagcctctggattttctttgctttctctctctctctctctgatcagacaactgtcgtttctttcatagaaacagggctgggcaaaaacttccctccctgtgtgggatagttggttcagagcataggaaggtaggagtggggtcctggcttcctggtggcaagagcaggtctttcaccttctctaccttccctacctttcctctgtcctctcctctccttacctggactgtggggatgaacttgagattgtgtacttctcacccttcaccttgctccctatcctcagctgcaaacccatgattcctactttcatttggccctcagctagacctgctttacaatgcagggacttgttggaaagaccagatattgtctgctcccctggctcttagaaagtcacattctagggctgggtgtggtggctcaggtctgtactgccagcactttggaagactgatgtgggaggatcccttgagcccagaagttcaaggctgcagtgagctatggtcacaccagtgcactccagtctgggtgatagcaaggtcttgtattaaaaacaaacaaaaaaggtcaacctctagactaggaagatgatcaggagccaggataagaattggcatcagtgttttcccagcgtcatttggaaatatacggggaaaggtttaaaaatgtgtttctctggattagtcaaaggtatttgcatgaaggatagttctgactttggcaaaacaaacaaacaaacaaacaaacctgtgatttttaatttttttttcccctagcaagagacctggattttgtctccccaggtgatctttaggaaggtactaaattaaacttcatgctctgagtacatgtaggcagggccaagtcatgtccaagctagcaaggactctaggaaaagcggacctacaatacttctaggaagtctctatggtgtgaccaagtcagggcacttgttctgtgctttgggggtggggcacggattgaggaagtggccttggggaattgtgggtacagcatggggaggatggcaggcttccctgagtctgggaagacctgaggcatgccacacaattagcaataatacagtgcatgtcaggctgggatgaagtgtgggacactgacccatgaacacctacccaaagagtgcatgtcggccttttatgctttcactttttttttcccttcccttctcaaatcaggaatttccctagacatctctctgatacttagggaagggaaagaccctgtatgtcatgttcctgaggagtctgtgtggggcatggagacctgtcatactctgtgacttgttaacaagcaaaaatgcagccgcatcataaactctcaccacctctttcatttttacctcaaacttctttcattttcttctgcattgcttcccattgttttcacttatccacctaagccatttgtagaggtggtaagaagcctagtcataactgaaaagagcctgcagggaaagttgcccacagactccatcctccaggatgggggagctcaggcttaagaggatgcaaaagtcttagggatctcatttcttgggaagtggcccagggaagagtttccgtggtcttacctgtcaccctgcattataattcctgccatctgtggttatcaccaagcctgggtgacctctttatctgtcataccacatctattagcaaagaaagaagtttgaaggcgggaacacatacatcccagaatgtgattgatgtatatagagtcacaatgtggtgaagcacatcccagttgagggactttgggatgtctctttatcttctcattcttcaatttcaaaggccccgagttgccaagaccctcttagaatcatccaacttgctacaaaaaactaaccagatattattatagaacaatggtgacttaagaaacacagttaatttctgatgcgtgcagattacagaatccaggtccagttaggattatgtaactatacagacactgcagataagcagcaaaagcatcccaactcgtgaggtgctatgagatagctgctggtgtctgtgtgtgtaatgaccccatctcaggtaacctaagtgtgtccctctatgcatggcagaggaaatagaggtaccgtactgctggatcaccagtggcttttgattgcatgatagcctgggcaatcaagaacaatttattctattcttgagtagaatctcctggtcatatacattctgacacccactctcctcccccgccaacacacactgttgttatatagcagaacgctcatctattgggtgggttggttttcactgtcttaggcataatgtcttgtacacctataaattgcatatagtatatatctggtgctaattctgttctttacccactgaggagggagctgatgcaaaactcttgccagaacaggcaaaggaaaatgtctgtcctgggcctatctcagtccttggtgtatgatatggatcttcttaggttcccatcccataccagtctgtggtggcttagagcgtttcccacatcaaaaccttcataccagttattcgcaaacctcaatcttcagttgcctgtaagttatgtgtttgtttgtttgtttatttattttgagatggagtttcactcttgtcgcccaggctggagtgcagtggtgccatcttggctcactgcaacctccacctcccaggttcaagccattctcctgcctcagccccccgaatagctgggattacaggtatcagccaccgcatccagcctaagttatgttttaagaagagttttcatcaatttgtttctctggctttagctgtttagattcttcatagctactgtaaatatttcagcgggattagaactaagaagcagcactcatctttaatttctactctataagttactgctttccaccttctctgtcagtggggagaatagtgttagactattctgactttggcaggaagagggcagcttattaattgaggccacctgaagaagtttttcccattgaagttttggcaagcctgtttgttactctttgtgctggcctatcagacacttcctgtctatataaccttagggtttagtacttaatcatatattgagggggctgctctgtcctctttctgatgccccattctccactcccttatctttctctcgctctcttttttttttttttgagtcagcatctcactctgtcacccgggctggagtgcagtggcgtggtctcagctcactgcaacgtccgcctccagggttcaagcgattctcctgtctcagcctcccaagtggctgggactacagacacacaccaccagtccaaatttttgcattttagtagagacagggtttcaccatgttggccatgctggtctcaaactcctgacctcaagtgatctgcctgcctcagcctcccaaagtgttgggtttacaggtgtgagctactgcgcccagcccattcccttatctcttaacagaagccatgtagcccaaccctctaagtgctgtagacttcaagcttgtagccagtaaacatctggcaaaggtaactccatcatccattcccatctggcagggagctatctcctggaggaggctgagacataagccctgggaatcacatgttctttcagatggaaaattccctgtctgtaagtagtttttttttttttgtttcttttttaaactgctaaaacattgagtatgcagacacacatgtgaccagtccatgagatctcacatgggctccagcctccatcttatttgaatgcagaaagtcaaattcaccaagatcccattccacagatttctggaaattatcagtgaatcttggaagttctacaaatctgctctggtcatcccttctttcctaaactgaccctctagtcctagattactgcttcactcttcccacggacaattgtcacccacctgcccctaccccctcaggactactgacctcaaggtgctgctctttctagttctgccttgtgctgctttggggcacagacccttcctacagccttccacagtgggaattaaaggaaagagaagtctgtgacctaagtttaagaatcatggaggtggctcacgcctgtaatcccagcactttgggaggccgaggcgggcggatcatgaggtcaggagatcgagaccatcctggctaacacagtgaaaccccatctctactaaaaatacaaaaaattagccgggtgtggtggtgggcgcctgtagtcccagctactcgggaggctgaggcaggagaatggcgtgaacctgggaggcagagcttgcagtgagctgagattgcgccactgcactccagcctgggtgacagagtgagactccatttcaaaaaaaaaaaaaaaaaaaaaaaagagagagaatcatggaggtgcagttcaacatggagaataatgcacaacttcagacatgtggcttcactcacagcccctgactcaaatccaaaaccatcttcagggggtccctgcaggctgctttccagccatctcccagcccaccatcatctcaaaggctcaatttccttccttgcagtgaggggtgccttcaaccatgtctgccttatccaggatccaagctccaacacatataaggcacctgagagggaaagcaacttgagcctcactccaccctaagtcctgctgttctaatcttcctttctcattccttctccccaaatggttaatatggaaaaatctatttttttttttttgagacagagtctcactctgtcacccaggctggagtgcagtggcacaatcttggctcactgcaacctccgcctcctgggttcaagcgatcctcctgcctcagcccctctagtagctgggactacaggtgcatgccaccatgcccagctaatttttgtatttttagtagagacggggttttgccatgttggccaggctggtctcgagctcctgacctcaggtgatccacccgccttggtctcccaaagtgctgggattacaggcatgagccaccgcgcccggcgaaaaatctgttttcttagcgatactctacctttgcctatgaacataatggtctaatgtcaatacattctggattgttcagactcatttgcaagtcagaaaagggtctggttggtctagaactgaactaagcctagtccagtgtgtgtttgcaatcctcttcagcaagaaatgaaaaagaaagctgctagaatggaagcagtacgagtggggatgcagaggaggggtcagtgatgagaaatgcggaggattttgaacagaggcagaggctattgaacagattggataccagcagggggaagagtgaagggtgctgctgaggatcccaggtgaactgcagtgctcgtgagccaagatagaggacaggagaagcagcaggtgagcagagatacaaggtccattttgcacatgttgagtttgaggtgattgtgggatattcagtatagacctacagtgagcagttagatgtaaccattgatgactgatggacgttccaggattttgtgatatggtcgtgatgcaaggaagggatcacatctcatggtgcccagctttccggaatcttcctgctttcactttcccacttctttctggggtgtacccagatttgtcttgtcttacctcaggggtttcctcctttcctctgataccttggcatgcttgctaatgttcatgctccccatgtctcacctccctaaagaggcttgtcgaggtatttgcccaagcaaatctaatgggctccttcttttacatagcaacattccctgcaactgggctaatggtgggctcaaggggtattgtcatttagaatctcaggactttctagctgaaacaccagcctgcagtattgaaaacatgagatcaattctgaagtctgtttatttgttgtaatgcatataaaattggtcttttgaatgaatcaggctcataaagctatattgccagttcagggaatgaaccccataataatcagacacagaaagctttatttccggttcagagaatggatctgtttttcagtactgtttaatgtacatttctagttccatgttttctatttgtcaatcccaccaagttgataatggctcccacaagcccatctctgaatcttccccccgtccctgaactcattgtcctcctagaatctagagatttctgatgactcttctaatacatagagccatcctggggcttgagctctctggccaggatccctcctgcctcagctactctgctgaataccagtcactgggcaaatgcttgtctttgtttaccctgatcctcctgttcagtggccgcctcagcggtccattatgtagggcagacaagctgctgtctcggcagtgaacccattgggcctcccaacactgtgactaattgtattccctgttctctgctaccagatgcagtaaattacatttcctcccagcttcccgacctgccaatcctctgttcacgaacagcagaaccatcacctgggcaggacgggaccagcagagcggctggtaagtcctggggacctttggacgctaggatggtccaaggggcttgcatttcactgagctttattaatgagatgagtgccctgctatccttacatagggggagctcaccttcagcccagcctcagatgcagccttcacagtggccacacaaggcaggcaccggccccagatgggtaactgaggaccaaatgggaaggagttctgaggaaatcatacggcatttcacctccgacttcgggggagtctttctttggtgtttgtggtccttatatctgtgtttattctcaaagttaatctgtattctgcctccagggattttcattttcctcattggaaatatacaaattgagagagccatccatgatggaagctggatgggaaatattttcaaagcctgtggtatctttacagaatcctttgggaattgtgctatttgtatattatgaatacatatattcctaagtcttcccatttctggaattatttcttagccactgtggtatatttgggaggaaaagaagcaatttaaagcacacatgttacttgctaatgtgtctcacaattggaaattttacaaataatatatttatgagtgttgagtgtagggagaaccatgctttgctctgcttaatgcagacatgcctcagaaatcagaactggaaggatgcaagcaataaatctgtacacgaacccttatgatctacacagaaatgtgctgagggctgggggttaaatggaaaaatgaattgcccaaggttgcatggttagttacaacataggtgacttcaaatatgagtatcagattctgctttgcatattctaggtaagtgtatgtttaaaataaatcacataatggcagattttttaaagtaaaacaatcatggatgtttaagccagaggatatcttttatataggccaacctgaatatttcatgaagcaaagaatccctacttattttaatacaaaagtaaaataaaaggcaagtaagaattaacatagttgtcacgtccactggctaatttaaatatctgttgggcatctctgtaaacatcttagcagattacttttatgtacagactcacagagtcctagagatggttgggactgtaagtggtatctggtcaatccagagccagttccacatcttcctggacagtgacaggatggataaacaggaacctgcaacctgcagttatgcttcaaaggactcactggcagtcactttaacattggactctttaagtactccagggtacacttctgaggtacacttctgaggtcaacttaggtaaaatgtgtttaagagtgacaccccttccctctggttattagagacatgggtgttgatggctcctgatagttgtgggtaaacaacttctcaggtcctctgcacaagttcctgcacttcaaaggacacaggatatgatccaacatatggatcagcttatgggagggtagggacaatgtatgagaaataattttaagagacagaaaaagaatttgagcagtgtgggtagtcaaagagtttaaagttcaagagtaacacatgaatgtgattgtagtgctgtgtaagcagcaatacacattattaccacaacccagctccctttatctttgaagatcctgcaaaacatgattttaaaagccaatgcattttcaaaagtataatgtgatcagaatctttttcaaagtaattttacatatgtttctgctgattagttaagagttaatttgcgtaaatgcatctactgtgggattacatataagcagagctatggaaggaattgtatttgttacgatgaactcctttgtccaggctgtttagggaatgggatgttcagattcatgatcaattatggttaatggtgactacacagagcatgtgtggcttaccaaccaagggtactcactagaattctcctagatacagtccatcttgctttaggaatgtccttttggaaatttatataacctcagggacattttgacaaatgtcacttgtcattactgagtagtataacaaatatcctggttgtttggcgtttggaaggtttgggactctgtataaatgggaatttatttagaatcattgcttttcagaattaggagacatctattccaatcctttatccaaacattgaatccttaacatagcagccctgtgaagaggtcctcaaaccctggtcacacacctctgtgattcatgtttaatcttcctccaagtttcccattccatctctggttggttctgactattgggaaattcttcctctgatggagccatcatttgtctgccttcatcatccacccacttatccttatcctgcaccctggagctactcagagcacatctaagttctaatttcccttcaagtgtagaaagtcactgttatttcctgtttttcccagatcctcactctaaatcccctttgtgctcacagtcccagtctctccagctggtattgagatgatgagattgcctttagacaccctccgccatccctgtccctcccctctgcacgctcttcacttggttgctagtcttcttgatgtatcatgctcagagctacccaatgccttcagagctaggctgctcacccccaaaatagagcacgacgctgcagaccacatggctgactttgctggcaatgtggcctttcagcttcagttttgaaaggcctcaaagtcatttcatgtgtgccactgctcagcctcactccgtttatccatagaattgttgtttctgagtcatttcagttgaaatgttcagtctgtttcccctagctatacatatactacttcacctgttcatacatagaaggacctacagaattcttttgttttttaatctcgaaagacaaaaataagcatgagctatgcacttttctgtcctttgtagatttgctatgactattaaatttcttcttgttagattgtctctcaagaatgttgcgggtttcatggaggcactgaggaaccacagcaggaagtgggggaagggaatgatgtcatgggatttgacagggctctgacattccctcccatttcaaacacgcgcagttcctccatcctcatgtttacatattgtgtttccacatcagatttcacttgaatctaggcctcaacaagttttgaatgtagaaaaccctcttctctattgttagggtctttgtagctcatgattatggtatcctcatagcctcactttgcttctcagtttagtaccccctcaaatctgaaaaagcaatcttttattattttttatcatctcattgctaaaaatgttgcatgttggaaccaaagtcagagccctgtggcacaccattagagatctcttggccctcaataaccctaaattgacatctttggggtatgatcatgcaaccactaacaagttaattgtcttaacacccaaggcacatgtttctgtgtagtccacaggaatataagggattttgtgataatccaaatactctggatcttttcaaatgcaatttgcctattctttccagagaccttgaacagaaaagaaaatgagattaatctgcatagtttctgcttgattaacccatgctggctcttagtcatctctggtctttgaagattaactttagaatttagctagccatgatgtcaagctccttcgatgtagtttagaatcccctcattctcatttttgaaaatcagacctttgagtgtcagcttccagcacctttcctgatgttcaagattcttgagacaaattcaacaagggaactgggaccctgatcccaaagcactgagagcctttatatccctgcagtgctatgttattttccaatcttctctgctcatctgggcttcacttccctttctgccactttctttctggcactttacaggctgaaaactctccttcttgaccaaaaatagaagcaaaatcagacacaagaaattggcttgcctttattatccatcaacatcacacccttgctgacttatttttgttactactgaggtgtcttggaaaaacaattgattcacagaaatttttgatcactgttttttttggggggagttacaattttttattgatacataataattgtacatatttatggggtacatgtggtattttgatacattcacacaatgtataatgatcaaaaaagggtaatgaggatatccatcatctcaaacatttatcatttctttgtgttgggaacattcaaaaatcttctagctattttgaagtagacaataaattattgttggctttagtcaccctactctgtattgaacattagaacttattccttctatctaactatatttttgaagttggagattgtgctttcggatgagagggagaacccattctgaattaatttcctcatttttattgtcattggcatcacaatagccatttttacatttccagcccaaagataatatgtgaacacatatttatatgtataaccatttgctcgaagggataagactacccatatgtgtgttcattcaataagtcaaccatgtgcattgcttgtctatcacatgccaggtgcaatgccaactcctggatgtttctgttactgagatgaccctgaccccccatggatgacacttatgatctgcttctctcctactgtactttacgcatcactgactcgtgaaccacgcagggtgttcacagcaccataaaatatcaaatctggataactttcattgtacaaatgagaaaatgaagccccaaaatggggtgtgatctggataggaattcagatcctatctttctccctcctcccatctccctgactaatgacagcggaacatgtggtgcttatattttagatgtgggctctcagcctgttcctcctcccgtaatcacagtgagtgaaagaaagtgagctgggaaaagcctgaatcaatgattgaactttccatcctcctggaatagtcttgttttgtatgctcttggactgatgctcaaatgtattcatgtccattgctcttcccgccttgcttgtgtcggttactcttgttccctcttctctaggctccctacagcccttgcagttgctttcactctgccaaaggtgaaggcaacaggcaacacaggcatgtgtagagccagggggataagtctgaatcagaaccaaacattctctgctcctcagacccatctctctgggccctgcagagcaatcgcttctctgctcaaaactaccaccttggtttttaggtgggcaccttccccagaggcctcacactccgctccacacctgggtgttttcagaacctagagactggaattctcaacctcaacttaatgtctctactccttcagggcgtttccctattgatgaaagaattattagggagcaagaaccaagaaaaccaaatgcggaggcccaaaatcaaagtatccatgcagtcattcatctgtatccctttgaataagctagcaacattcgttcttactctctttaataaaaagagcatattaaaataaaataaaataaaataattcttaaaaacagcatattactcagctgtctcgctggcttcttggaaggagtagcaaatatgctttatatactccaatctcattgtcatcagtatatagggtttggaaatcaataattaaatacataatttaataaaaacatacttccagatttcagccagcctatcagtgaaacttccattgaattgtcttctatttcttttccttcttccccaggtccttcatccaggaaaatttccagagctttccttcaaatacttttctgtatgtccatgtatgtttcaagatttctttcagggctccccagaaagccctcacccctcaacagcactccctcctcattttttaaataagatgaacaaaggcagcaagccctttgaccctcatcattatacaaattgtagtgtacctctgacatggagaagctggagagaagacagggcaggttagagagtatgctctgtgctttgtggttagagacaaagggatgaaaagtgtgagaggccattggtataaacttttggcagcaacaggaagtagaagagtttttaaaatcttgtgcatcaaaaataagacattgcactgaaaacgtaagtcttatgttcctattggttcatatgcactctagttcatgcttttgtatattattggctgagaactgaagcaaaatataaatgcttactcataaagatgacatttaaacattcacacctcttgcatggctttctaaaaggcctagataacattctcatatatgtatccatgaaaacgaaatattgcctttgggttaagtcagagcttctcaaagtgttcgcctttgttctctttactggaggaaagagtgaatgcagaaaggaatgtagaatcacactcttaagtgtgatttgtggttcctctgaagccttatgttttatctaggaaaaaaatacatatgcattttgtgacataacatatctaagtttattttattataaaattatattaaaattcttaaaatattctatgctcatattctaggaatattggaagaatagtgtacaacatgtaaatataaataggtaaccctagtaaaaccatgtcacatgtggttcagtcccagagccatatcacatttaaagaactacagcttaaaattgcacaccaaaaaaccattaagaaggtgttctgttctttaactatttctcctgaaggatattaaaagggaccttggccgggtgcggtagctcacgcctgtaatctcagcactttgggaggctgaggagggtggatcgcttgaggtcaggagtttgagactagcctggtaaacatggtgaaaccccatctctactgaaaatacaaaaattagccaggcttggtagcatatgcctgtaaccccagctacttgggaggctgaggcaggagaatcgcttgaacccgggaggcagaggttgcagtgagacaaagtcgcaccgctgcacttcggcctgggtgacagagtaagactctgtctcaaaataataataataataaaaaataaataaaagggacctaatttatatctccactaagtaataattctcatattcacttttctttcctccacatatcacctgctctaaagcatcatttaccaccacaaaatactccttctctatgcatatttcatacagtttttactctctttcccactaaactccttctttctcatttgtgtattatgtggatatacttaacctttccagcaaagaacttttcatcatcatctctcctttcttccaggctctgattctagaacaggcaaagattaaaatgacagaaaattggaccaacaatgatcagcattctcattggtgggaagagggagagggatatctgtaaacatccccatgttaataatttgtatttttatcctatcacatatggatataaaaatagaaatattttgttccatattctgtattgatcgcaggccagtgtgtggatttgttcacagataactgaatgtttgcagaataataagatattgtacctacaaactaacaattattactttccttatttataactgtgtcccatgagtgtgttaatagtgataagatatattctaatcccaaactgctttttaaaataagtgttatatttcaagaacaggcttttggagtccatgcaaattttaaatgcctattctattcttctgatggcacattttgtgagaaatcaggaactaactgagataaatgtttatttggatacacagtcattgtgtgtgtccatgcacctctatgacaaatgctggttggcctcccattgtgtcacttgaagaaacttgagatctttatgctgaacaagtgaaactttcaaaatggatctgatgaaaaccaaacatgggattttgtttcataatctttttagttaagtgttaaccaggaacagagtgtatcttattatgcaagcagatggaacaatatcatcactgttattttttcaaacaagttcaaacattaattactgtgtgtaccatttcattggtgtcatattatacaaagtatttgttactagattacaacaaccatattagactcttgaattattagcctttgtttgagagatgtgtatattgggtacctgctatacaaatggctctaaggtaggtgctgacagggagggggcatcatggataggtgttgggcaagaaactaaccctcaaaagatcctaaaaatctatgaagctgatgaaacattcccacagataattatacaactgagtggtaattgttaagagccttcagagaagtttagaaaaagtattgagaaaattttaagagagggatgacttagagatggaaggatcaaagaaagcttatggaagaggaggcagttgaccttggcgttaatcaatgggccatatttggatatgtagaaactcaaaacaaagacatttcaggagaagggaatcttaacaaaagcagaagatatttacgtctgggatggtgttatttggttgtgctaaatggaaaaggagcactagaacatatggttgaaaagatagtttggatcttcttaacacagggaacttattcagaaagaggtagggactcaagacaatgacaagcagatgggctagatctctagaagtttggaggagcaacagaaggctatctaggcagagggacagcaggcacacagatgagcagccgtgggaggaagttgagtgtcctgggaatagtgagaagtcgttatggccacaatgtgtaaagaatgagagagcccacaagacaaggctagaaaggaagtttgcagacacatcctgaagggaactatatgccatgctggggagtttggtgtttattttctaaagacacaaggaaccaacagagggtttatgactcaagtaactgtgggcaggatggagcacaggctggcaggggtcggcaaaatttttgtataaatggccagattttaactattttagactttgtggaccatatagtctttgtcacacattaattgttttctttctcttttctctttccttcccccatcttttcctccctctctttcttcttctccttcctcttcttttttcttccttctccttccccttctcttcttcttcttcttcctcttcttttttttttttttttttttttttaaagaaacaaccctttacaagtgtaaaaccactcttagctcctctggccatacagaaacaggctcaggctgtctttggccctctggccacagtttgcagtcttctagactagagcaagaagacagaagtgttaggtaaaataaaaagcaaggctgttgtgcagagagcagaggagggcctggactaaggccttggtgacagaaatggtggtgaggagatggatgagatatatctgaagtagaatgatttactgtcagtgagtgtttggctgtaagaaagtaggaagaaaagaacaagtcaggtgtgattctcaggcctgtggcttgagagactaggtagcagtgctgctgttatttggcatggagactgtggaatagttttgatagaagaagctggagtcagtttggaagctgctgagtttgatgggttcgtggcacatccagataaagggcacctggagcctggtggctctatgggcctgatgcacagtttcttcccatccaggaagactgtgaagaaaccagtttggaagtatgaggtgtcacaagagtctataggacaggaaagagctgtccttagcaaccccagactggcagcaagagttgggatgaattagaaaggatacaagactgagagacaggggcaaggggagggggagaccaggtaggaagctcttccaacaatctagggaagaggaagtgaatgtcttacattgaccagtagcaatggaacaaaaagaagacaacagatgggaaaggtattaatggaacaaaaagaagacaacagatgggaaaggtattgtgggcagcaggacttggcactctgtgcatggaagatgaaagaggccttctgcgatcattgtcttcaaattccagtgtcctatgtgatgttacttctgtcttgttcttttcttagttcttattttaggtacctagtttagtgactgaagtactcacagggcacataatatgaatgctcccatgctttttcaattgttgaaaatattctgttgtatagtacagtggaggatagccatgacccacctatgaaaacctttgtggaaatgtagagaaaacgaaaacacttgatgaaagaggttttttcatttatttaaaattttggacctggaacacattttaaccaagggtttgtaaattgtctgtcagcctgggaagccctcagtcaaggtagtttgcatgttgccagcctccatgaaattcttcacactaagatctaaagtctcttgtgcccttattttagcagatcttccttaaatgtgtgagtgccattgagatatagcaaccgtgcatctgtcttccaagtgcattaaactgctgtgttacaatacagatataaccatctttattcacagtgcgcacctcactctaacactcaagatgcttggcagttagaatagaaagggcacaaaacctttttttttgtctgtttggcaattaaccattcactggctttttttgttgtaacatgcacttcctttctcttgttttcattcaagctgtgtacgccatggaaattaatgtggagaaagacaaacaaacaggagagaccaagattctctctacatctaccattggcccagagggggtccatcagaaaggagtcaaagtctatgatgatggtaccaaagtagtgtatgaggtgcgctcaggaggcaccgtagtagaaaatggagtgcacaaattaagcacaaaggatgtagaagagcttattcagaaggctggacaatcaagcttaggaggagggcacgtgtctgaaaggactgtgattgcagatgggagcctcagccatcccaaggaacacatgctctgcaaagaagctaagttagaaatggtacataagtctaggaaagaccattcttccgggaacccagggcagcaggcccaagcccccagcgctgcagggccggaggcaaacttggatcagcccgtcaccatgatttttatgggctaccaaaatatcgaggatgaagaggagacgaaaaaggtgctaggctatgatgaaaccatcaaggctgaattggtcctcattgatgaagatgatgagaagtcattgagggagaagacagtgacggacgtgtccactattgacgggaacgcggctgagcttgtgtccgggaggccggtctcagacaccacagagccctcatccccagaagggaaggaagagagcctagctacagagccagccccaggtacccaaaagaaaaagcgctgtcaatgctgtgttgtcatgtgaccacttctttcttctcctttcttctgggcagcctgtactctccaccactcacgtagacctcactgtaccactaactgcaatactgtgaactggaagcaaacacctgccttgccttgcagttgaattgctttgatctctctcattttttttccttttcctcacctgagagacaacgtgcatgtgtgtgcttcattctctccaagaacttgcttttcctctaaacctttccttgtgtcttcaagagtgaatcacttccttcctgctcgattggaatggactcttcgtatcagccagtgatatggtagccttaactcacttgactggaattgaacccattggcactgggggtttcattttgtagtgtgttcctgtaacgtagtcacacactgccatgtctctggtttctcacttgcctcctttgctgtggatctttgtttttatatcttgtgtggcaaaatgctgttggctctagccggttgctagtgtagccaaaagtggaccttacttagtctgtccgatctagggtgatgctttttgctgccttacataagcttccagattacagtattgtgcattcatggctttctttctgttaaaactgaaatgaagtcaatgtagaagaacccagagcttgtcacagctgaaatgtagggactgattccataacctgcccatcagcggttgtctctctttctatggtttaaccgatgaaccctttatataagaagcaccattttaaaatttctaaggacatgaaacaaacattgtttgaagcatcagtagcaattgatctccaaacttaggcaaattcacaagccttgtttctattctcttaaaaaaatgtaaatttttatattgtttcttttttctggatattttctggtcatgttaatctattttcaatgaggagatcatcttgagaagtatctttgcagtgaccatatttctaaaacagtctgtccaacctacaatggttgccatgatgctcccacttcatcatggatggtgctgtaatgcattaactgttcatctcctccccagttgattacaaagccttgcatccatactcttttctttctggccccatgagaaagagaatgttttaggtaacttcaacttgtaggtttatctgcccttcaaaaaaaaaaactttaaaaaacttttaaaaattaagaaagacctatcttctcaatgttaagcacttaatttcataacaaatattaagtggcacatagctgagcttcttagggcattgttttgtttttagcttctggagattccagaagagcaaagaatattttttatctagaacacaatgaacagtttttgaaataccttctcagcactcccccaaagcaaaaagccacatatgtagtaaaaccaaagggaaacaatttaataaaataacaatagtatagtaatgaaataaagatataacatgattactggttttaataagagttatcttaactttaagttatttgcccatttatagcattgttatgaattattcataaaattatgtcccacagtatatagttttgaaaaaacatatgatatactacatccagtctaacttctgtggaaagtagatcagaaaaaataagatagtcttgagagaattttattatagaagctgtctaatttgacctattttgcttgctcagtgctaaatctattgcttttttttaatctcctggcttgaaattatatttacttcaataggaaaggtaaaaacatcagtttttacttttcaaagttaattttctgaaataattgcattttaatgagcacaaaatgggtcattttatttttattatactcatcttgtttacacctatacataaacagaaaacgttaaagaagagaaaaataaaggagctaagttctgctgttgaagattatttcatccaaggcttggttttgaataactgagggaaatatctctaaatctcaagttcatcaaagcagctgcaatggaataaaattgctattttatcgagaaacctggtttggatgcttataaattccactactctcagcttcattttcctgagtacgtggtcactgaagcatcatttagacattacataaactggcatgcagataaacctatttacatagagggagaaaacagtttcaatgtcttggacaatctgttattttaatgatttacttaagaaagaaacaatctgaaagcttaccatagcttatcttttctactcacttggagattcaagctattcaatgtgagttttaaaaagttaagcacagttagtgagtgaaatggtagaatgtagaacctttaagcttgctggttgataaacagaatcaatcttccaggacagataattccctgaagggacctatccttgcataagtgaactagttactcatacagaaaatgatctgcacatcttactacaacactacacacaagaactaaaagattaatgattatctgtattctcttcactaattactattatgggggaataatgattagcaaattatatgaattcgagttctctctatacttttattagtaaagcttatcatttaatggactgaagtaagatgtgttacctttattcgagctatttgtagccacactaaatgaaggtgtgtttgaatatggcgcatatatttgcatatgtcccatcattttcttgtcataatggggaattcaggcttagccagtacttctatgggatgagacctataatcccacctatagcagcaagtaactacccttcatgatgatagtgtacatggagctgtgattatgaacatgctgcctttcctgctgccattggcattctctctgtaaattttattatgtgtggtatcacactctccaaaaatgcagggtatttggttacataaccaaactaattaaagaatcagtaatgaaattgcaaaaccatgatcttttttgagctaatgattagttgggctttcctttaaaataatataatcaggccgagtgcagcggctcacacctgtaatctcggcactttggaagtccgcggcgggtggttcacctgaggtcgggagttcaagaccagcctgaccaacatggagaaacccccatctctactaaaaaaaaaatacaaaattagccaggcgtgatggcgcatgcctgtaatcccagctactcgggagactgaggcaggagaatcgcttgaacctgggaggcaggggttgcaatgagccgagatgtgcactccagcctgggcaacaaagagcgaaactccatctcaaaaaaaaaaaaaaaaaaaaaaaaatcatataatcagttcccttttaaatagaaagaggaggaaaaaaaaaaggaaaagggggggtatctcatttgtatacaaatagattttcaatggcatttaataaaagattctttaatggttaaaatgataaagattaattctacatatcttgaaaaatcttaatgacttctgtattcttgacttcttaaaaatattttctttcttttagtgtgcaataagacaaactaaggggaattttttcagcttgtatctcttttacccatattattttccttgcataagcaaaaaaataataattgcctctaaaactgatttgacagtgttcagtgacatcatttaatattggtgatggggtggaagagaaggtagggaatgcccttatggccaaacctaaaacacagtttccttgagccttctgagcaatcttagaattattcagaagctttcaggaaactcaaattctattaatttgatttggttcctttccaaaatgttaatagacatgtatttgcttaaaacgtctacctattccatttaatttcctgctgataaatgtattttatctacaagcaagtagaatattttgttttggttaaagtcaagtttttataaaaggaggggaagtataagagagagtttcctagagatacaatatcatctctggagcaaaatgttgaggccaagtgtaaaaacagactatttctctttacttcctgcagaatttcatttcaagggaccacagcacacccttgaaaattaccatttatttaatgccagttgaaccaatgggtagcaaaagaggagggagggaacatggtcatagagacaaaatctaactactataccaggtcttcctttgtaagaaatattagccctgccaatataaaacgcagatggacatagacagaataagcatcgaggactttttcttatttacttgaaatctagaagctcagtcatctctgctcatccctggacccactggagagttttactcactaacaggtcctttcctggaagaaataacctcatctcctgccatattagtttacaataaaaatcattccaaagtgagccatttcacattgcatttttgccacatgcacatttgctattgaaaccacagattctcagcataagtaagacataggtgtttcagaaacttcataaatacacgatctttcaggtgctcctcaatttcttaatcaaggtatattgaactccagtgattaggatagaacctgaaaacatcctttgttctattggatagtacaacacagcaagagcacacagttatttgtataataaaacaacttaattaatgaggaagatgggatgtttgattcctgctaccaccagttcacttcacaaaggccttcttctggtattaccaggaaaactttcctgcattttctagggaaaaagaaaagtcgtttattaggagcacaatgcagatatgtatctgtgttttcatagcttcagcaaacttcttagtaaaattcccatttcaacaaaaaccaaaatactgattgtttgaatgtagaaaggtatagaataaagactacaaaggggaattttaccagggctccttagaccagcttccccagcataatttttatataactcaagtaagcctctgcttcccctctcctttccagtataatataagaaggtcggaactgtcgcacaaaagaacttgatttcaatatgaaaatataatatgtaattttggggactgcagactttctgcatcaaagatctggacagccttaacttttataaaaataatttttcaatgttctcttttactaaccaggaaaacaagatgttttctgaaattaatgactttttctattttgggtctgttttctaagtttttacaggttgaggtataaagggtcgtcttctcctcatattgcctcttcataatcacctggggctattttttgcaagtcactgcatttttacaaaaaataaaaataaaaagtacatctcacaaatcataaaattctccctagacttcagacagtccttctggagtgaaagaatagaaatacagaaagaaaagaattacagggtggctttctttttattttcctatggttaatgtactgtatggtatatatgtttacagaatgtatctgccttgtgatgttaacaaaatgaatgacaaaaaatagtactgatgtgccatttgacagtttgccttagcatcactgtttatgttcttcttttctgtcctttttggtaaaaaaaaacgcaggttgtattccaaagctgtattaacacaacattctcttccccactcctacccagccttcttcagagctgtgaatttcattacaggagcattgaggcagaaccttgcaggtgtggcccaaaggggctaaagtgggcataggttgggatttacttctgcccgtctaccaaccaaacacgtatctgtgttctcatataagcctgcaaaattttacaccctgcctttcagggagacaggccacatggagcgcatgacctcttgtagtcgtctcctcacagtccttcccactgtgagagaaggaaacttgcagacccccaactggatctgggagcatatttttaagcacagttggcattgcttgaaaaagcaagagagatggactcaaattctatgattgagccatgactgaggaatgtgcccattcgttatagtcgaagatgagtaggatgatatgggtgagaataggagtggctgtagaaatggaatattttacagttatgtatttttttaaggaatagtatttttataatgaaatctatatacattatggagcttgagttggaaaacacccttgactgagctatttcttcattccattaaaggtaactttctggggagtcctatagcactaggccaagccttgggggcatgaacaaagggcctgtcacttggccttgcactgccattacatgagatccagtgtttccaaataggccttggttggaagattgagctttctatacctgccattaggtagattagatagatggcttgatagctctctgggctatacttttaataatatataataatctttgggaaggagatagctattttaaatgcaagcaaagcccagaaactatcaaagtccaaatctttcacatatttaaggagtaattgccacatttgaggttaagggaccacttactatggtgcatttgagaaatatatatgaaacggtgagtcagagccctctgaccatcttcagtctacacataagcagataaaccaccaatataaatcttataggggccagacgaggtggcttatgcctgtaatcccagcactttggggggccaaggcaggaggatagtgtgagcccagaagttcaagaccaggctaggcaacatgttgagaccatgttgtttagtctctactaaaaaatataaaaattagccagcatggtggcacacacctgtagtcccagctacttgggagactgaggcaggaggatcacttgagcccaggaggtggaggctgcagggggctgagatctcaccactccattccagcctgggcaacagagcaagactctgtctcaaaaaaaaaaacaaaaaaacaattatcagttggccttctacataacacagggctacactgtatttttagagttaagtagatacaggaaaagattgtctttatccataaaggagattctgaatttttagagttcctgaatattttcccccaagtttctgtcaaattcctgaagtcccttccctatcacactcagtttcctgaagctcttcccctacacctgctcctctgtctggctaacagagttgtcatgtctcagaaactactcaccactcttgtgagactctcttcccaagcatcatccttcctcaggatgaggcctttttctactacccaagagatcaagaccctttttctaacaagacaaggttatatctactccattttcaagagaaataacccctctggttcccatgcaaatcgcttaaattccttcatcaccagaatctctccaacaggcccaactccagcccagctgtgaacactgctgtcatggagacaactccaaaatgaaagaactatgcaattgcctgaaggtgctaatggagagccagtttactctaatctcttattactaaggaacctctcggtttcgagattaagtgggcagggagacatccagtcacttagttttgcaatgacaggtcttgatatacacagaggccaccaggcaatgcctgatccaaactattctgtatgtagctccaactccaattctgtgatatcctattctggcaggtgggaagagttctattctttgcagggttctggaacattctttcctgctctcaagctcctgacttaggagagtcaaaatcatacaggggttccagaaaatgttgtgtctgatgcagcttctcagtgaatgtaggttgttggtgaaattttcagctttagcatctcactcggggtgagtgatgtctctgtaaatactttcatttgtggttggttggtgggggtgggggtgggagcctgtcgtgcttactctgaattagcttactgggctagctgctgtactttgtaacctgaagtgtactttgactgttctgtttccttcagatgaaaaacaaaataaaaaccgacttcagaaaagacactaccagcgacagctgatgctgtacttgtagcttctctctgttcctctgtacagtattaatagacaataaactgccttttcactgcatcta

SEQ ID NO: 1481 - DNA, 171180 bp, Homo sapiens
ccagaggctgagcccgggcgagcccgccgtgcgcacagctctgcccgccgcccctggagcggatccccagccgtccctgggcgttctcccgggttctagcaaagccccccggggtgcccatcagtttccttgggtgactacagcgtgtgttttttctttcctctttcccctgcctgtgtgcccttctccaggatggcagaggcggaattgcacaaggaaaggctgcaagccatagcagtaagtccactttcattttattttcttgctctattgtctggggtggaagggggcccccgagggtttcggggcaagcggcatgccagcacagtagccgcaggtcatatgttccaggggctaaaactctgtcagggctcagctaggctgccttttcttttctatgtctatagatggagacccccaagggcgcgctttggactgaggatttgaatgtggaagattggcttaaaaaaagatgcttgctgctgggctttggggaaggactaaacagaggcttggggtggggggacgactccaggaatattatgaccgaatgctcaggcatacgttggcttcatagcctggagaaccaagagaagggtgacctgaacggtggctgccatcctctctgcggaagctgtcctcctgttaagtggaaaaccaggagtcagcgactcagccagccacgcggtagaacctcctcccagaaaccgggaatgttagttttcccttctctgtttgatattgacaagggcactggcacaagccaccaccctggaggtctggggacttcatacaactgggtcctggttataatattccatgagagcctccttcttatggtgtggagtatctgaaaacctattttcagcctacaaaggagtagtcagttttggcaaagttcgtaggcactttcagaaaagtgtacccatgtgcatcttgggtttaaaaaagaactctctgagactgcctagatttgagcaatcttaacacagtgttgccaatgatccacagatgtggtatttttactggagccaccacagctggattatatatttccttcgaggatgagggaatgattactgctgccgtatgaaatagtaacaattaaaaaagaaggtccgttaacatattggcataaaagaatctccagacattcttccacctaaatacatttgtgtttttcagttcggaagttctctggaaacacatataaatttgttggagaaatagtgtgtaatgttttggaaccaaagtatattaaagcgttttccaaaacctttttggacagattcttcattgggaaaatgcacacagacccttccttttttagaagcatttgacatggtctccaaggctctgagaccctctttctcaaacgcctcaaatctgaaatgtcttggagacttcaccactgaagtgagagagatgtttgctggcaatattgaaatgccatggtttgcctattaggtaatctttgaacgtggtgctctgaactcagaaaggttgtttttttcttctttctctttccccctgtgcatgtgtattttgatggtttgtgaagttatttgtggtttctaaagttggtggcaaggcagcatggccagtgtgtcatgaacttgataagaatggtgatattgagttaatggtgccatgtagctggtgggtgttttgtgtgaactggataataggctgctttaactgttgatgcagtggctgttcccattggctgctgctgaaggcttccaacagttgtcacattttctgcctttgcacaaccagctttactggatgcctgaggaacagctgaactccatgaaaggacttgctttccaaacatggagccagtagctgctaacactggggtacccttttccaagtgcggttgagtaatcccagcagaggccaagtcgattttccaagaaagatctaggcaaatctttgggaattctcttgagcatataagaatacacacaaatactcacttgtgcctcttcagttattgaagaattgagtttgtcctgtgtatctggggagctgttgattattctcatgaatgtgcacctaatacagtctgccctccctattcatgggttccatatccacgccttcagtcaatcttggattgaaactattggaaaaaataatagatagctgagtctgtactgaacatgtacagactttttcttgtcaccattccctaaataatacagtataatcaactgtttacgtcgcatttacagtgtattaggtattataaataatctgaaaatgattaatgtatgtgggaggatgtgagtaggttatatgcaaataccatgctattttatagggacttgagcatcctttgattttggtatccaagggggtcctgaaaccaattctctgaggatactgagggatgactgtatgatgttgtcaggacagatttgctaacagcgtgtgtttgtttgtgtgtgtgtgtgtgtgtgtgtgtgtgtgtgtatgtgtgtgtgagagagagagccaattaagagacagagggagttgggtggggggacttatggccacatcggtaaatggttttatgctatgctttggtctagtgcctactcttctgaattctgcaaaccctgactctctcatcactttcctggagttctcaggggaccctgaggagatcacaagcctgcccccagaacctagcactcctgaagtctctctggagatgtgagggaagaagacaataggtcctcacatcttcacttacttgggcttctctctcagaggcagagaatcgactgggattccagtctgcagggccttgggcagtctttagtctgggtctcagctccttcatctgtagaatgggttcatgagttctacctcctgggctggttgtaaggtttagttaggatggaggtgaagcacctggcaggtagctgtcattggatggtgttgagcagagcccttagcttttgtctgtattgctgtcttgtcctgtggggggtcagaagcaacatctctgaagtggaatgtgtattaatgacttttttttttttttagacagagtctcactctgtcacccaggctggagtgctgccatgacagctcgctgcatcctgaaaccatcctcccacctcagcctccccagtagctgggattacaggcatgtgccaccatgcccagctaatttttaaattttttgtagagatggggtttcgccatgttgcccaggctggtctggaactcctgacctcatgtgatcctcccacctctgcctcccaaagcactgagtttagagacatgagccactatacttggtctgaacagctcttttttaatcccttccttcaactgactgaaagtcagggccctgcccagcatcactttctctaactgctttagacagaggcagagatatgacttgaggattcattcatccatttgttcagtaggtatttacagattgcctcctctgggaaggtattggcaacactgaaaagttggtgtccccaggtttcagctgcctgaggctgaaacctttatttcaccttttgcacataatttcttgaaggacagatgtcctgatacctaagatgcttgtcacatgaacatctgtggaatatccgcccccaccaacaaaactgaattaaatacttagaaactacagtgctttaatggaatcttccatttggatccaggaactaatcaatgagaaaagatgactcttatcctaatttctgccaaaagaagagcaagtccatctttgacaatgatctctacactcacatgctcctttcttctgtagggatactccccaaactttacatttagaacatggtaaaaagcctctgaaacagcatgagtgagaatggtaatcccagggactaataacaacaattgccatttattgaatattgttcattcagaaaggcacggtgtgaaatactttttgtttttcacctaacgttatttatagtctaatggaagaaatagaaaagcacataagcagttactatccaggagtactatgaaaatgagcatccaggaggaacatgtaaaccaatctcagagttgtgaaacaattccccaaaaagaagacattagagtaagtcctgaaaattgggtaaaataaaatataaaataacatcataaccttcccaattaccaggaggcatttgtttattcgttatttgattattatttattcaggacatttagtgtgagaaagggaaaggcaaaagcatgaagaagttaagtcagtagctaaagacacaaactcagagtgaacactgaaatgcttttcagcatgtattatctcattgaatcctaataagaagcttatgaggtaggcactacagtattactcatattttataggtgaggaggttctagaactggtctaacattaaactgatagtatcaaagccaggatttgaatgctgcccgcagcaggccattggagcctttgctttgactgctgccctgagctgccacccaagatggcggcagcgtctcgcacttttcccatgagcacactgtgcaggtggtctcagcagcctgagtgtgagccacagactgattccattgcaatgggaaagcttgagacaagccaggaggcctacctccttttgagagtctttcaagcctggattcagtgcatagaaatacccaacataaaatttaatggaacgagtaacattcccatggggaagaagctgttgtgtctcagtggaaactaaccttgtgggagggtgctgttatgtctgcacattggagaggaagatagttttctttgggcatgagtgaaaataagtaaatgttatataaattgtcttgggtgaaactcctaagagccacgtggacaaggctcaggctacaccagggaccagcatgagtatgtttatatatgtgcggaaataggaaatgctaatctaacctatgctgttctttagggaattttgtcatttaattagaacccactctgtgaagtaataaaaatgatctttgcatttgtgcagtactttataatttatgaaaaccttgtatatgctaccttcttcctgaggtgtgtagagcaaatcttatacgctttacaggtgagtattcagagctatccaagcttacacagatagaggtggaagagttgtagtaaatcccagcctctcctgactcccaattcttgtattagtccgttttcaccgtgctgataaagacatacccgagactgggtaatttataaggaaaaagaggtttaatggacttatagttccacgtggctggggaggcctcacaatcatggcagaaggtgaaaggcacatctcacatggcaacagactggaaatgagagcttgtgcagggaaactcccctttataaaaccatcagatctcgtgagactgattcactatcacaagaacagcatgggaaagacatgtccccgtgattcaattacctcctaccatgtccctcccacaacacgtgggaattcaagatgagatttgggtggggacacagcaaaaccgtatcacttgtgttagtggtacatccagccttggaagggtgctttgatacgggctgaaactgcaactaagatcctgctggactaaaatcttctggctgggaggagaggagtgagcttggatgtgtctctatggaatatgcccttgttaggatttcactttcggcctctttcattcttgaaattctcaccaaggggtcagctagtgagtttatggctttcatctgattctattctcagtcctgcatagacctgggtatacgctgttggcctaggctggctgtgccgtgggcttacagagaagtgctcattggcttttcgttggattcgcctctccatgccttttcttgcctgggagcattacagccttgagtaccaggcttggagtgtggggccagtggccaaggaggccaccaccctgcttttggtccaggccttttaggccgacctgcacagcatgggcaaaaagtccttgcaatgatttacatactatccagtccagcttcccaaggatccctcagaggggttagagactcaaacccaagccctgtagaaacaggcactgtgattcatgtggggaccatccccatccatgttccttgtggacttgtgttattggtatgcagctgtcagagaactggagaatttaagatcctggtcattcatctgttatcttatatctcagagatgcagatgacaccctgcttctaaaattccatgttaaggcctaaaaaatcatttgcgtggtatattggtgctgaggaagggttcaacttggctgagtctgtgaagctgcccactggataggtgacactttgggcccatgcagggtcattgctgtgtctgggagtgccaaggcaggccttacccagcatgcataagggtcacacacctccctgctacttatttgtacctctgagtatttcagtcttcagcttattgggacaaagagcagctactctgacaaactttaaaatgctctgagaaatagagcagttatcatggaaaaaaaaagtcatcatagaaaaagctaagtgaggggggttgtgggttatagtttgtcaatatttaaaggaaaaccagggcccagtagaattgtttctatatttctttgggggctactcaatgctttggggtcactgctggcccctttgaactctccacatttcaccactgatcccatttgggaatgttgatgaacttgcttggcagtaagagttggtcattctgtggcatgaaattgactgagacagcagatggacattgatgcacagagacggtggtcccaagggctgtcattgtggtggggtagttaccagcatggattttggtgtcaggaagacctggcgcaagtcctggcctttccgttggtatctgtatgatgtcactgtaccttggtttcctcacctgtaagatggggctaatgatcatacccacttcagtgtcttgttgtgatggttcttttagaggtttcttgggaaatgctcagagacagcatgcattaagcactcacaaactttcctatttataataagcaaaccaacaaatcataacttatgcatctttaaacagaaagtgaacacaaagagtgaaaggagaattttgttagccacagcatttttgtcaaactaggaaattagataaatactaggaaatcagataaatgttgtaactcctgagttttcaatgcatgaagatagtattaataataaaaaatggattatttgtagtaagcaggagtagtaaactcaacaggtcagggggccagcatgcaatgtaaatgagggacacagattgagtcgaaagtattggtccctagagagcagatgccacctctcagttaagatgcagttaatttatgccttgtgagaacgtgggtcttatgttgttacatcaactcattttcaagagaagccagaaatctgatttttaacatgtgagatctcccacttaaaaaagaacagtattaactagtttaaaaactttaaaaagattggcagtcacaacacaattccttttgatcaagaggccgacattttgtgacctttagatatagacagagctttgaactttacaggatgctttccttatgcattgatttatttggatttcataaggatactgtgaagtaagcctatcagcacccctgagatatttcataatgttgtaatatcgggttgcattttcaccagagctttgtgagtttggtgtccagatgtttggatcattggataaatggtgcttatttgcgatatcttttgacattaaatgagcccttgcaaatcactgacattattgaaactcagaatactcacatctagataggtaattgctctctaactcaaccaaaacaaatctaaaccacatcaagtcagcaccttaatttgggaaattcctcttattagaaaagaatctttaagaacctatactcaaggtatgcaaatctgaaatgcaaacctgatatgaagcccaagcctaactcatgtcagtcaggatgtttgagttgatcctgatttattattagcctcaagtaatggacattgtagggagattctgctgggctcaggactcatagtagcagcaactgccatttgaccgatgtttttgtcatatatggtatagaacagtaattctcaaacgttagtgcattaggatcacctggagggttccttaaaacacagattgcaagagcacactcccagagtgtctaattctgtaggtctagggtgatgtggcctgagaatttgtatttctaagaagttcccagctgcaactgctattctggggaacacactttgaaaacgactggtgaagtgtaggagatcaatagtaaaggaagattatgacctgggtcctgatgtgcatcacatgcccattgtgatatgcccaggagtttgtgtggtgtgtatattctgaagaggtgaaatagaataaaaggccaaatttagtcttgattaatgagagccttaaacatagcccagtttggaagtcatgcaagccgggtgcggtggcgcactcccatagtcccagctacttgggaggctgaggtgggaagatcgcttaagcccaggagttcaaggctgcagtgagctatgatcactgccactgcactccagactgggcaagagtgacaccctgtgtaactgtgtccttctcacattacactggctaatcaagaagaggtctttgcttatctcgggaacttgctttaatctatttaaataaagtgagatatctgttggttacttgacaacaccggtttggaaggtttgcccaggattggctgggcaggttgagagagtttgcctgggattgactgactgaaactatgggctacaaaattcccttggggaggccttagaggacacctcagtgagataagaagtcatgcagtagagaagatatccagcaacaccatgacagccccattgagagaggcttgccatacatatgatggtgtatagatgaagacatcaaatagcagatcagcccatcaagcctggtggccccttctccagcctgcaggtgctaattcgcgatgtgattgcttctcacgtgggcaactccaataggatgccaggagaagcagcaactgatgttcatttacttaatgatggttaatattttatgaagccagtctgtgtatatgcaagtatgacttgttattggcatatcaaggacaagtttattcttccaaggatgtcatgcaggcttccctcacttgtctttgtaccatgcattttttgagctaacccttcatttttggaaggattctgcctcaccggatctcttgtatatcttaaaacacaaagcacagaggctgcactgtacaggatgaggcctaagagaacgtggagactgtaggggatgggccacacagcatggcggagtttgtagaggaaaggttgctcataagtgctctgggtttgggagaagaccacacagctgagatctatttctgacaggaaatgccggcaggagcagagggtggtgtggggcagtgcgtgttggagctacagtgcccttggttaattattatctcagtatttctcattagtctcttgttgaattaaaatgctcaaaaggagattattaaatacacacagaaagggagacagactgacagacacagagacaagactacaccctatttacataatgcttgaacatatattaaaaatactttggattactctttgaccctagtatcactgtttctataggatcatataagtttagctagaagaaaagaatagagaatctgtacctttcttttgcataagatcgaaggggaaagaaaagccatgtgaggcccaagataaaagccccagctgtagatgaaaaagctgtgggccagacgtcggaacacatcttcctgtccatcatttcccttgtggaagcctatttcattaccctgcaggcttttaggctctagacagctttgcaataccaaatatcttgaaggcatttgtaaaacctactcttacttttttcctggaaaaaaaaaattatactggtttacttactattctaggtgggtgggatttttcccccctctgctaaattataaccagtcatctaagtattcactttatttttaaattcagggctgaaacttaaaaccttgagggttaccaaaaaatgttattcttaagagaaaaacatgcttgaaaacttaacccctttggtggcaggcaggggattttctttgtctgtgtttgagtgctaatgtcgacaactttgaggccaataaataccaaatggggctctaggatttgggcaactgtgatagtgtgtgtgtcctgcatgtcacatgagaaagagagaggccgggatttaagaaaggtgcctcttggctgggtggcatgaactcagtcagctggctttccccaggcacctgattggccttaaacactgagtttttgtggtgtgacttgacatacatcttgggctgatatcacgtgctgtttctactggggtgggaagtgctttgaaaatgtccttgctccagtggaactgtgagacatatctaaaaagcttaaggctaatatgagtgatgctaaaaggaagtcctgcttatccaggtaagcaaaagcatactctaggatagcagtgctcctgtaacctgcatggcctatttttcttttccaggtggtatgcaggcagtcttgttcatgaacattgatgtctgagcatgtgtgttcaaaattcagtgttgttaatcaaataaaactcaccacaaaacccgaaggatatttaacaatagatgagataggtttggcggagatgggtcagaagacagaggaggtcctggaggcagcagtagaatgtactttccaatcttactggtgactagagataagacactagtagcctgtttactccccatccttatttacactggagtgagaatgatatatgtcagatcagtattggatgcgatgagggagaatgaagagaaaatattgactctgaaaaatacagacaagaggaggcaaagttgaaagtaatgtaaactgcttaatcacctgcctttctctctttccaccgtcatctctttctacttgacatgttcctgcttttgcctctggatggttctatctctcatcccctctcagcctgggtccacagagaaaagcaggaagcagcctggcatggcagtggagggagccttttccagccttcctccagcagaagtgcgccctctcccctatagggagatagggcaccccaggcttcagaaagcaagggaaagatggtacttcatcatgtagcttttcttaaggggttggagggaagggctcccagttccggagagggtccatgtgccagccaccctgctgaatgccttatgttaggggggtgagatctcagatgtgcacaggtaccaggttgacttggctgagcttttgggactgtggtagccaagagagggcagactcctgaggggacagagagtgctcaactccaactgatgggcactgtgtgggaatttgagcccagggtctcctgcttttccaagagaacctggaaatccaattttgaaggaagtctgttgatgtttaaatgctcacaacagtttaaatactgtatgggccaaaccaaacataacacagattttaacacagtgtaggctggatttgttccctgtctcaatgaccctccccctctacccccagcctgggccaccagttttccacgtctgcatgtcacaacctattttatttaattacaaaaccaatagtatgtgggaatgggggctggggggttggtacagtataaagctatgtgagttgtagatacacttatgtatgttgggcaccttggtgggatccataccctataagaaaaccatagtcttgggtcagagtcagggctgctacttaaatcagttccttatccagcatgctggatgaactcatcagttctctgtaagaagtaaaaactacaagcactctttaaaaaaaatgaaaatgaatgaagagaaaaatagacttattaaattctttaatttggaagactgggtctcgctatgttgctcaggttggtcctgaactcttgggctcaagcgatccttccacctcagcttcctaagtagctgggattataggcatgtgccattgctcccagcactaaaattgactttcttgatgtacagctctctcaatttgaacacatgcgtagatttgtgcaatcactggtatactcaggcaacagaacagttccatcacccccaaaagtctcccaggaaggctgattttaaaactctaactggaatctaagtcattctgcttggggctaccttataccctgactttgaagaccctaaaaatcagttgagggtgggagggttgaccagaacatgaaacttgggttcccagccattggtggggaactgtttcataatgagcaccctaccatacctatataacaagtttttgcttcttcctaatacataccttctgctccagcctgggtcgtcttttcactatcccctactagggttgttccatttagcaactaaatgtataggatgcccagtgattccatggggacatatttatattaaaatattatttgttgttgatctgaaattcacatttaacaggacattccatattttatctggcaagcccatcctcttcacattcatgccacattctcatgtaagttcaaaacctactttctctgtgtttcaccaaagggtgaaaatactctttgaaaatactctttgattttattacacttaatcttagccaaaggccaagaagcgattgtatgctttgattttaaatagtagcatgtttatagggagatagggcaagtgttggaaggataagagtgctttctatacacataaatggattttcaagaaatgttttgtgaccaactggttttatcctttccagagaacaagaaatgatctaatatgtgctcaaggaaggaggacaactggatttcagaaattggttcatgttacagcccctcctctaccctttttctctggcctgacctttgaataatataagtctgaaaagactaaacaaagagattgctcaaactggatgagtttaaaaataacattggaatgctagccttcagcaagccatatatcttatactgcactgagcaggacagtgccctgtggtgggtagaagatgagtcacacagtgatcacaaccagatccttcccagcctggatactttggtggagagtggtgtgatggctgatttatttgtcttgtttgtttgttgtttcatttttccattttactagtgtgatttcagaatcacaaggaggcaaggaggaaaattgattttagatagcagcttcagaatgaaaaatgagtggaaattccacttttcggtctagaccagggaccagcaaacaatagcccgtgggccaaattcagcctgcagcctcttttcataaggcctatgagcagtgcctggtttttatatttttacaaatttgaaaaaattcaaaaaaggatcttttatgactcatgagatttgtatgaaattcaaatgtcagcatccataaataaacttttaccagagcataaccatgcccattcatgtatgtgttgtctatggctaagtttgtgctataatggcagaggtgaataattaaaacagagactctatggcctgtaaagccaaaaatatttactatctgaccatttggagaaaaactttgccaacccctgctttctacatggcgtatttcaatggctgtatttgcgatgaaggctccaggagccttttatctaaagaaatcactattgcctcattgcttacagtccagaacaataaagcatctcagacatccttttcactgttttctgggcttaccatgatgagaggttttgtttaccgaagctggcatgtgagttttgccgctgtggaattttctcattatatcctttgctatctaagccaactgcatgttgttgttgttgttgttgttgttttttgaaaaccagaaaatctgatctcttagggttaacagtttggcccatctgaaataagtccatacaattaaaaacatttctttctattgacagggactgagggttgagggaaagcactgcagattttccaggtgtatttttttttttttttgctccctggattttgcctgaaccctcacttttctctttcagggaactttaagcacacttagtgaaagactaaaggtcagagagcacaccagccacattccctgagtccaagcagggagccagagaggagtggtttctggccagccttccctgttcagttacctcatggaacccttgggaccagggccttgatttacaaatagagtggccactaggtaaaagttgcccatggccagtggtagcaggatcgaccctagtgtctctgaatcattaagtacttcctttctgccctcttccatttcttactcaaaaacaccagctacaattttgagtctggtctgcctggaaatttccaaagggactttggtgccttaataaatattttcaaattgctcaaggttttggaagatagcagagccataattgtgaaatcgggttaaagaatgattgctgcagtacttgcgtcggccctgtggccatgctgaagtggacagggttgtggacactcacaattgctcactgcagatggacagcctttgcttttctggtcatacatatgcttgatcctgaaattctctagatgggctacttctgagcagctgcttggagaatgggaagccaaccctatagtgtaaggtttcttaactgaagtaccattaacactttgggatagataattttctgctgtctgtggggccgatcttttgcattataggatgttagtggcatccttggtctctatccattaaatgctagtagcacaccccactcttcattgtgacaatcaagaaggtctccagacattgccaaatatcctttggggaaaaaaataacccctttgaaaatcactgatgtagtataacataaaggttacctgaccaaatgtacttcccattcttttaccattagggatttatccctttaagtcttcactctcatcattagggattaatttctttaaatgtcaaagtcttttttattttctagaatccctcacgacaatattgatttaactaacctgcacgttgtgcacgtgtaccctaaaacttaaagtataataaaaaataaaattaaaaaaatggtaaatccttaagcttgggatggcagatggttttcagctcctatgtgaactctaactgatagaaagtgtccatctatagtgccgccgtgggaagatctttgaagctgcattttaggtgttggagaaaggacattaagacagattagagctgtcttccatgggcaagagatgagggagttggcatacacgtgtaaggaaccttcttacctaacatttctgcggagattcactatagtcaggccttaggctggtgctgtagttcagccttactgctgagccctgtgccagggcactgttcacacaaggtccctgtagccttgtgtatttgttagggcaattttccagcaggttttgaggaaagggcaccttttctagatcacagagtgccatatgggcgagcagaggtgctgtactctgttgatgggaatagaagtcagggaacaaaaagagaggggcaaagaatataacttcctgtctgtctctcctgcctgactgtaaacttcttgaggccaatgactatgtcatattcaccattatctactctccgcctgtcacaacacattttgcatagtgtcaaagcaagtttagtgacttttagcagagttcttgttctgtatcttggactccttagcagtcttgtggaacctatgggtcgcttttcagaatagtgcttaaatgcacaaaataaaatatttaggattaaaaatataaccaatgaaatttatatatagtcagcaaaatattagaaaactgtgatagataatgtgctttgattgattgatgtacagtcagcaaaatattagaaaactgtgatagataacatgggatttgattgatgtacagtcagcaaaatattagaaaagttaaagataacatgcttttttattaagtaaaatctagtggcagttctaatacttactctaattgcaaattattggtgaatgtaagtgatattttgagctgtctccaacaactgtaatgttatataaaaagtctgtgattcctactcctaataaagtcatggtatattagtccaatctcacactgctataaataacttcccctgagactgggtaatttgtaaagggaagaggtttaattgattcacagttctgcatgtctggggaggcctcaggaaacttacaatcatggtggaaggggaagcaggcacatcttacgtggcaacaggtgagagagatcatgtgtgtaggagtaactgtcaaacacttataaaaccatcagatttcatgggaacacactcactatcatgagaacagcatgggagaaactgcccccatgatccaatcacctcccaccaggttctgcccctgacacatggggattatgaggattacaattcaagatgagatgtgggtggggacacagagccaaaccatatcatataggtactaatgatctacctggggcttgtgcttacattcataactgaaggcggtgctaaatgttagctagggggtggtaaaaataacctttagctgggtaccctaaattctgtcttatccccaaacgccctgaattctcacttctttcttttgtaactgggcccctgctctgatggtttcctcctttcctttgcctgatgctacctcttttaccttcttggggttcttccccagcaaatttttctaggttctttcttctgcattcactttccatctctctcagctgggttgtgtcctttggccgctatctaagttctcactccgcttagcatgggaagggaagcttctaggcccagcttggggttaccctgagcttcagaggagagagggaggttggcacatcacagatactcactgaatgctttttgaatggaaacagttgctttgccaacttcaccttttttatcaggggctcttcttggattcttggactgtgtttgagatcagttcactcttgatatctcccctccgcatggaaagcatccacaaatttccagctagagcatgaacttgcaatttggtttgcctagatcctggaagtctacagagttagaatctttcctggttctgaactcagaagcagcagtgagcagtgggactgctgggacctttaccagcaatcacccaccacatgcaccagcttcaagcagctctgcagaagccgtccgtcaccctccccgttgcacaccttggctgtgaaccgccagggcaggggcatgtgtgggaagcaggcggcctgcagattcattattgctacaagtgaatttcataataaacaaacaaaaatgagccatctctagtttagttccctttgagcatataggccatcaggtcccaaaatgttcagagttgggttagtatctgtggctttcaccaggtaaacacatcagtgttcttcctaatttggactgttgtggcttccctagttcttttttcccctagattgttataaaggttctgtattagttttccagggctgttataataaagtgccacaaattgggtggcttaaacaacaacaattttatcatctcatagttctggaggctagaagtctgaaatcaagatgtccagctagattggtttcttctgagggttgtgaggaaggatctgttccaggcctctctcctggacttggggatggccagcttctccctatgtctcttcacatcatcttctttctacatatgtctgccggtgtgtccaaatttccccttttcataaggacaccaatcatgttggaatagggcctaccctaatgacataagttgatgacttctgaaaggaccctgactcagaaatatcctgaggtactgggggttaggacttcaatatatctttctggggacagggtccttgcatgctgtcagatgatacctgcatctcgcagtgatggtcaagcgtaccctactctgcttctggctatggcagtagaaattgtgtcccaggggaatggctaaggggcctgtaaacaatgggtgccatatgccattaatggctcaaacctctgccttgtctacacactcatgtatcccataaccctctgtctcctgtcaaagccttttatcaggaaaggcatagaaccacatttcacgctaaggcatgagtgttaaacataccctcacctagccagttaaaaacattgggcaaagctgtaaactacatcacaggagttcaaaatgtcaacagagctgcccccagtcctgtctgtgtttttgcttaggacccagtgttgtgtcactactccccattgataataaacaaaacatgcctcatatgttcacagttatttagagtttacagaattctctccttctatcaatttgtttgtgcctgaaggagcaggaaaggtattattttctgcattttatttcagagaaaacagaagctcagctgagtaatttgttcaagatcatccaggctgtggccggagcccacatcatccatgtctctatgtcagctgtctttccactgctccaagccacctgccctgctgccctccgtttcccctccaggtcactgttgtgcggaccatgcaacccgagtctcaaagactcacggatccccttgctgtgctctaggacccagtcctagcacctcctaacctccccaagagggcaaaaagcagcctaggtctggtgagggtggccaaggccagaggattctgttagtatgcagatcaaaggaggagcatgggcaaagtgacaaggtttgtgatggagcagaacagtgtcaggaagtgatgtgaagctcagcgtggctcgtggatgttgagaagtgaggttgatgggcagggggtgctggaccacagaagaccaggtgttccaagtggggcaaagatgtggtctgtgagaggctgagagccactgaagacctgtggtttatcagagactgctgtggtggcagagtggaggcaggatgaggcagggagctgctccaggttcctgactgccggtccctgccagtgctggtacattcctcaaggcttctcagtggctttccattatttccatagaggggtcacctttagttttggggagtttatttttgagatggggtctcactctgttgcccaggctggagtgcagtggcacgaccattactcactgcagtcttgaccacctgcgctcaagtgatcctctcacttcatcctctcatgtagctgagactgtaggcatgcaacacgatgcctggttaatttttttgtattttttgtagagatggggtttcaccatgttcccaggcttgtctcgaactcctgggctcaaacagtccacctgcctcagattcccaaagtgttgggattacaggcatgaaccaccgcgtcggccaccattaggtttttaactgtttaaggcattctttttatactgaaacccagaagaagcatcctccccagcttcagtggaaagccttagagctgatggaaaaccagtttcgagttggaatgtggaggctatttctggcctttgtgacatcctgttcaactttcagaggagcctgggaagaaaggggtgactcagactataagcttatttttagggaaagctaagaattcagtcagagccactcggattccctattgcctgccatacagaatgtgctgttggtggagagattgatgggcagaaatcctatgtttatcacctgattgttacccagcacctcccatgtgccagtataaggtttactgatttgaaaagaggatggagatcaacacaaacacacttttaaatcagaggagcatatttcaaggcatttatatttaagaactaattttagggccaaagaactaatattgtaagagcttctgtgattaggtacttaatatatactactgttatggtaagtgtttagcaaatactaccgcatttaatggaaacaataatactctgttagaggaattcttatcactgttttaacagaagaggaactgttaacttgaggaggtttaacgttagcccaagaccgggtagctgagtccagattcaaactcagatctgtctggctccaaacccatgcaaatgacccctccgggtttggcaattaaacgactcacatgttgccaccctttgttcctatgtatcactaattgatcatggaattatttcttgctcagctcagatttgacctcaggatcctttcaacacaatgctacaggtagccactgctcccaactgagcaatggtagtacttgaagtagcgtctacctgtcatcttagctttatctttctctgtatttactcaaaatagaatctttaaatctacaggggtttgttgttgtttatttctacagatgtatttgtaaccttttattgattaaacaattgtaagaaatggagtattcaatacaatttccttttatagtcactggaaactctgcgtgctttaatagaggatcctaactgccttggagggaagaatgacgtcttaggactcaaagccttgatacaggcaactggcttatgtgtcagtgtggtagtgatgagtgggagatggggaatcagcctgaagaactcaagctgtatagcagtaaaactttcaattagcccagtctggttaattacaactggatggtgagttggggttgggggatgtggtgggaaggctaaagaagcaagataacagggtagatttgggggttgcatacatacacaccttcagttgccgtgaaacatttcagctcagcagacagacctgttgtcctaaaagtatagcaccatgtggggctgtgggtccctccagggagaaaggagttccttaaaagcaaactcagacaagagaatggggaagatacccccagggatagtggtgaagggagaacctagaacccagccttgcaggaggatgaggtagaaattggtccaggaggaagtctatggacaatatctaaaactggagcatcaagaaatagtaatagaaatatgttgcttagaaaggtggattccagatgattgagctgaaatggagttggacagtcacaatgtatggaaggtagtgcaggtgcatcaccaacacagattcattcgataaaattaaaatgtttttgttttactttcaaaaaaataaatagcaaaaaagcaagctcaggccagtggtggctggtggcctgtcagcatggagcatggaccttagccacaggccagggctttaaagccaggactccaggacctgggatgggtcattctgaaagctgattatcagaatgctcaggccagagctgggccagctgcccaggtgttgatatgtgtgtgtgtgtgtgtgtgtttgtgtgtgtgtgtgaagggctgagaactgcatctactaacatactccttgtgtgatgttagggttagtgaattgacctacagtggtacttggcctgcaggaaggggataaaaatgggcatcatggtaagaagttgggccagcaagcagctctagtctcacaaagccttttcctggactaatgagagggaccatggggaggggtgatccccccaaaatcaaccagatcaagttcctgatgaatgggcaatttatgactgaccagctggacacaaaatgccattgaacaacccaaatgaacaacacttctcagtcaaaatgctgctttggagagtctgtgtatgcaaatatacctcatatattcttctcactgtgggatggagcaagaaggccctgagcgtgtttctctaaaaatgcatagcaataatcctagtcttaattttagcctcttctgggcatctgaaatggggttgctacagttaaaataatgctgtataactaacatgatattgggtattgaggtcagagcagggctggcttcatcagcacgtgatttctgtagtcacataggttccccactttgttaaatgctccatagccatattgaaattcttaataacttttggaccaggagccctgcattttcattttgccctgggccctacaaattatgtagccagcagtgggttgtcataccccagagtcccagacaccagccagacatttgctgtgttgaaattatataggggaaaaatataatttagagcataaataaacccccatactttcagcaatttaacagtctaatgcaggtattccttgccagtggacagctttcctccatgtggtttctactatttctgactctgctatctcccagggcctcagaatcctttgcctccagcctgtcaaatgagagaggatgaagaggcacactcacttcttaactgcctttgtctggaagtgacccacatcattcttctcatagtctggagaactagtcatatgaccacacctaggtgcaaagaaagctagaaaacatggtacctggctgggtggttactttccagggctgcctccatcctatgggaggaagagcgtaaatttagatggatcattagccttctctgccacatagattgttcatgaaggaatgctgatgcaaaagcaggtatctcagtgcagactactgtgatggatcaggaaaggtaggaatccgggtctttttaacacagatgccagtctcttagcctcatcagttcattattattaagatgcttgctagttccagaataggaagaaactagaatcagaatagtctgtgtttgtttgcttgcttgcttatttatttatttccaagaacaggtttttggggaaaaaaaaagaaacactaacacattaaaatgtacacattaactgtaagatgcattgctatttcagtaacattataatgcgagaggaaacacaatagcatatcttagaattgacgaaatctagtaattgtcactgtgaattattggtttagtaatttttcacaaatccttttgctagcttcataaagtcctttaatagtgctcataggggatagccatgtgttggcacttggatctggtaggttctgcctgaccattttaatcaaaatgctgttaaccagggtaggcaccgcctgttgaatagcacaccttcttggtgaatttgtctcatggagcctcatttctggatgtgtcttaggcaaactaggagccctcaagatcatctagacccacgctggaaagaggtctaccttggagatgcatttatattcccccctgagatgctggtgattttgcaagtagtaataatcagagacctggaaaacttcaagagttctgtaggaaatatgtcctggtcagttctcatcagctcaacaaactgatgtggctcttgagggaaccagctgcaggaggcaggaaagcaagttagcatcaacacaagtgggccagcaccatagtcccaattctcctctttcatctgcttctcctccaccctagtagacaccttgggaagacaaggtagagacagtggcttgaaattcctagtgtcttcctttgatgggtatgtgctcctgcagagttaagggagtagatgaggttaactgtcatctaaacaaaggcagtggctgtaaatatattccttggagcttgggagccccatggctatgttccaggccagagagtccaaagaaaatcaaagactgccacctaacagcttttttggccatcctgaaagtccccaccttctcccaggtagctccagagaaagacaactcccagccaggctctgacagctgaatcgaatggcccagtggtggcacattccccagagggcttcaggttcaggatgcagccaagtttcctgctttatcctgagttaagcagagatcatcacctgcctggatgttgttttgtctgtgtcacctcatcactggagaaaacagattaccatctcctgcagtttttttcacaaaacagagcatggcatggaggaaataagatagtcagcatggcatcttggtgggtcaaaaataatatcatctgtatactttgattacattttaaattcagtttgcacacaattggggttcatttaattaactctaagctgtaatctcagtctgggtttgaatggatctgaattttaatagctttttcctccaaaatattatttctatggcaaataagcagcccttccttataatgctgaaatcatagaagttagttgttttcccctcattttttgacaatcattctttttgcggtagtaacgaaatcaagcagttttcatttggctttttggtagttgaagttaatttgtcaatttcctgctagtcttctattacgtacacatttttctggttagctgacaaatcagaatgctaatgatggtggggaaaagaagactggcaaattttacttctgtgggttttaccaaaatcataattggttgatttttcctttagaccttccaggataaaggattttttatttttaataatattttcttcattctaaataagaaagtgaaatgtacaaaacagtggaaagaataaaataacttaaatgtgcctgtcatggggccttacactcaatcagtatgttaacatttttaaagaaaaataaatgcccataatctcatcaccaaacacatgtagggaatttttttggcaaagattttatatatttgtagttatgctctctataaattttgcatcaagcttttttcatttcacattttcataaataatttctcatgccgttataaactcttcataaacataattttaattggctacgtaattgttttttaggagtacatttggctgcaagtgcctgaaaacctgggaagaaacagcttaagggtttttgtttgtttttttcatggaagaagacattgagacaaggggataaggggtcattgagaccatcagagaacctcctcctgcagctctgtttttcttagtgatggtggctgcaagccaagcacagggctctcccagagaaaacagggaatcactcccatctgcagactaagccatgtgatcaccctagctcaaaaatatctgggaaggtgggctgataactttccagcctttgtagtggaggaatatgggtttcttaaaataaaatgacctgaattagaattactgtgtcaaagagcagttgatttttttccccgaaattccagtctgattgcttatttggtgaaaagcaggatttaaaaacctgtgctccatttactaccatctcatttggcactggaaacacaaatgtacaactagttataaaagtaggatcaagtccaaaacctgtggctatcagtttcggggaggcagctgtcaatgcaagataaggaaaaaattcctcaatatttagagctgccccagtttggaattaactacttcatgggatggtgagcaacctttcccaagatgcagcgactgaatagatacttggtatataggcagaagaggtaatttacgcatttggtaaagtagaccgggtgacctgtaccacctaggcatctccatgattttaaaattaggatacatttgctaaaatatttccccaagcacccaggatatcctttgcatggtggaaccttgttctgatgttgcttcagatcaaacatagtagcctgaaatgtggctgtagtagagtagttgcctgagatgggaagaattcacctcccaggctcctgactccagggccatggaaaagctctatcttgggtttgagaccagccattacctgggtcaggcccacataccagccccatccaaggttacatatctgatttcctcactgcctgttaacatgactttattatttttcctgatgccatggatttcttcttttgtatcaacaaaatgtgcatgttccttatgtaaaaggtggtataagttctatctttgacattacccaattataaaatgcagtaaacataaaaacaattttctttttgatttatttacaaaagtggtctttccaaaacagttttactagtttaactcattttatctgaactccagcttaaagctatgaagtcatgtgtgataaataaacatgcatctgagtttatgtaattcagccaagaaatattttttgaacattttctatgttatagatatatttgtggatgctgagaatgttcatggtaaatacaagacagtctctgccctcacggagcttgcattctggtgggagactagggaagaataatttatgaataaactattgaatatatactatgtttgtatagtttgtagtacagagacttggttgtgctggggagggggataccttcatagaatgttcaagaaaaaccttactaataagctagtgttggagctgtgataaaaaacaaagagtgagccatgtggatatctgggggaaacacacttctggtggaaggaacagcaagtgctggcctgagctgagatcatacttagtgtgttcaaaaagcaaaaggaaagcctagtgtggcaggtggggagtgggtgaaggagagtggtaggtgatgtgaccaaagaggtggtggctggggctggattatgaaggcatctatataccgtggtaaggatgttggcctttacttgacatgagatcagaatccagtggaagatttggagcacaagaattgcacaatctgacctattttttaaaaagattactctggctgatgtggtgagctgagttagtaaggaagtgggcaagcgtggaagcagggagactagttgggaggatattgtggtaattcagagggaaaagagatacatgtgggccaagctagcagcagaggagatggggaatcctggattgatgttgatagtatagttcaggggatttttctcatccagtagatctaagtggaatgtgagagagagaaaaaaaagtccagaatgtgccaaaggttttgaggtaagcaactagaaggatggagtttcactggaatgaaatggggatcaccatgggaaggcctgctgtgaagggaaaataggaattcaattctggacatgttaagttcaatttttggagatgttggtctgatacctaggtggaagtgttgagtggtcagtgtcttagcctgttagtgctgctgtaacaaaatgccatagactgggtggcttatatacaacagaaacttatttctcatagttttggaggcttggaagtccaagaccaaggcattagtaggtttggtgtctggcaagggcctgtttcctggttcatagatggaaccttctatatatatatgttcacatggtggaaggggcaaggcagctctctgggaccttttttttttttttgtctgaaagaattccaatattatgagcatgtaatataaacaaaggtagtgctttaatctattgggaaaaggatgaattatttaatcactagcaatgacatggagggagaaaatcaatatgaaccaatggagcctcttttataaaggcactaattcaccccctgatatggtttagctatgtcccgacccaaatctcatcttgaattgtagttcccataatccccacatattgtgggaaggactatgtgggagatgactgaatcatgggggtggttacccctgtgctgctgttctcattatagtgagtgagttctcacaagatctgatgattttataaggggctttttcctgttttgctgggcactcctccttcctgccaccatatgaagaaggacatgtttgcttgcccttctgccatgattgtgaggcctccgcagccatatggaactgtgattcaattaaatgtctttcctttataaattacccagtctcaggtacgtctttattagcagtgtgtgaacaaactaatacagtaaattggtactggtagagtgaggtgctactgtaaagatacctgaaaatgtggaagcaactttggaactggtgaacagggagaggctggaacagtttggagtgctcagaagaagtcaggaagatgtgggaaagtttggaacttcctagagacttgttgaatggctttgaccaaaatgctgatagtgatatggacaataaagtccaggctgacgtggtctcagagggagatgaggagcaaaggagactcttgttatgttttagcaaagagactggtggcattttgctcctgccctagagatttgtggaactttgaacttgagagagacgattttggggcatctggcagaagaactttctaagcagcaaagtgttaaagaggtgacttgggtgctgttaaatgcattcagttttatatattcacaaatatatggtttggaattataacttatctttaaaagggaagcagagcataaaagttcaaaaaatttaaagcctgatgttgcgatagaaaagaaaatctcattttctgaagagaaattcaagccagctgcagaaatttgcataagtaacaagaaagccaaatgttaatcaccaaaacaatggggaaaatatctccacggcatgtcagaggtcttcatggcagcccctccaatcacaggcccagagggcctatgaggaaaaggtgtttttttgggctgggcccagggccttgctgctttgtgcagtcttgagacttggtgccctgtgtcccagccatggctaaaagaggccaatgtagagttcaggccattgcttcagagggtgcaagccccaagccttggaggcttccacatggtgttgagcctgcaggtgcacagaagtcaagaattgaggtttgggaacctccccctggatttcagagtatgtatggaaatgcctggatgtgcaggtagaggtgtgctgcaggggtggggccctcatggagaacctctgctagggcagtgtggaaaggaaatgtgggattgtagcctccacacagtgtccccactagggcactgcctagtggagctgtgagaagaaggccattgctctccagactccagaatggtagatctactgacagctttcatcgtgcaactagaaatgccacagactttcaatgctagtccatgaaagcaactgggaggggagctttaccctgcaaagccaaaggagcagagctgcccaaggccatgggaacccacctcttgcatcagcgtgacctggatgtgagacatggagatcaaggagataattttggaactttaaggtttaatgactgtccactagattttggacttgcatggagcctgtagccccttggttttggccaatttctcccatttggaatgggtatatttacctaatgcctgtacccccattgtatctaggaaataactaacttgcttttgattttacaggttcataggtggaagggacttgccttgtctcagatgagactttggactgtggacttttgagttaatgctgaaatgagttaagactttgggggactattgggaaggcatgtttgtgctttgacatgtgaggacctgagatttgggagaggccaggagtggactgatatggtttggctgtgtccccacctaaatctcatcttgaattgtagttcccataatccctgtgtgggatcatgtgggagatgactgaatcacaggggtggttaccccatgttgctgttctcattatagtgagtgagttggttttataaggggcttgtcctctttttgctgggcacttcttcctgccgccatatgaagaaggacatgtttgcttccccttctgccaggattgtgaggcctccccagccatgtggaactgtgagtcaattaaacctctttcctttttaaattacccagtcagctatgtctttatcagcagtgggagaatgaactaatacacccccgaaggccctacctaatataatcacattgataattaggttttcaacatataaatttggctggtggtggtggggaggtcataaacattcagtccatagcatgcagataaatttaggagtctagaattcaaaagagacgtctgggctggctgtataaagatgggaatcatcaatgtttagatggtacttcaagctaggaggttggatgaaatcaccatgggagttaaggtaggtagagaagaggtctgagaatagagctctggactgttacaggagatggtgaggcactaggaaatgaaaataagaagggctggccagtgaattaggagaggactaagagaactagggacctagaatttaagaaagtatttctagaaaggggcagtgaccatccttatgaaaagctgctgatatgccacgaaatctgaggccagaggattgtccactggatttagtagcaaggaggttactggtgccctgaactggagctgtttagatggagaggtggaggtgaacactgggaggtctggatttaagtgagaatgagatgaggcagcaggagtgttgactccttcaaggagttttgctgtaaagaggaatagaaaatggagtagtagatgagggagattgtgggcttggaaggggatacttttagagatatgacagtatgtttgagggctgcagagaatgatctagagcctgagaaacattgatgagggaggagagagatgagacaactgctagaaggaagcacttgagttgggaaatgaggaaggcatcgagtgcacaaatagagaggctgttcttgtgcaggagtgatagcagagcccacagaatgagtgcaggtgtgcgggagcctgtggtggcttggtctgtggatgaaccttctgactgcttccgttttctcagtgaaatgggaagcaaggtcatcagctggcagggaggaagggggaagaggtgttggaaatttgaggagagaagagaaggtgtgaaataatcctctcagacagttcaggagtaattgatctaaggcaatgcagtcagatttctggatacctccaacggctcccctgtgattagggatcttgaatttaaataagagcagacagtagaaatcaggtcttgggtgtgtctccagtgttttcaactcaataggtgcaagtacaggtaggcaaagtattggatttaatctgagttgggcttttgccagctgagtatgacagagagagaggggtgcaagggaattgagggtgtggactgtgggtatgatgatggttattgatcatagaatctgaaagctggtcagagagggacatgaggtgggtgcggggcagtgaaggggtggtagaaagagtgctatgctttatttgacttaacaaactggactccttattataaattcaatcacatttctaatgcatggtggaaagttagtatgttaaaaaaaatagtacatttttatatgttaaatatcctatataatagtaataattatctgctgtgttgctgtttttattatattctttttctttatgtttttagagatggagtcttgctctgttgtccaggctggaatgcagtaccatgatcatagctcactgcagccttgaagtcctgggctcaagcaatcctcctgcctcagccaactaagtagctgtgactacaggtgtgtgccaccatgcctggctaattaaaaaaaattattttagagacggtggcttgctatgttgctgaagctggtctcaaactcctggcctcaagccatcctcctacctcagcctcccaaatagctgagattataggcatgagccactgtacccaggtatattgtattttcttaaagcaagtcatggtatacctgaaagaaaccaaatataaggcactgtagatgaatcccagtgctgttggcagaagggacagggaggccacatgtgaaccaggggtcactggccctgccccaaaggctggacttgaatatgcagctggtgccactggctaacagagccacagtctcggtcacaataatagaactgttgacccatgaggtttctggtcataggggcagaaactgccaacagggagagggcagctggccatctgaagccaggatctgtcccatccaggaaaggagaattggcaggagttggggacatcttgccatgggtgaatactcctctgagaagggagaagggaggaggcagcttacagacagaaccatgagggagggacaacatggagcccaaagccctgctcctgagttgctgggtctggatctcggggtcagggttgtttgtgagattggagaggcagcagaagtagcccagatgaaagggaagaacctgggttggtctctttgctgggcaaactctttgcaccacagtctgggctggctcaggcattggataggagtgagcctgagggtgggggtactgacccatccagcggcacaatttgggaaaggaaggggcagaagaagcaaggcgcggctgatgaggaacatctgctctcttcccacagtgcagatggaaggcctaaatgccagcacaccgtttatttcactttggcaaaatccatgtttatttcatccctcacctcattgtctagacttaacataaatcaggacagtgcaaatggaaaccacaggtccttctcttggccttgccagctttattcttccctagggcaggtgcgcatgttgcattagtgtcataaggtggcatgagactgtaccaggccattagtcctgattctgatccagcagcatcactgccttgctccgtgatcttcccatgtttgagtcacctcatccttgatatggaaggggcagtacctgttctctcagtagcataagataagaggtagggaagtgcttgggaaaatgcaataaaagacactgctggaagccttcagcagtaggttgggttacagaggtcttggccttgcaaaatgaagtgaggtcagcacagattaagcagaccaaatcaaatctttgatggttgagtgatttttaaaaatgattgcaggtctgcacaatttaacaagactgcccatagcagctgaaaacatttccagagcagatcagataaagccaagttagaaattggtcattgctgtaaatcaagtggcagactatcaatgacctagattaccccagttttcccacaggaagtgaaaggaaaaccactgtgtggctgctgaggcttgatttgtcaagagctgagagagctacacaacattaaaagattgcccatttctcagcttgccctaatgaattgggactcatttaattcagaagctgatgagatgtctaaatcacatctatagaataagtggtcagatttaaactccagttgccaacaatctgtaacggcctctggttgcgttgttcatctcttagttaataaatgcttggctttttgctgaagctgccgctttttaatgtctaacaccatgacgtcagcatttttcccattttctgccctccctttaaggaggtagggatgagaaatggtaagaagatagggcttgttatgggtcttgacttggaagacccagagcatgggtcttgaagtagaaccttgatggctcttttctgtctgtgctgcaggtttaggggcctgcatttagactggcccataactatgggagctgctcccagccatcctagacttctcaagaagcccataactcttaggaagaactaagagcctaactcgtgttgtcctggacttttcaagaagccgataactcctaggtagaaccaggaacccaactctactcgtctgtcctacgtagggtctacaaggcagtgtaacacaccacgccctgcaccctaactgatcatagtcagccgtggtgaccacaggatggttcatccttcttgctggttcccagcatccttcttgctggttcgcatgtgctcttttggcacttatcactcccacattctggactcctggccctgcagttgactttgaccctacctttggccctttgaatttgtgcaaataccactgctgagctgacttgactcattctccagctcccactaccgtttgcagtgaaggtttgtaatgcccttgatgagaatgaagctcccagtttcacattgggacacagtgggtaagcaaatgccacacaaaagaaggcacatagtgcacacttgtaccatcatctaacgtctgcatggttctattgcagggctatactttcttatcggtagatacatggaaatggaaatgcacctgcttttaaatatatacttaatgcacaagtgtcaatgatatagttttcacctgaagaaaatctagagccatcaaagtacagggcgagacatactatatgagcctgaacgattgtggcaggattctaagaatctggatgatgaatctgaagaactctgtaacaaacagatgcaaagatgccatatttagacctcagaggaagtgagcctcctgtcactgggagaatccattcattctcctgattcactcatatgcagaataagtgttgatggccttctgtgtgctagggattcaaggacagtgcagtggaaaagatgggctagtacggaggatttagaaggtggtgtgggacaataagtactctgatagagaagcatgtggtgctctcagaagtaacttgtccatgatcacaaaccagtaagtggcaatttaattttgaacacatgtatatctgacaccaagactcatctatcaaccattaagctatatcattgcataagcagttccctgtaactggattggaaggtttgagataatggtgagaatggtgagaaagaatgatggagagatggactgtcttgtatgccattttaggtagagtttggattttatcctgtgggtcatgggaatctctcaggaagtgatctagttggatatgcatttttgagagagtactccactgtagtatatgaagtaatttgaattgggagggatggggagtgggcagtaagaccactcagaggtggctatcttgatactgatccaagaatgaaatagggatagactgacatgagagagtggctgtggagatggtgaagaaggcatggatttgatagttatgtggttgaattgctggaacttggtactgattgagtaaagggtgagaggtatggagaaataaagttgatagccatgtttccagcatagacaaggggatggttgatgttgaacatggaaagagggacatattttggggaaaagtgatgagtttattttggacatgttgagatcataataccttcggaatatacatgtgagatgcctgataggaaataacatgtaggtatggaattcaggaaggagatctggttttggggacttcagtaaatctgcatcaaatagtaactttagccatggatgtgaatgaggctatccagggaaagaatgcaaaatataaggtcaacctggtgactcactgtgctgagggaagccagggaagcagaaggggagtcagggtagacagaaacaggggggtaggtgaagatgaaagaactttccaggaaggagggagtgatgcatggtgccaaatgccactgacaggcaatggtacacattctaaaaagtgtccattgaacataccaactagaaggtaactggtggccctcacaagaatggaaaagcaggttcagtgaggttgtggagtgtggagttcagctgagaggaagttggggattaaatgaagtctttgtctccctaagtggtgtggctgtgaaggaaagaagagaagtaagtcttagctagagagggcataggatttgcatggattgttttaagaagaggaagtctaaattcttaggtgaaggagttaggagaaaatagtgaaagaggtgaaatgcaggtgagtggaggataaatgatggtatggggtccctgagaggtcagggcatgatggaattcaaggtactggttattagcctttttatgtacaaacaaaaaagatattgatgttctatttatgctaagtatgggcttgtcctggggagaaagtatctttaactgaagctagagagttgacaaggaacatgtacaaagatccctggacagtgttgagagctcagataaggttggagaccacagatttgtagtgtcgttctcctacactccagggcaccttatgtaggtgtttgatcttgggaaatgagactgtgcttagctctcatttgggatttttgccagatacctggatgtagccaaaggacgaggaggcaagattgttgaggatataggaagacagtgcagtgattggaatggattgttcacatgatcttaggcgaaaagacataaaaatgaagacaggagggctatgatggactgggataagatagaggaagctggagattagaagatttgaaaagacccaagagcagaggtgtgaggacaagccagtgagagacagggaaagaggcgaggctgtggttggagtctgggccgctgcacctaaacagttccacatttagtgatgaggccagatttcagccctgagtgcagatcgttgaggagagtgaagatcaaggtcatcagagttgaggttttcaggaaactgtgggaatagggttgaatgagtcatgaacacaaacactgaagtcaccccggatgatggtgggatttcatatagctcctgtgagccaaggaatgaagtcatcagtggatgtacggaagtgaccagaagatcagctggggacagagttaaggagagagggaacaagggaacagatgagactttttccatgagggcagaggagtcatggtctggaaatgacatgaaggagaaagaaaagtgccaaacccacttcctgatcctaatgccatctggcttaagagcccatattcattgagtctgaaatgcaacggacaactaccagtttgtctggaggcggtacaaatactcttctaatatttttttaaaaactataggatgtagtctattttcaactttattcaaccagatttatttacccctaccgagttttctaaatcagtgaatcagtattttaaggaataaatcttaggcacataaaatgataggaataaaatatgtattataaagcttctttaatcaatacaagctattcttataagtctattggttaatgtctagattgccgtgcccacttaaaatgggaaaacattccagttggcactttgtggatgttgagttgctacttggacacagttactggccttttggtctgatcagaggccaattttgagctaggagtttcccatgcatatgcatgatgtcctactatctgtgatacatgctgggcatctgagcctgcctggtatgctaatgatcagaccagggaaatgcacatcactgtgagtcacaagggtagcacgtctaatctaaaaaattcaaacccctataattagagttcagatgtcttcatagctctattcctcagatttttttgatctgaaaaacaaaagcaaacaacaaacaattgtgtaaaaatagacagtctaggcttgtgtaaatttgcagtggaaatctgcctctctgatgagccatacagtgtctatgggttgaaaaacgaaattcagaaagcaaatagttggtcaccttagagcccagagggatgctcagaattccctaacctcacagcggtgactactgaaagtttcattctgttttatgacttgacttgcagcgaggaaggtagcacagctgtaaaccagctgtattttatttacgcttggaaacagggcccctttgttccaaatgttcctggccccctccctcaatttcatggatttaggttgttagtggaaaagtagttgttgaaatatcagttcactcttggaacctgccactcaccaggacttctggcaaccagtgagcctttttgtgatatgcagcaaggtaaagaagtcgttaagtggatctcccacatgttcctctgtgacttcattcatagaaatgcgctgataactgagttacattaagcgcagtcttcccagctgtctgaggacataagggatgtagcgcctcctagtggagggaatttcttagcatgtgttcaaccccgcacatatttttggaatgaggcaaggtatttaaaaatagtgtacgctaatgaatgtatttattatatctgggtagcagcgaaacagaaaaggtataaataagcctttcgaaaaatgtacttgctacacaatctctttttttttgacaagtcagcccttgaatacaaataatcttttaatggtgaaaaaaatgactgaatcatagcatcttataaacataggagctatgggtatcaataacatggaaactgaagctgtggttatttttgagtggaagaagagggattaaaattggcgtggggcacatggagaggcttctggaagtggctagcaatttctatttatttttaactgggtggtgattacaaaggtgtttgccttataaaaattcatttagctaaacattggttttatgatgcttctgtatctgtattgataagaaggtaaaaaacataaaaacttttcattaaacatactacctgctaaatttgctttttaaggaaaaacctcaaaaatgctaagccatgtatactttttatttttagagatggagtctcactgtgttgcccaggctgaactcaaactcctgggattaagggtttctcttgagtagttgggactacgggcgtgcctggcatggttttgacactttatttcactgtactttcgaaataagacttaggtaccagtgaacacctacattgacaggcctggtaatatcattaaaacttgagcttttatgttgtctgtggcacagactctcttctttctagttcttcagagaactccaaattcagtatttcacttggaacatccagttgccatagaaatgaccatgtaggttacaagttcatttttgtaaccagtcaaaaggagaaactaagaatgacacgaaggcatctttccattggaaaaaaatcctttgcagagtcccaatttgagaaaaaatacattttgctttagaagtgagaggcgaacagatgaattagtaatgctgaaatatttgactccttcccccacaggtgaaaactcctgcagagcatcttataagaaaaattattttagagcaatataggtgatggcaaattgacattgggttgtaatattctatccaacatagtttaattctgagttattcaatcataactaaatttattcaagacatagaatacatttaaaaattcatcttaaaggaaatttcacaaaggcttttacattcgtgtaatccagatgagaaatgaagatagggggcgagcaacaaagttgaaagacccaaattgattccggaaggacttgccaagtttctataatgcctcattagctgcttatgtggcagggagacctgggaagagcaataactcttttctaggttctcaggttagggaatgagattttgacgtggccaatatgatcttatatgtccatttatgtcttttaccttatcattttcttttaccttatcatggacagagtggccccccagaagcacaggatgcaagacaacacacatttcagtggctgctccttctgcatacatcattgagctctgccaagggtttgaacacacacacacgtaaataaaggcctaattatgtgtgtgtgtgtatgtgtgtgtgtgtgtgtgtgtgtgtgtgtattatatgtattaagctctttttcctttctccatagcactgcatatacaaagatcagccaccctgagttgaaataaactgtcatgatctgtttggcattgtgagatcaccactcatcataaaataagctttttaaaatgttaaaattgaagtgagagcatgagcacaaagaaacaaggaccagaaggtgtttataatcatgaaaaattgggaacaattcaataggaaaacaggaaaatggttaaatatgatatgttcggagtatggaatatgatgcagcagttacaagtagtaaaatagatcagtatgtactgacatgaagaaaatagacttacacataccttatgtaaaggaggtgaggaaaaggaacaatggtcttttctgtattattagaatttgaatatcaaaattggattcatatattacttatataattaaaaaattaagttagtcagacttagaactctttgaaatctaatttttgaaagttaatttatgccatctggaggcaaacatgccaatgtgattgaagtttcagtggtaacctgaatcctcagtctcgttgcacatttactctgaagacattctcaaaagagaattggagaggaaatccacccagtgtgtcccctcatgtatgtctgtctgggatgctccagtggtgagatgccgtcacctcagtccattgtgttagtttattgcaatgttctagggttcagtctcagccccattcctgccaactgttagcttaaggcccttgggcaaaggagataaaattgttcagggccaacagatctcagagtttcttggaaccttaaaaggagatgacccaaacatttcttattcaagatgccaccagctccagtcactcacagtgacttgccacaggggctggtgatgttagctgcttccttggcgtctgagttctggcttgtgagcagatcttatgcccaatacatcagaaactccatgtctccttcagttgtagtcgttgggagaatccatgggttgactggagcctaaggaaagcaccaaaaagtcactagaggcactggagtggatatgaccttttcctttgaacagcagtttgcacaacatataccggtggctttgtagatctggttttcattaccatttctgtcctggggcagccatggaagccacctggatatttcaattagtgcagcaagctggaattcatttactttagagtctactgcctgaagcttctcccagctgggcacccaactacgcccaggaacttctagatataacacagcatcctgatttcagtctaataagtagatctattttagtcttctcaatttccagtcattttgaaagtgctcccctgtccccataccaggcatgggttccattcccaacttctatcactgtcagtggaggtggcagccttgtgagctgccaggtgggaccaggtgcaacccacagcaaggccacttgatgtctcagtctgtagagtaggtgcttaataattgtctttgacgagttaatgggtgcagcacaccaacatggcgcatgtatacatatgtaacaaacctgcacattgtacacatgtaccctagaactgaaattataatgaaacaacaacaacaacaacaacaaaataataataataattgtctttgaatggctgactgaaagcacattcatattatctagtcaaatgaatgtccaccctccactatagagcctttgtaactgagctactggggtctacctcatttcagaatccctcagagtccatggtgtatccattcatgcattcattgagcaaatattatgtacctgttctgtgttagagaatatttgaagtggtgggaatatagtggtgagaaaggcatgtttctgccttcaagacatcaccatatgaaagatactctgggatggatggagggtgttaatagaaccccagcaaattgacaaggtggctccccctgtgtcctctggctagtaagggactggtggctccatgaaacagggagctgccctgtgctgcccaaggctccagccctgcttcctcctcatctcccccctggacgtgactctgcctcatggggagcccattctcttagggatctttgtaaactgatcttcttgtgtcaaaaacatcaaatgcctcagattccattgcttataataagcactttgggaccaaaggaattttttgtaatgaaaaaaacagtttttcataagttaatgtttttcctttgagacctggatgcccttctcttattcatccactgcccatgcagctaatcagatttgaagggtaaaataataccagacttatcattgcatgttacatgagaaatgtattagttaggagtctggggttctaaggcatagagacagcatgagctagctcaaggaaaaaggggagggaattgttataagggcacaggggtgccccacagaatcgaaaacagaaatgtgactaggcctaaggaaagcgtcaaaaagtcactagattttttttctctctttcatctctcttcccatcttccccatccatctatccatccatccatccatccatccatccatccatccatctatccatccatctctctttccttctctccttcccagctcctgcctctgtatttcttcctccttttttcttccaactttcatttcaggttcaaggggtatatgtgtgcatttcttatatgggtaaattgcatgtcacggggggttggtgtacagattactttgtcacccaggtaataagcatagtacctgaaggtactttttggacctcacccttttcccaccttctaccctcaagtaagccctggtgtctgttgttcccttctttttgtccatggtatactcagtgtttagctcccacttataaatgagaacatgttgtgttggtttttggttcctgtgttagttcacttaggacaacagcctccagctctatctatgttgctgcaaaggacatgatctcattattttttatggctgtgttgtattccacggtgtatatgtaccacattgatgtccaccattgatgggcatttgggttgattccatgtctttgctgttgtgaacagtgctgtgatgaacatatgtgtgcatgtgtctttatggtagaatgatgtatattcctttgggtagatacccagaaatgggattgctgggtcgaatggtagctctgttttaagttctttgagaaatctccaaactgcttgccatagtccgcctctgtatttcttcctccacctagcttcctctgctttctggtccatgaggtcaatcaaatagggttgccccatagtgtctaagttttcatgtcaccagcccagccacatcagagagactctcgtcagatcagctatggccagaggtcatattgttccatagtggttcctggatgcagattaacttccagcgaaaagggacacattttgagcaggacagacatggccaaagctatctaatatgcccaagtctacacacacagacacatgcccaaatccctctcatggctacacatccaaccagagatggtcaaatggaccctgccctgaacccacatgggaggatatggttctgacttgagctgcaggatcccagggcttgtgttgaggtgggaacagccctggacctgagccagaatactggggctccagtcatggcttcaccattaaacaactctagagtcttaaacaagttcttagcctgtctgagtctttattttctgtataaactgggagtcacagaggcagctttcaattatttaaaggaccactttatgggagggggataggtgtgttacctgtctagtgttggaaggtgaaaccacagtggagaccacagagtggcaatttgtggctggagatacagaagaaccttctcccaatcaggctgccccaccatgttcaacctgcctgccttgcagagagttggctctccctgttactgtgggaaatccaaggggtctcagaaaacatctacagaatggagatactggcccatttcctagcaggattatctgtgtttgtctgggggtgaggggagtaaatagaagtttgagtgctacatacaaatgtgtattttttgcattgtaatcttaacaaacagaaagaagtattttgctccagtttgtatattctttcaaagcctttgaaccacactttatttttttagacaggatctcactctggcgcccaggctggggtgcggtgttgtgatcatggctcactacagcctcaacctcccccagctcaggtgatcctcctgcctcagactcccaagtatctgggactacaggcacataccactatgcctggctgatttttgtatttttgtagagacagggtctcactgtgttgcccaggctggtctcaaactcctaggctcaagtgatcctcccatctctgcctcccaaagccctaggattacaggtgtgagccactgtgcccagctgaagcacactttttagtgtgtctgccacaagggtttccaaggccactagctggcagaaggataaggtggaaatgtaaatgacatgcccctctcttcatgaaaacaatgtcagttgttcctctcagtccccaccataacagtttctgaaattctttctcacctccttcacttatttatcctttctgctccctgctagactgctaggggtggggacaggagtgatgtctgatcaccactgcctctgtgaccataacctctgatactgtcatttcttctttccaaagtcttggctatcatttgaggagctgagacaataggatagttctgctttcacagagcatattagcaaataccctgtgtgaggccctaatgacatatttggccctttccatctttggggctgtaatattccctacagatggaccctttggttaagtctccttatgttgcttttagttttcatcaatctctggttggtttttagaactactaaatggagccattaggtcattcaaaaacaggcagatgtatgtatgtttgtgagccatgatagggatccagaaatatttacataattttcatctattaagagatttaacagctgtgtctgccatgtagttactttaaaatataaaatgcaaggtcagatctcttggggatactgttttgtttttcttttcttatgattgctgttaacgatgtcatgtttaagtaaggaaagaaggttttgatattcctctaagagttaccagcctgtggaggagttgtgctccaagaggatcgaaggcttagaattcaaatgtaaaagtgtttaccttcttaggccagtcatctgatcaacacgtaatgtagctgaattagtacacatttccaaagaatttacgaaacaagacaccttgcaaaactagcagtcaaataaaacagaactctaaaattgaatttaaagtacagttttgtctggctagccatatgtagaaagctgaaactggatcccctccttacaccttatacaaaaattaattcaagatggattaaagacttaaatgttagacctaaaaccataaaaaccctagaagaaaacctaggcaatatctcattcaggacataggcatgggcaaggacttcatgtctaaaacaccaaaagcaatggcaacaaaagccaaaattgacaaatgggatctaattaaactaaagagcttctgcacagcaaaagaaactactatcagagtgaacaggcagcttacagaatgggagaaaatttttgcagcctactcatctgacgaagggctaatatccagaatctacaaagaactcaaacaaatttacaagaaaataacaaacaacccaatcaacaagtgggcgaaggatatgaacagacacttctcaaaagaagacatttatgctgccaaaagacacatgaaaaaatgctcatcatcactggccatcagagaaatgcaaatcaaaaccacaatgagataccatctcacaccagttagaatggcagtcattaaaaagtcagggaacaacaggtgctggagaggatgtgaagaaataggaacacttttacactgttggtgggactgtaaattagttcaaccattgtggaagacagtgtggcgattcctcagggatctagaactagaaataccatttgacccagccatcccattactgggtatatacacaaaggtttataaatcatgctgctataaagacacatgcacacgtatgtttattgtgacactattcacaataggaaagacttggaaccaacccaaatgtccaacaatgatagactggattaagaaaatgtggcacatatgcacaatggaatactatgcagccataaaaaaggatgggttcatgtcctttgtagggacatggatgaagctggaagccatcattctcagcaaactatcgcaaggacaaaaaaccaaacaccacatgttctcactcataggtgggaattgaacaatgagaacacagggacacaggaaggggaacatcacacaccggggcctgttgtgggggtgggggtaggggggagggatagcattaggagatatacctaatgtaaatgatgagttactgggtgcagcacaccaacatggcacatgtatacatatgtaacaaacctgcacgttgtgcacatgtaccctaaaacttaaagtataataaaaataaataaataaataaataaaatacagttttgttttgtatcatgaatattgttgctacttgggaaaaacatgtttaatcaggcactaaaggggcagctgaagtgtttgatggtgattctcaaagggattcttggacccctcaagagttttagaagatagtgatgctagtattttattatgtataattatactgtaaaatacatttttgatacattataattacttctgtttatgacttaggtagtttttgccttgcaaaagggagatagggaaagaaagtttacttaaataattggaagcaaagggggaatgaggagaaagctaatgaagatgtgaatatttgtgaggaaaattgcctgtaagtgtgaatagggtgtgaatggagagtggatgtgtctggcagcacctcttcttattcttatcatcttactggggtgattgaagttgcaaacacatggcccttcacttcttttgtaaacggacataattgatccaacacagcatgattgctttctagtgcagcaattttcagaatactgccttctcaaagatatggttctcctgattgattatgaaatgagataaaaatataagtccttggtttaataagtgatgaacaagcccataaaatactaggtttttacttttgctagagtaatctactaagtgagttattaagggcctttctgaactcaagttagtgtgtcaccatagactctaattagtctgaggactctaattagttctgctaaaaagtctcactgctattcggtgacaaagctcctataatgtggcatgcatgtaggcagttgtagtttccaaaaaagaaagaagtaggtggagcataggatgctcaaagtagacaatgatcaaagacttttgagagtcatcagtctaggaaagttattctcaaccctggctgggtatcagaattgtctgtagtgcttctaagaattatgagttatggccagacgcggtggctcatgactgtaatcccagcactttgggaggccaaggcgggtggattacaaggagtttgagagcagcctccccaatatggtgaaaccccttccctactcaaaatacaaaaattagccaggcatggtggggtatgcctgtagtcccagctactcaggaggctgaggcagaaaaatcgcttgaacctgggaggcagaggttgcagtgagccgggatcgcaccactgcactccagcctgggcgacagagtgagactccgtctaaaaaaagaaaaaaaattatgagttgctggactgcatgatgatctactgaatgagaatccattctccccccagtaaacttttcctttatctcctttatctcattggcaggcactcattcacaggtccactcaagacagtcacggacaaaaggaaacaggattgtgaggatttagccccatggggctagagcactgctactgaaaaaaaaccaccctaactatatttgcagctttacggtgtgtaaaacttcagtttaaaaacaaaagggaaaaaaggtctctgccttcaaagattataagctattcattcaaaaagaccaaacattgtaagaaataactggataattaatccataaagggcaagagaagtagagccagcttttattgagtacctgcctacctgtgtgctgtgtgctgtgtgctgggtgagtactttatatatgtcacttcctttaatcctcattttaatcttcagaggtcagtagtgtcactggcattctacagattaaaatactgtagttgagggaatttaggggatttgaattgcatttcctctctagaatggggtgagacagaagtggtgtccttctttcaggcatctaggtttgtttctttggggtgtgtatgtgtgtatgtttccatgtgtgtggcagcttaccaggctatgtcccaattaataaggagatgtatcatcctcattccagtttttcaaatgtgacttgaccaaaatgcattctattcctattctttgagtttatatgccagaaatggagtgggcatgtgtgtcttctcaggactaatccatgcatgaagctctttgaatcagcacaatattgtacagcctagttgcgttctgttcatcaagcatcggtcgatgatttattgacaatgcaaacaagtggtctgttcatgtgagttcatgatgatttgtgagtgcttcctgcccatctgctctctcattttaagtgtgctctgtaatataaaaatgatagtcatacaataattctattggggtagatctgtaccactacccagagatatttgtttgacttttactattattttacaaaatgggaatttctttcacaaagaagatgagttcattgtactttggctttttgtaagagaaagtgaatgttgtgacactgacatgaataaatgaattcatgttttctgatcccgtggaaaggaaagaatagaataatatcagcacgtggatctcataatgaaaggggagtaaagtgagtcttcagaaacagacttaaaataagctcaattcattgtaattagaaaatggatcttgaaagggccttgccaaaaggcgatgatgtgatgttggggtgtagaagttttttgacagtggactcttttatcacagaatgtgaggtgaggcagaggaaatatgattcatgttatagtgctttagttattgattacataggagtttgctttctccagctcttgttcatagctgctaactggcatacagaggaaatattgtttacttatttaaataatttttaagatagtgaaaattctgtatgtttggttaaattatacttggttgtttgcataggctgtctctccctgagacgctcacctcacttctctatgggtcagcgaaacacataccctgtgtaatcacctcccctataaaaccccatggcaacctcttccaacaattcatcctttgcattccatccaagtatgtcttgttatatccatagcatttagtgcatttattatttcctctcctgctttcctctactagattttgagagccttaaggactagagagtgactgattcatccttgtttccccagcaccctggagcaaagagcccagcacatagtagttgcttgtggtgaatgtaattcagggtgtcttaggactatcctgctcattatgaatagaggataaaaacagatttctaagttctccatctgccataaaattctgggaagaaaaaatatgaagtattcctttctgcacacacagaagtcttccattttgcaattttctatctagtctgctgtcctttctctctcttctttatcagggctacacatcctctctcctggccagagcgtcatttgaggcgtgcttatgcagttctcattgtcttcaattaaggtttgggactgagattaccagcttggcttggtaaccctgttcacttattaaaaaatcagtcgatccttcatttttatgaaaagatgcaatgcaaaataaccttgatttagaatttaatgaggctgacatttaacctgagttcagttaggaagacaaacaaaaaacacagacaaagttgagagaaggaaaataattacctacttgaatagtgtgggcaattctccatccatatgccccaggagaatatgaggtgggagatgcatgaattacctgaaatttcttttagcctctgtttatgattttagtctttcaagatgcaggtatgtttttcaggccttgtggtccccaaacacaaggaaactttctttatctgatggtcaaaagaagtgacgacctagtccttagtaggagaaaaatgtgcctgcatggactctttgtgagacagtgttgttggatactttatgaacattttaagggattctcatgagtaattttgattatagacgatttttactttatgcattgactaggaaccaaatgcaactttcttagagagacacaaaattcattgtccaaatagaccatagggtcagcaggctttgtaaacatgttttgtatgtgcctaggggttgagagcaggggcgggagaggttctggtccgttcatcaaaccaggggctggtgttaatgtttgatcaacaaaacacatgtaggcctaggctctgatctaggtccaactgccaacatagccttttcatgcctgcctttcctacttcaggtagagagaggagaaaaaacctattgaggaaaaaagaaagaataatattagcccaagcagtggttctactcacttaaggagaatggagtatgtttatttaattttaactgaaaagtcctggccaatatttctaagcctggcttgggataacagaatgaatggccttgggggagagggaggagaaagaagatgactgattttagtgtctgctttatggtgtgtgctgtttaatcctcatgacaatcctaagtggaaggaagaactccccatgttaccagtgacgcagcggaagcccaggtgctactgaaggtcacgcagtcagcattgacgaagtctacactagaatccaggcctgacacaacccaaagtctgtattttttccctctgcagtctcttaaaattggcaaaaggtaaaccttcatgcgaccctagatttgattggaacagcagatttaggggtcatgcaacaggagaatgagtggattataagtttttgagtccccagatctttggggagaaaacccaattctgttgaagtaggagctgttcaattggaggtgagatttttagtagggatttctaatgcattcttttttcccattgatggttgttaatacttcccctacacacacacacacacacacacacacacacacacacacacaagcataaatagggcacacgtattctcccatgtaagggctgctgtcccttctccctcccacttatagcgatgtgtgcctctctgtagctgaaggttgccttgtattaggacactgactgatgagtactccccaccagggtccggagagtgtgcttcattcacctttcagcctctcacagttctggcacaggggagataaagatgttgatggtttgaggtgctttttggtaaataacataggcaaacacttgacacccctaggctaccacctgtcctgttgtgtggatacctattcagtgaagccagataacttttacaaatcacaatgaatacatcctcagcagagccagttgcctgagggaggttactgaatcttctgggagtcgtttgcaggcctttagacactgggctcctttctggaccatgcccaaactagtgacagatgcagtcagagtagcagaataaggaagtctaaagtcacccaagcctcttagttcttgataattgacatgtccagcatttcttgaccatcagtagaaaatactaaactttacagtacataaaataatcaattcattcctctgatggggcaactatttaagtcagtatggaactctatctttctgattgctgcattagtccctttttttttgtttattttgcttcttagtagaaaagaaaaatctaaaagattctcattttaagtgacttgagctatcagttaaattttaaaagccaattattttgaagcagtagagccttacgaattctaaagtcacacactggaagccaaactatctagagtataaatatttccttttgagggggatactgacagattcttctattttatcccaattccagttcctgacctccactcacagacagggaggcaaggggaaggctcactaattggcaaggctggacaagcataaaggattcagtgcataaagaatcaagcttctgatcctctcaagaggtcacacgcagagtgtctatgtgctggacagctttggctgtacacaccagaagtgttccaggcgtaaggtttttggcaagtctcgttgcctacgttcaagtcctctctgagtcgcttactagtgtgtaaacatagctgagatatataatgtttctaagcctcagtttcactgtctgtaaaatggcaatgacaataactgtacccacctcacaaggatgctgtgttgtgaggtgtgaacgagccatttgtgtcagaacatagcacagtgctgggctcacactaagcattccattcatgtcagctactagctctttggaacttttcaactttggtccctagggctacattaaccctctttcctgccagacaataatctgaggttggttgctgctttcagaagaaacagtgtttgaaagctaagaaaaatgtacctagaaatctaatttctaatttcattgtcatgccttaacagaacacccagatgccttaaaagacttttacaaaatgcaaatttctgatccagaaaacttctcagccatagtgccaaagaacattatcagacccaattccctatatcccaacaaaaccactccccagtcacagattatccgacacaatttcattggggttctcaaatggcaagagtttgtttaaaatgcaaatctctgagccccaccctcagagaggccagcggggcagtggaatatgcactgaacacttcgggcactaactcgtgtgccaatggttgcacttggacatatactactctaggcctttgggctcctttcgtccctgcagcaccttctgtcctcaagacaggggctctcttgttttcctcatgcgagagctgttgcccagctagtccatcccactgaggacaaactctgactcaccttttaagatgtagttctctggctaggcacagtggctcacacctgtaatcccagcactttgggaggccgaggcaggtggatcacgaggtcaggagtttgagaccagcctgaccaacatggtgaaaccctgtctctactaaaaatacaaaaattatctgggtgtggtggcacacacctgtaatctcagctactcaggaggctgaggcaggagaattgcttgaacctgggaggcggaagttgcagtaagccgggatcacgccactgcactccagcctgggcgacagagtgagcctctttctcaaaaacaaaaaagaaaaaataaaacatgaagttcccaaccatgtgctgtgtagtgagcaccatggtggccctgcagtgtacaaaggtgaattggccatggtgtgtgttggcatggagctcccagtccagctaagaatacccttcagggccaagctgactccaccctgtttcctgaggcccagtcagcggtcccagcttctggtctgtgggctcacctagtttaaagacccccttgagcctcaaaggatgttcgaagcatgattcagttggggagttattggtcaacatggtgggacaattcttcactgtgtgggactgccctaaacagtacagggtacttagcatgtctgccctcccaatgctgagtaccagtggtgctccacagtcactgtgacaatcaagaaaagtaatgattgccacatgtttctgaatacccctgacctctggggaataatactgccccaagttgagagcctctgtccggtttaggtctttctcctcagtccatacctctgctacctccttaagggaccagttccctccaaggggcatgctttcttagaaaagtcatttgatggccgggcacagtggctcacgcctataaacccaggacttcgggaggccaaggcgggcagatcacctgaggtcagaagttcgagaccagtctgaccaacatggtgaaaccccgtctctactaaaaaaataaaaattagcaggacatagtggcatgcacctgtaatctcagctacttggcaggctgaaacacaggaatcgcttgaacctgggaggtggatgttgcagtgagccaagatcacaccactgcattccagcctgggtgacagagcgagactccatttcaaacaaaacaaaacaaaacagaaaagaatgtcatttgacagtgtacaaagtttatatattttaacatacaaatgaagttgacatggtatcaaccaaagggaaagaagggccattttgtaacaggcagaaaccagttgggatttaagaagcattttaattacccttactttttttctataaaggaaaatacttttatttctttcactgatgtgccggtgagagtcttagcaggcttgcctttgtaggtaaatatgatggcacttcccaatcatcatgtattgggatgtgaagttgtgtggagtctgaggctgacccctggtagtgtgaggaccttgggggattgccttggaaaatacagggtccagcccaaggctctggctttcagggtcgggggttgagatgaatttgtcacagctccgcctgagctcaccacactgggaagtcaaacagaggcaacagcttctgtttgctaagtgttaccacatgctaggcactgtgttgagtatggtgaaggacctcttaaatcttcagaacaaccgacgtttcagcattttacagctgcaaaaactgagtcttagcaaacatggtcttagagccacgagaatggacctgggacttaaatcccaagtctagagcctggacttgaccacagcagcatccagcttctcacccatctttcgctcaattcatccctttaatcatttattttaggattcagtttgattcccccaatctcaaaactttcaaggatgaacaatacttctcacacaaacacaccttctaccgaatgccaggaggggtctgcacttagattcctcagctgtcacagtgccattgagtctgaggctgcctgactgcttggttgtggttttttgacacctggcatttgtgtttaacagccccagtggttgagaagcagaggggacccacactggcagaggtggagggaaagaggagagggtgtagggaaagaggagagggtgtagggaaagaggggagggtgtagggaaagaggagagggtttagggaaagaggagagggtgtaagggaagaggagagggtggagaggtagaggggagggtgggggaaagaggggagggtggagagatggagaggagggtggagggatagaggaaagggtggagggatagaggggaaggtggagggaaagaagagagggtgggggcggttccaagatggccgaataggaacagctccagtctacagctcccagcgtgagcaacacagaagatgggtgatttctgcatttccaactgaggtactgggttcatctcattggggcttgtcggacagtgggtgcaggacagggggtgcagcacattgagcattagccaaagcagggcgaggcatcgcctcacccaggaagcgcaaggggtcagggaattccctttcctagccaagggaatctgtgacagacagcacctggaaaatcgggtcactcccaccctaatactacgcttttccaatggtcttagcaaaaggcacaccaggagattatatcctgcgcctggctcagagggtaccacgcccatggagccttgctcattgctagcacagcagtctgagatcaaactgcaaggcagcagcaaggcttggtgaggggtgcctgccattgctgaggcttgagtaggtaaacaaagtggccgggaagctcgaactgggtggagcccaccgcagctcaaggaggcctgcctgcctcagtagactccatctctgggggcagggcatagctgaacaaaaggcagcagaaacctctgcagacttaaatgtccctgtctgacagctttgaagagagtagtggttctcccagcatggagtttgagatctgagaacggtcagtctgcctcctcaagtgggtccctgatccccgagtagcctaactgggaggcatcccccagtaggggcagactgacacctcacatggccggatacccctctgagatgaagcttccagaggaatgatcaggcagcaacatttgctgttcagcagtattcactgttctgcagcctcggctgctgatacccaggcaaacagggtctggaatggacctccagcaaactccaacagacctgcagctgagggtcctgactgttaaaaggaaaactaacaaacagaaaggacatcgacaccaaaaccacatctgtacgtcaccatcatcaaagaccagaggtagataaaaccacaaagatggggaaaaaacagagcagaaaacctgaaaattctaaaaatcagagtgcccctcctccaccaaaggaatgcagctccttgccagcaatggaacaaagctggacagagaatgactttgatgagttgagagaagaaggcttcagatgatcaaacttctccgagctaaaggaggaagttcaaacccatcgcaaagaagctaaaacccttgaaaaaagattagacaaatggctaactagaataaccagtgtagagaagtccttaaatgacctgatggagctgaaaaccatggcatgagaactacgtggcgaatgcccaagcctcagtagctgattcgatcaactggaagaaagggtatcagtgatggaagatcgaatgaatgaaatgaagtgagaagagaagtttagagaaaaaagagtaaaaagaaatgaacaaagcctccaaggaatgtgcgactatgtgaaaaaaacaaatctacatctgattggtgtacctgaaagtgacggggagaatggaaccaaattggaaaacactctgcaggatattatccaggagaacttccccaacatagcaatgcaggccaacattcaaattcaggaaatacagagaacgccacaaagatactcctcgagaagagcaactccaagacacataattgtcagattcaccaaagttgaaatgaaggaaaaaatgttaagggcagccagagaaaaggtcaggttacccacaaagggaagcccatcagactaacagtggatctctctgcagaaactctacaagccagaagagagtgggggccaatattcaacattcttaaagaaaagaattttcaatgcagaatttcatatccagccaaactaagcttcattagtgaaggagaaataaaatcctttacagagaagcaaatgatgagagattttgtcaccaccaggcctgccctaaaagagctcctgaaggaagcactaaacatggaaaggaagaaccagtaccagccactgcaaaaacatgccaaattgtaaagaccatcgaggctagaaagaaactgcatcaactaacgagcaaaataaccagctaacatcataatgacaggatcaaattcacacatcataatattaaccttaaatgtaaatgggctaaatgctccaagtaaaagacacagactggcaaattagataaagagtcaagacctatcagtgtgctgtattcaggagacccatctcatatgcagagacacacataggctcaaaataaagggatgggggaagatctaccaaggaaatggaaaacaaaaaaaggcaggggttgcaatcctagcctctgataaaacagactttaaaccaacaaaaatcaaaagagacaaagaaggccattacataatggtaaagggatcaattcaacaagaagagctaactatcctaaatatatatgcacccaatacaggagcacccagattcataaaacaagtccttagagacctacgaagagacttagactcccacacaataataatgggagactttaacaccccactatcaacattagacagataacgagacagaaagttagcaaggatatccaggacttgaactcagctctgcaccaagcggacctaatagacatctacagaactctccaccccaaatcaacagaatataattattctcagcaccacatcacacttatttcaaacttgaccacttggttggaagtaaagcactcctcagcaaatgtaaaagaatagaaattataacaaactgtctctcagaccacagtgcaatcaaactagaactcaagattaagaaactcactcaaaactgcacaactacatggaaactgaacaacctgctcctgaatgactactgggtacataatgaaatgaaggcagaagtaaagatgttctttgaaaccaatgagaacaaagacacaacataccagaatctccgggacatatttaaagcagtgtgtagagggaaatttatagcactaaatgcccacaagagaaagcaggaaagatctcaaattgacaccctaacatcacaattaaaagaactagagaagcaagagcaaacacattcaaaagctagcagaaggcaagaaataactaagatcagagcagaactgaaggaaatggagacataaaaaacccttcaaaaaatcaatgaatccaggagctggttttttgaaaagatcaacaaaattgatagaccactagcaagactaataaagaagaaaagagagaagaatcaaatagacgcaacaaaattgataaaggggatgtcaccaccaatcccacagaaatacaaactaccatcagagaatactataaacacctctacacaaataaactagaaaatctagaagaaatggataaattcctaggcacatacacccttgcaagacacatacacccttccaggaagaagttgaatccctgaatagaccaataacaggctctgaaattaaggcaataattaatagcctaccaaccaaaaaaagtccaggaccagacggattcacagccaaattctaccagtggtacaaggaggagctggtaccattccttctgaaacgattccaatgaataggaaaagagggaatccttcctaactcattttatgaggccagcatcatcctgataccaaagcttggcagagacacaacaaaaaaagagaattttagaccaatatccctgatgaacatcgatgcaaaaatcctcaataaaataccggcaaactgaatccagcagcatatcaaaaagcttatccaccatgatcaagtgggcttcatccctgggattcaaggctggttcaacatatgtaaatcaataaacgtaatccagcatataaacagaaccaaagacaaaaaccacatgattatctcaatagatgcagaaaaggcctttgacaaaattcaacagcccttcatgcgaaaaacactaaataaattagatattgatgggacgtatctcaaaataataagggctatttatgacaaacccacagccaatatcatactgaatgggcaaaaactggaagcattccctttgaaaactggcacaagacagggatgccctctctcaccactcctattcaacatagtgttggaagttctggccagggcagtcaggcaggagaaagaaataaagggtattcaattaggaaaagaggaagtcaaattgtccctgtttgcagatgacatgattgtacatttagaaaaccccaaatctccttaagctgataagcaacttcagcaaagtctcaggatacaaaatcagtgtgcaaaattcacaagcattcttatacaccaataacagagagccaaatcatgagtgaactcccattcacaattgcttcaaagagaataaaatacctaagaatccaacttacaagggatgtgaaggacctcttcaaggagagctacaaaccactgctcaacgaaatagaagaggacacaaacaaatggaagaatattccatgctcatggataggaaaaatcaatatcgtgaaaatggtcatactacccaaagtaatttatagattcaatgccatccccatcaagctaccaatgactttcttcatagaattggaaaaaactattttaaagttcatatggaaccaaaaaagagcccgcattgccaagtcaatcttaagccaaaagaacaaaggtggaggcatcacgctacctgacttcaaactatactacaaggctatagtaaccaaaacagcaatggtactggtaccaaaacagagatatagaccaatggaacagaacagagccctcagaaataataccacacatatgcaaccatctgatctttgacaaacctgacaaaaacaagaaatggggaaaggattccctatttaataaatgatgctgggaaaactggctagccatatgtagaaagctgaaactggatcccttccttacaccttatacaaaaattaattcaagatggattaaagacgtaaatggtagacctaaaaccataaaaaaccctagaagaaaacctaggcagtaccattcagcacataggcatgggcaaggacttcatgtctaaaacaccaaaagcaatggcaacagaagccaaaattgacaaatgggatctaattaaactcaagagcttctgcacagcaaaagaaactaccatcagagtgaacaggcaacctacagaatgggagaacatttttgcaatctgctcatctgacaaagggctaatatccagaatctacaaagaactcaaataaatttacaagaaaaaaacaaacaacccaatcaacacgtgggcaaaggatatgaacagacacttctcaaaagaagacatttatgcagccaaaagacacatgaaaaaatgctcatcatcactggccatcagagaaatgcagatcaaaaccacaatgagataccatctcataccagttagaatggcgatcattaaaaagtcaggagacaacaggtgctggagaggatgtggagaaataggaacacttttacactgttggtgggatgtaaactagttcaaccattgtggaagacagtgtggcgatagctcagggatctagaactagaaataccatttgacccagccatcccattactgggtatatacccaaaggattataaattatgctgctacaaagacacatgcacaggtatgtttgttgtgacactattcacaatagcaaagacttggaaccaacccaaagtccatcaatgatagactggattaagaaaatgtggcagatatacaccatggaatactatgctgccataaaaaaggatgagttcatgtcctttttagggacatggatgaagctggaaaccatcattctcagcaaactatcgcagggacaaaaaaccaaacaccgcatgttctcactcataggtgggaattgaacaatgagaacacttggacacaggaaggggaacatcatacactggggcctgttgtggggtgggggtaggggggagggatagcattaggagatatacctaatgtaaatgatgagttaatgggtgcagcacaccaacatggcacatgtatacctatgtagcaaacctgcacgttgtgcacatgtaccctagaacttaaagtataataaaaaaaaaaaagaaaaagggtggagagatggaggggagggtggggggatggagaggagggtggagggaaagaagagagggtagggggaaagagggtagggtgggggggtggagggaaagaggagagggttgggggagagaggggagggtggggggatggaagggagggtggagggaagaggagaggatggaggggtagaggggagggtgaagggaaagaggggagggtgggggatggaggagagggtggagagaaaggagagggtgggggggtggaagggagggtggagggaaaggggagggtggaaagatagaggttagggtggagggaaagaggggagggtggggggatggaggggagggtagagagatagaggagaagttggaaggatagaggggagggtggaagggtagaggggagggtggaaggaaagaggggagggtgagggggatggaggggaagttggagggatagaggggaggtgggaaaaaaagaggcctggagctggtgttaggaggccagggtctaaaccccacttgaaaacctacctggtggatgacatgcacagactctctgggcctcagtttcccattcacatataagatggggaggcctttatccacttccctaagagggttgttgtgacaattcagagcagtgttagagtccaaagtcgggtgaatgcccctggggagtgtacaggaccatcctttatagtgtgagtagaaagtcttagcatttttattttttactcaacaagaaattaggctttacaaatatttgatgtatggatggaccatgacatccacaatcagctgcgtgttctgggcatgtcctcaaagaaagaagggactttgcaaacgggaaggggttgggagctctatcctcattcattcccttgcagcctttgtgatgtttgattgcaatttgccacttctggtgaggcgggtacgcagaatacattatccagcttaaactcaacaaaccctgtttcaacaaactgaagaagtggcttaaaaagttttcatgaattaaaagctaattaaaatctataatgaacaatatccacataaaccaaaaaatggcagagttaacacttcactgggaagaagtttttgttgtcgtcgttgttgaatcagccccagtaagatgtgaaaaaaaaaacagactaatgatatctgacaagaagtcggcccaagaagttcaaaattatcaaggtcaggtgcagtggctcatgcttgtaatcccagctctttgggaggccaaggtgggaggatcacttgaggccaggaatttgcaaccagcctgggcaatatagtgagattccatctctactaaaaatcaaacagttcggtggctcacgcctgtaatcccagcactttgggaggccaatgagggcggatcacctgaggtcgggagttcgagaccagaccgaccaacgtggagaaaccccatctctactaaaaatacaaaatttgccgggcgtggtggcgcatgcttgtaatcccagctactcaggaggctgaggcaggagactcgcttgaacccgggaggtggaggttgcggtgagccgagatcgcgccattgcactccagcctgggcaacaggaatgaaactcggtctcaaaaaaaaaaaaaaaaaaaatcgaacaattagctggatgcttgtagtctcagctactcaggaggctaaagaggatcacctgagcccaggactttggtgctgcagtgagctatgatggcactaccgcactctaacctgggccacagagtgagcccctgtctcaaaaaaaaaaaaaaaaaaaaaaagaagaagactttttgaattaaagaaagatttacatctcctctcattaatagcactattgatttttatttgatttaacacattatttcattgttattacaaattatgtgttttaaatgcctattttgatgtataattctataatgtacacttagttcagtagtacatgtgtattacttgtatttatcatgtgtgaatatatatatatacacacatggtatgtgctcaaaatattttacagattagagtatgtgaaaaaaatttgaagaccactctgcataataaatgtgcaggggctggcccatgagacatgttcagtaaatgcttgtttccatcctctttctccctggaaataaagtcgatagtgtgtgtgtggaccttgcttattaaaggaaagtggctgatttgatttctggaacaaggtgcatctcaaactagctggcagcactacctcggcctggccccatcccagctgttcacaccgagttccagacatttgtaggagcccggacgaggccagctggctgcctatcagtggccttcttctgtcagcactacacagttgtcacggctcacatccaaccgccagacagccaagaaggagacgccaagatttaaatctgcagttcctgacctccgcaaccacacccgattctttggttggtcctagacaaaaacaacggttttgcagatttgggttctctttctcaaactgccttttgatgatttatttgtgagatatgattgctcctcttgcaaatcagagctggttgcagtagctaactaacatttattgagcgagtagtatacccaggcttcagctaagtgctttctggaattatttaattttcacagcaaccatgtagagtaagttctgccactggcaccactttacagataagcgaatggagacttagaaaggttaagtaattttactagaggaacataaactaacagtgaaagtgagaaatctcagagtctcattggtctgacagctatgtaaggaactgaggggatgtaccattgcaaatcgtcaaaatggaaataccccaaatgcaatgcaggactctggatgcgattctggaacaaagaaagaacacttgtgggggaaaaaaaatagtgcaacccagagtctttatttaacagtattgtatcaatgttaatttcttagttttgacaaatgcatcctggttatgtaagatgttaggattatgggaagctgggtaatgaatagatggagagtttctgcactatgtctgtactgtttttgtaaatgtacaatgattccaaaataaaaggtgtatttaagaaacagaaatgccaagtgtatatgtgtgagtacacacgtgctctcacatgtgcatgtgtacagttgtgcatatgtaagtctttgtgcatatgtaagtgccccttgctgcacaccccctgctgttctgtgtgtgctgctccactcaagcccctgggacttacatggatgtcagcgagaaggaagcctacacaactcacatgtgacatgcccgccatgctctcgtcatacctcacctgtgctgtagaacccctgggtcacaggtggcagtcttgttcccccataacaaatgccagaaaatgatgtgtgtgtgtgtgtgtgtgtgtgtgtgcatgtgcacacacgcatgcacgcacacacgctctggtaggggggtttcaggaagtcattcgtgaagatgcagtgtagcatccagaataaaataaccaatttacaccttaaacactcttctccagtaaggccactacagctgcctctgcttactaagtgcatttgaagagtcctctgctttatccgtactctatcctcctgaaaagaggcactgacctgaaagggaagcccaggagcttctaggcccagacttttgctttgtttctcaccatgtgctgtgtcaaaactgagagaatattttgatcaccttttagctaagagctatctcctgggcagcagcttaaggctagagtaaggacatttcacagtttaagagagagcagtcactccgccaaatggctctgaggtggccacaaagtgcttgacttgcaaaaaattgctccattaactagattcagggattttcaggatttatgggctaggctgtgctaatattactgtggtgcttctcagtataattgctagaggcctccagtgagcagaggaattgtgtgttcagtctgtcctgggtgacccttactgcgtagtcctagggagacaaagaaaacccactcaatccaggaggctacagaaatgatgtttgtggagatctcagtgggtatctaatctgtaacctcagggggagaactctagctggtctcagtctttgctggaaacagaacttactggatgtgtgtgtttactcactcattcatttatttgtttatttatttactgtgacagggtcttgctatgttatccaggctattcttgaactcctgagctcaagtgatcctcccacctcatcttccaaagtagctgagattacaggtgcatgctaccacacccagccatcattcatttacttattgagtgtctaccatgcaccagatgcccaggttaagcataaaggatatagagcaggacaatcaaaaagtctcagattcagaaggaggagatggataaaaaccagcaagatctaaagtagataatttgattatgataagcacaaataagcagagaatacattgatgtgatacagagggccatgtggggggcagtgtgattcctttagattgggtgaatcagggtgatggcttttcagttgacattggaagaatgaggaggaaggaggaagaagtggcagccgggtaggacagcaggtcttctctgtcccccgagttcttctgatgtcctgcacagaaacctgaggggtagagtagcaaaggagaaatccaagctcaggctgggaaagaagctcatggcaccaaggttagggcttgtgataacagggacctgcttcaagagaaagggaggtgggtggcagattggtctcatggctgccacccacataattctaaaggtctcccaatgggagaacagccaccctggtaagtgtccagcatcatacaaggagtctctgcccattgtgactcttgcttgagcccccacacttagccctcaccaagctgtgtgatttaggattcaggtgttagaacggagaaggcaccaggcctactgcaccatatcaatgaagcctttgctttggggaaaacagagctgggtacaaataccagtgccacccattcttccctccatgctctggacattcaacccatctgagccttaatcccttcatctgcaaagtaaggaccatgcagtcttcctggtagtgttgtaaggctcagatagaataaccagacagttccaggtgcatatggcactcagtgagaatccacttgctttatcctccctcactcccttccttcctccaggaataaagagtacactagttgaagaatatttctttgccttccttctttagcagctccaatcccagcctaacagcacaatgagcatcagatgtgcttttttgatgtttgaaatttatagtctctgttgaatgttggccaggacagcacttcgtcatttgaacaatttccattttccacaagctctctgtgattgatgacctaaccaggcacatggcattccgttccaccagcaatgtggccagtggggagatggctatgtcagtaacacctgtttgtggtagaccaacaatggcgccctaaaagatatatccgcatcaaatccctgggacctatgtgtgtgaccttatttggaagaggggtttttttttgcagatgcaattaggaatcttgagatgcagagaacatcctgtgctatccaggtgggccttaaatgcaatgacaactgtcttcataagagacgtatagggagatctgacagatagaaggggagaaggcaatgcgatcaccactaggtagaggttagagggatgcacccctaagtcagggaatgccagcagctgccagaagcttaaagaggcaaaggatgaattgtcccctagagcctccaaagggagtgtggcactgcttatgccttggctttggacttctggcctccagaactgtgagagaataaatatctgttgttttcgatgggcgtgatggctcacgcctgtaatcccagcaccttgggaggccaaggtgggcagatcacaatgtcaggagatcgagaccatcctggcgaacacagtgaaaccccgtctctactaaaaatacaaaaaagtagctggccgtggtggcgggcgcctgtagtcccagccactcgggaggctgaggcaggagaatggcgtgaacccaggaggcagagcttgcagtgagccgagatcgcaccactgccctccagcctgggcaagagtgcaagactccatctcaaaaaaaaaaaaaaatctattgttttaagccaaccagttcgtggttatttgtgtagcagccctagaaatgaagacagcctgcgagcaccttgccccacctggctgtaggtgacttttggtgccaccatttttgactcttgtggataaagagcagactatattctttttataagtaagtccaccttttacagaaaaattaatagccaggatcatggttttagaactcatagaatacactcctctcatcctctcattctttcccccacccattggcttataaacttgttcctatgaaataagtcagctgagttgagtttgtaaatgcatcttgaataaatgtgttgggtggggtcacaaacatgcagacacctgctggtgagtgttactgacctgcactctgaaaggcccctatattgatgatacttcttaatctcctatggctcttcttcagccctgggagcaggggagtgcagacttttgttcaacccctttcacagatgtgcacactgaagtcccagtgtgtccagtgacttgctcaaggtcatcagcactgtctggtggagctgggactcgaacccagtcctcctgctctcagctgtgggaaatggagacagcagttgccctggaagatgtttcctgtgctgcgtgtttgtggttgtctcaggatttgtgagacttactgttttcttgtgtcccctgtccctgtgacttatctttgtgcccactcagccatcaccacttccaacacacacccacacctgtggagagaatgcagcctcctagagctcatgtcatggcaggactgagggaagtagtcagttcttggtgctctctaatagggctctgaattgcagcctgggccgtgcccattcatttatgtattgtctatagctgcttctgtgttacaagaattgacagagactgggtgtggtcgctcacacctgtaatcccagcactttgggaggctaagacagaaggatcgcttgagcccaggagtttgagatgaacctgggcaacatgatgataccccatctctacaaaaaaaaaaaaaaaattagttgggtgttgtgatggaggctgagatgggatgactgcctgagcccatggggtcgaggctgcaatgagctatgattgtgccactgtctcaaaaaaaaaaaaaaatgttgacagaacaagttgattcaattatagacttgagtagttgtaacggagactataaagcctaaaatatttatagtgttaactttgataggacaagtttgccagctcctgcactagaggataaagattaacaggattgactccacatagaggagaggagaggaaggggcaaggatggaagcaaggagggagaagggttagagagaaagaaagagggaggggggtcactcagagacttcacaaagtatgttatttcctaaaaactgtaatgcccagtatctagtgattacctgtggcactgtcagccttctgcctgggaacaggaatcttgcaaagatcaaatgcagggcccagagccccaggactctgcattggcattcgtcagtaagttttgaaggaggcagacatctcaaaaccatcctaagcataaggcacccagctggtgatttgaagatagccatcttccccattactagttggcctcactttaaaaaatgttgtttcttggatagcatttttctttcacaagttggtttgctttcacatgtcaaaaaacaaaaccagggctgggcgcggtagctcacacctgtaatcccagcactttgggaggcgaaggtgggtggatcatctggggtcaggggtttgacaccagcctggccaacatggtgaaactccgtctctactaaaaaaaagaaaatacaaaaattagccaggcatggtggcgtgcacctgtaatcccagctactcaggaggctgaggcaggagaatcacttgaacccgggaggcgaaggttgcagtgaaccaagattgtgccattgcactccagcctgggcaacaagtgtgaaactctgtctcaaaaaacaaaaaacaaaaagcaaaaacaaataaacggaaagagagagagaggagagagagagagaaacacataccatttgccatatttgtggtttctcattcttgcgctatttttttaaacctttcattacattaggcctttatcagatattagcactggttcttcagttttccccctgatcaggaacttccctgaaataaatgctggtaagatcgtggaaagttcccaggagaaggatagaacaggtgtaccccagggaggctgagccagtacagagagacctatgggtttcacgggccctcagtagaactgatttcctctccttgtctcaggttgtcatcagccactgagcaagaccgaataagggatctcgtgaggctttggagatggatgcaggatctgttgcctgcgattcaaagctggtggaggacttgcttaggtcatgttaattagtttttctcagctctcaccaggtgtcattcatggaggttgcataaaagaaactcatacccagggatgagctttttcttaaatattacctttctgaattttgaaatttagtgtagcattgagacatttaaacacatttttgaagcacaaaacttatttatcctagttcaaagccagatttggtttgacctgtcttggtggtgttttctgtggttctgagatccaacccccaacttcgtcccttttgacctagtttatcacccatgtccttgggttgaaaatagtagtgtaatcctaagagaaggggcctgaaaggaagggaagagaaatcagatgtcagctggtgaggatgagaaatactgcaacaagggagcagcattgacccttgagagctacatgctaggtagagtcaagctctacttgccctaagtcaaaaatatcattgacttgtggctaaagcccagactttgaagagcaaagaaagcaaggatttaactgcaaaaatagaaaagtggctgacccaatgctgaggcttttaacaaaatttaccaaatagtttatttcagactgagaaagaaagagctcaaacaagcttaagcagcagcaaatgctatcagcctggaccatgagattgcatgtgccctgcagtgatcttccaccttgactgacattaaaactacctggtagtggccgggcgtggtggctcacacctgtaatcccagcactttaggaggccgaggcgggcggatcacgaggtcaggagatcaagaccatcctggctaacacggtgaaaccccatctctactgaaaatacaaaaaattagccaggcatggtggcgggcacctgtagtcccagctgcttgggaggatgaggcaggagaatggcatgaacccgggaggcagagcttgcagtgagccgagatagcgccactgcactccagcctgggcaacagagggagactccgtctcaacaacaacaacaacaacaacaacaacaacaacaaaaaaaaaaaaacactacctggtagtgtttacagccttgagtgcccagaccaataagatcaaaatctctgaaggtgaggcctgggcttggtgctttttgatgatcctcaggtgatcttaatggtcttccagggttgagcactgtggggaaaattgaggccaagatgtggaggcatctaactggctcgtgcatgttaagaactggatgagatgggaagccagacattagaaataatggggtcagggcaccacttacatggtattaatagccagaggtcttgaatcttcctccagactacagtgaagagagatacacatgttatctacctggtgatagataccaaagggaagcaaagtaccacactgaagcaaagtaccatggaaggactgctccccacttttgatgcatgataaagaccaacctgcctgcatgaagatgatggtgcacttctcctgaacttcaccatcatgatcacagtcaaagccagtgatgatggagtataatcacaccagtaaatgaagttcccctgctgtcttctgactcacttctaagtggcctggaccctggtggttaagaaaagtaaacccccaaagcagtcagtcattgtcggtttgctaacttgagcatcctgaaattaaaggactaagtactttaactgggtcacctctattagtgggtaaaaagctgtgtggtctttgttcacttccttaaaatgctgctatacgtgatggcaagcaacagaactagccacgagaaagcaacatggaaaccactgaagtcaagacttaatcctacctggttccccatcaataggtaaaacaaagtggttctgagcacaaactctgaagccagatgatcagcttttaaaaaaaaaataattaaagaatatttatttatttatattttattttagattcaggtggtacatgtgcagatttgttacatgagtatattgtgtgatgctgaggtttaggcatctaataatcctgtcacccaagccatgaacatagtacctgataggtagtttttcaacccttgatcccatcccttcctccctccttttggaatgcccagtgtctgttgttcccacctttgtgtctgtgtgtacccaatgtttagctcccacttacaagtccatgttgctgcaaagaacatgatttcattcttttttatggctgtgtagtattccatggtgtatatgtaccacattttctttatccaatacactgttgatgggcacccggttgatttcatgtctttgttcctgtgaatagtgctgtgatgaacatacgagtacatgcccttttgatagtatgacttatcctttgggtatatatcagtaataggattgcagagtccagtggcaattctgttttcagttctttgagaaatctccaaactactttccacagggcctgaactaatttgcactcccaaaaacagagtataaatgttcccttttctctgcaacctcaccgacatctgttgttttttgacgttttaatagtagccattctgactggagtgagttggtatctcattgtggttttggtttgcatctctctgatgaatagtggtgtagagcattttttcatatgtttgttggctgcttgtatgtcttttgaaaagtgtctgttcatgtcccttgctcactttttaatggggttgttttttacttgtcaatttgtttcagttcctataggttctggatattagtcttttgtcagatgcatggtttgcagatattttctcccattctgtaggttgtctgtttactctgttggtagtttccttttgctgtgcaaaagccctttggtttaattaggtcccagttgccagacggacagctttgaattctggtcttaacacttcataactgggggatctaggggcaagttacctaacctctctcagcctcagtgtcctcatctgtaatggagggataatagaagcttccccccagggttatagtgagggttgatgaggtagttcatttaaagcactcagaactgcgcgtggcacctgtaaacactcccacccccagtaccttttcacaagtactattaggatgatgctgttagcagcaattatcagcacctctcatctcaagttatattgctagtgacaaaacctttggcatttcagtgtatagctttccaatcttttccataactgtattttttcttataaaagtgagattatactgagcatactctttgctttttaaactgactatattgagaatatctttctatttcatgtaatctacagcttcatttgcaatgactgcataatggtgcagatatatcatagattatttaaccaaacacctgtggtttaatacttaagtctctctcttttttaaaagcaatgctgcagtaaatatcattaagtaaaagcactgctcattggcataatttcccctttagaataaattcctagaagtgaaatgtgttgttcaaatcgcatataaacttgaaagtgtttgctattctatatgactgccaaattatcctctagaaagattctaccaccaccagcagggaataaaaagtcagtttcccctcactatacttgacactgggtattacagtttttaaactgtaatcttttgtatttgttcttgacctaaagctgagctctgctgtttggggcttggcttctctgaacttggtgctgattcttgctttaactggagcttcctactggagcatcctaggtgggctctcactggctcaaacaaccctatgaggctcttcttagtcttctaggactagagcagggctcagccaagcacatggtgctggcaggacacttggagctgtccctataccagcagcaatcttttgtcttgcttatttaattaccttatcctaaagtacgtctttactagaaatttgctgtcctcagtgagaagcagtacctttcccttgttccctgctgaaccaccagggtcactaccagcagatcagagccacttccctgtccctgggggcatcgtcttagactttggtcaccaccaaagaggagacataagaagaagggcaggaagaggtagcattgagcaagagctctggatttgccatcatcagctgaggattctgaattaggaaacatatctatttaggtttaaactacaaaatatgcaagggttcctattccgagcctctcagaaacatccctctggccacaggcaactgtcactggtgatggttattctctcagaagatgctgaggatcagggtgtctaaggagtagctttgctttaatctgagcttggtatattacattttccatgttagcctacctaatagggtgggttcacatagaaatactagaaaacacagaaggatataaagagcaaagatgaaagcattccaaatcctaccatctagatacaacctatgttgatatttagcatgtatgcagaggatagatgctatcctgtagcatgatcatttatatgcatgtgcgtacacatgcatttactttttataaaaatgatataatactgaacatgctattctgtagtcagtttttaaaagaatgtatctttttttttttttttttttttttttttagatggagtcttgctctatcatcaggctggagtgcagtggcacaatctcggctcactgcaacttctgcctcccaggttcaagtgattcccctacctcagcctcctgagtagctgggactacaggtgtgtgccaccacgcctggctaattttttgcattttagtagggacagggtttcacaggttggtaaggatggtcttcatctccagaccttgtgatctgcccgcctcggccccccaaagtactgggattacaggcgtgagccaccatgcctggtgcccccccctttttttggggtgggggaaacagggtctcactgtgtccccaggctggagtgcagtggcacaatctcagctcactgcaacctccgcttcccaggcttaagcaatccttccatttcagcctcctgagtagttgggattacaggcatgtgctaccatgactggctaatttttgcattttttgtagagatggggtttcaccatgttgcccaggctggtctcgaactcctgagctcaagcaatctgcccgtcttggcctcccaaagtactgggattacaggcatgagccactgctcccagccttaaaagaatttatctttaatggctgtgttttatttatacattttcagtcattcattatcaataaatactgattcaggcccagtatgtgttaggcatgattctaggcaagagagagaaaccatgaatgagagacatggtctctgcccttggggagggtgtaatgaagttcgtcagttttgtgctttgtggtttctttctatgcgttatgtttttaaagtcctcttccatcctaaagtcagacaatcactatattttctcatgttttcactttttacattgcctgagtccatctagaaattgttttggtggatgaaaaattttctacttttaaaccattggaggacagcaatgaccacaaaaggattaaatcctctttccttatagacaagtgggcacaacttggctatgcagtaattctaacatcagcagtgcaaagaagggaagtacagtgttgattcttcatgggagactgatggaattataatagacttctgttcttaaggtagaaaattatcatttttttaacctgaaaagatagagtaatagtctatgataaggacaaattaccccaatatgtttttaaaacattgcaattattaacaaagtggtagtttctttcatttaaaacccccttgggccctaaagatatagctaacaagaggaaaaactgtcaaaactcttattaggtggttgagtttattttctgctcacaattgtatcatttaaaaccctgagaaactgttttttggagagcaatttgtccctattagagttttatgtgttcaaatccttgacttagcagttctgctggtagaaatccaccctatgtatggaatcacaaaagtacgtctaagatgaacatagaggaagattcattgcagtcccgtctataattgcaaacaaagcactgagaaccacctaaattatctattagcagcagactgctaaagtaagttaagctacatctgtgaatcgccatgccgtagttgcaaagaatgtggtgggattccatgtgctgaatgaaatagtaaaatctctaagatacatcacgaagtgaagaaagtaagctgaagggcaggtcttttgtgttaagaataaaagaccccaacttatgttggtgtatccattttttcctgtaggatgcataaaggactaataggaattgttgcctgaaggaacaaagctggtagggatgaggtgaagagaaagtcaaatgttcattttattcctgtgtggatggtgtgaatttttctaccctgcatgtttattacttttatttatgttttgtaatgcttactccatttatctaggcagggagattatagacaattggtgtttccttctttatacttttctatattaaaaaatgaatatagatcagaaatgttcaccagatactggcatctaagaaacaaacaaaaacatgatttgtcaaagtcagaaaaggagtgtatgtctctgtttggaattatgctaatttcttggagtttgcgttcctttgttgtcatcagaatgctgcacattgtgttctctttctatttttgtgcacactatcttgttttgtatttccaaccacgacagctatgttcagttgtgccccatcccctcccctgttctgtggcctgcggtgctgagaactgcgagcagccaatgggactgctgcttactgtgaggtccatgcagtgtccacccccgcttcctgccctgagactgcctccaggcctggcacgtcttcctaagacaggcctatcaacccagtggatccttctgccccttcctcctcctgtcctccaactttagggagccatattctgatatccagagatcctggatttagagcatctcctccattcttggtaaattgagaaccttcccaactgctgcctcatctgcagtagttcctttcagatgaaaagttaaaatgggagagaaatattttgcatttgctcttttcattagactattcgatttctatgtaaatgtcttctacagggattgaaagaaatgaatatattggttcaccagacattgctgaaggttccaacacagccttgacctatttttgtttgaaattgagaaatgctcacaaatgtaagaggcctccttttttggagattggagggatttgacatcaagatgttttgcattttcaacagctcatttgccctggatggcttttggcagataaatgtggaggtggcagtgtaataggtttcatgtgtccagagtggaattcacccagagccaaacaaaagctagtagctctgaacatgtctcttttcatggtaaagtactctggagtgagactgtttaagtttcaacccctgtttggccacttcttagctcaagggcacttcccttacagtagctaagtttaggttgtttcatccataaaatggaagattttaaagtatctacctcaaagtgtgatgaggattaagtgaaaaactgcggggcaattcttactataatgcctgacatagcaaggcatcaataaactcagttgccattattattcttaccattatggtttataccactaccatcattgggattattaggttcaaccactacacaactgaattgttgttgcatgagtaaattgcagttgtttagacaaaatcctaagccaaaaacttcgtgctaggtagaaaggaagcaccttcatttattaagtccctgcactctaccaggtgatgtgttagttccatctttgctgtatctcatttcaatcctgcagtagcattttgcaggtagttctatttcagtatttcagacggagttccaattgtttgatgcttactagccatgtgaccctgtctctttatcttcctgtgcctcagttttctcctctgtaaaatggggataatgatagtacctaactcattaggttgttgtgaagattaaacatgttaaatcacacaaaacagtgcctggcacacagtgaccactatgtaaatgtttgctagcattactttataactcaggaagggcacatgtgacagtctggaacgtgtgaagtcgttgttctccttagcactgtggaatgttagtgatgctggaggaaacttagagctaagctggcccaacctactcatttcacaggctggggatccaaggcccagaaacaataagggacttgtctaagtcactcagggagttcgtggcagagcccctacctgatacgagatctcctgactctgctcacgagacttcatggtgggaataaggcaacacacggagagggatgagatggagatcacattcttcgggagagtttgattctgttattcctgccatttgggactttttcagagtcctctaccattctgcctacctgtacagaaagtgctggatttttccaccacaaggggcttatcaatgtggtgtcataaagcgggtcttactttctcatcagagcccatatcagaccacttcccttcttggtctttagaggaaaccaaagtgaagcactcctagcaaagaatttgatgttatgaccatcaaagcaaaagtatagctctatggttaaataattacttaaagggtcacaccgtgggcagaccttaaaaaacagacttaagatataacccatatgggctataaagtatctataaaggaccctaaatggaaactctgctgtgttgtgcatttgacttggcactaataggccagatatattaactgttgggtgaaattaatgataatattgcatctaaattctatgggatgtttcttaaggttttgggtgttaaattaccccttctaaaatccagtattgaggctcgaactaatcaatgtcttctttttcttttaaaaattctcttgaccatattgtttctattacaaatgaaacatgaaggtagaaagtagaataataagttacaagaagtggagaagggagtgtgtgtagtggaggatgagagaggttggttaatgggtacaattatacagttaggtagaaggaataagatctaaggttggatagcacagtaaggtgactttagttaacaacaatatattttagattttaacatagctggaagagaggactaaaaatgttcccaacacaaagaaatgataaatacacgagatggtggatgtcctgaacaccctggttattatacatcctatgcatgtaacaaaatattacaggtacccaacaaatgtgtacaaatatcatatgtcaataaaacaattaaaagtaaataactacagaaaacaatacaaagctggcagttccttcttttacagatagatggcaagctcaagtccaaataatcagttgaagaaaagagaagttatgtagatggaaatgctggtccaaactaagggatgaggaataaatagagttgtggaattatccacttcacctggtgatgttgcgggttaaatgggtacatggctaggcagaacaatgtagaaaacctaccttacttgttcttctgaccaagccttttaaggctgtcatttaaaatggctctgagttctgtttcttagttttgtaggatcagaaaatcacatgccaacttagctttcagctacttatctacaaacccaagtgtctatttatttttcagtggatggacactgcaggggtcttagcaagtaccatctctccatttagctaactacataggaagcctgaatagaaatcaggattatgattggtgatcttgaagacagagccaggagagtgagttttaatatctgatggtgttgagatgagataactgatctcgaacagggatgtgtctgctgagcaaactcagcattacttgttagctggacaggcgattggacaaagctgagtgagcacctcttcaattttttttatgcttgattactcaggttttcagtttttagacagactatttttcttttttttcccctcagatgtataaatagcattgaatctgcagtagtgttagaaaggtaattataacccaaccatgtctgagatgacattgtgatttcttaatagaaaaagcttgttgggtccccacttgcaagttgatttttcataatttaattctcaaaatgtcaccttatttcttggtgtaacccagataaaacctaggtatcctggcaatccagtttcagcatgaagttatattcaaaggaacacaggctagttggccaaagtaatttcagtatccttactggaatcttctggagaacatcagaggggattcattttataagccacagtaaaatatctcaagattctcttttcctgatttcctggccttaatatctcagccttttcattttaaactcttgaactttaaactgtctctgacccctttcagtgctttacttcttcatctcttctttccttttctcgatcatttttccccctaaatagcatccccacccattccctttccaagtgcaactatataaaacagtctgtttctcgcagtttttcagtactttacctctttctctgattcttcatttcaaaagcctaggaatcctctggcaaaaagtcacttaaaaggtttggggcaaggaaacaagattccctttagctcacatggaaggaagtcaaagctgaattatcttcatctagcaatagaaagaataaagattgcaacgtttacaatttaatatattttctttaccctcctcttgtctaaattctgtgatctcatgatggcaagagggccttgagtaggtcttctggtcccttcccactgctgtgccctggggcgcgaggtatcagcgcaagctagaatgggggttcagtggaggaaaggaaacaccctatttctgcttctgactaccttccctgcttagcctctttccctgtctccctgtttctcacacactcagttgggacacccaccttgtccacagccacagcctggcatctcctagtgctccagttgcagcacagtcagcaggagagaagagggagtctcaaggagcaaaaaggtggaaataggctttcctaacaacaggtgcttgccatgtctgtcttctcatcatatttattgaacagaatgtgcttcattctctacgggtgctctttaacaatagtttacgtgttatgttacgaacatgttatgattataacatgttctatcatgttataatccttccagaaaatacttgccaggaaaatatataatttatagaaagtgaatgaaagtggcttgttagccttcccagatagtggaggaatctggaagtctttctaatggattgagatcacgtcattccagatgtctcttgaggcacactgccccgaatggttgctactgtcagctcattatgcttttccctggaatttccacttcccccgcctttctccccagaataagctttccatgattctttcccagaattagccttttcaactctttcctcatatgcatagcaacagtaatttatttcatgtgggttaatgtctttagcattaggacacttctggttttatggactgatggccaatgtgtttttaataatgtattttgcttctattgaagtcatgagtacaaattcgtaattcatttgaatgagggatatggacaaacaggaacacaagtggaagagagaaaaaagaggatagtacactcagagatactcagtaagcataaattacatgtattcatcatacaatattctaggctttagagatgtgtcagccaagatccttgtcctcaaggagcccatagtttgttagagagagaagatgtgtaaatagttaagtgtataaagtgctacagtgcttgaggtctaatgtagaaaaatccacagcctgtggggagggaagagaaaggagggagtgatgcaatctatttggagggaacagaaaaatcttctgtatttgtcagtactctttgagttgtaagtggtagaaacatcactcaaactagcttaagaaaatgggagatttattagtgtatataatttaggaagcctggggatggttctggcttcatgcatgactagatctgggactcaaacaatgtagtaggacccttttttctctttcaactctgcctccctctgcatgttgactttattttcttcaatgtagatgcatttcttttatgtgacttggaaaaattgctactcagaagtacatcatctcagcttaatcctagtggtatgttttttcacttctctcctggtatccgtgtgtctgtccctagaaatgtctctaactggtgtttctcagttcacttagctatcccttggatcaatagctattgcaaagaaacgaggtagcatgattggcctaacctggctcacaaacaagtcctagtggcaggaatgagctaaccatgactggcatttccaccagagccatttacagtgagggtagatgtgtttccccaaaggaaagaagactaggcagatcaaaattgacagatgttcattaaagcttcatggatatttaaactgtgccatcatagatgaattgttttttgtcaaatgaagcagcagtgcacatcgattattgttagaggaagcaataagaacaaaactaagaggacatgaaccagccgggaagatcaggagactgcaagtagtctttgaggttggatcatggtagggggccatggcttgagatgaagctgtgaaatagacaggagcctcactggctatgctagggaacctgctctttgcactgtaggcaatggggagacatccttggttttaggcaagggtcggaggtggtcagatttccattttagaatatcactctggcagcagtgtggagattgagttggagaagccaagaatggatgcagggagactaataaggaaaccactacagtaatccagctggagataagttctgtaatgtgctaaagatgctaatatggaatagtctccatgtccaggtaggagatgaaggaaggagggttaaggcaatactcaaggttatagtggggaagcaaaagatgtggaaactggccagcagaatcaacatgacttggtctttcaagaaagtaagtgtctaggatgacttagatttctgacttaagtagtgtcatttgctgagatgaaacatagaagaaggaacaggtgtgaaggtagagggtgggggattgcttgagatggtgactgcatgtgtttgagtttgggggagtgactatgaatagttggcagttcagtatagggatctgcagctcaaaggagaggtagagttgtagagtggatgagaatgaaggcccgaagagttactggttttgtcctggttaagggaaggagaaatctggaaaccagtgggctatcccggtgaggagcacagctcagacctcagccatcaaacaagtatcagaaactgcaagtgagttccttaatggtgtcctatgcaaacttgttgtcgtttgactcatatctaattctgagcgtaggctggttgcctcttgtccacctagaagtgactttaagaccatcactatgggctgggttcggaggctaacacctataattccagcactttgggagactgaggtgggtggatcacctgaggtcaggaatttgagaccagcctggccaacatggcaaaaccccatctctagtaaaaatacaaatattagccaagcgtggtgacacacacctgtaatcccagctactcgggaggctgacacagggaaattgcttgaactcaggaagcagaggttgcagtgagctgagactgtgacaacagactgagactctgtctcaaaaaaaaaaaaaattcactgtgaaagggagctcagctagtcaaagaatcctgaaatagctgtggatgcacagtgggtccttgtcatggggccaggcccagggtcatcagttagaatgcagttgtaaacatgctaatgctgctgcctggttgtatgtgctaacaactgcttagttccaaattctaacccaataaggagtttcctcaggggaaatgtatgactacagcacaaatgggctcagccttactgctttcccactgttaccccttcctgcaccagcgctcttctggtccgtgtgactaaaagccaaaacaccactttgcctaaccccccagatcctattagttttgagtctcatcaattctgtttcttccatttgtccttctctttccattctgattggtacagctctaagctaggaggcttgttagttcatccatccttactgcacaaccaggtgaatggaacatcctcctaaggcacttaaatgatatttgaatccacaggtcagcaaactaggacccgtgggccaaatctggcccactacctgtgtttgcaaataaagttttattagaacacagccacactcattcatttaaatattgtccaggactgtttttgaactacaatggtagcattcagtagttgcgacagagactgtatgtcccacaaaatctaaaatatttacttttgttttataggaaaagtgtatcagcccctattaatccaccttatgtatgaatgccagattaatgttcctaaaatgccatttcaccatatcattctgtagcttagaaccctgcaatgacattgcattgtccatgcaataaaatctaaacttcatggccctccatggtatagtcctagccaatctgttgagtcattgatctctgttcctaaaggcaagccctacaaccagttagattttcctcctcattgtccctggaatatgcagtgcatttctacccttgttcacctagttccttttgcttggaatgtattgcccatttgtatctacctaaatcctactcattccttttttttttttttttttttgagacagagtctcactctgtcgcccaggctggagtgcagtggtgtgatcttggctcatggcaacctctacccactgggttcaagtgattctcctgccttagcctcccaagtatctgggattacaggcatgtaccaccacacctggccaatttttatatttttagtatagatggggtttcgccatgttggctaggctagtctcaaactcgtgacctcgggtgatccacccacctcagcctcccaaagtgctgggattacaggtatgagccactgtgtgcccggccctaaatcctacccattcttaaaggactaacatgaactctacatccttcatgaccatgtcagttacagtgatcaccaatgagcctgctgcttgagcatgtaaaggtccactgcccatactgcctggtaagttttcttctgctcagagaatggttcaccaatatgatgatgggcaactctggagtgaggactttctgatggaacaaagtcacagctgtgggaaagcctgggaatggtttggaaatgacaagacatgtaatgagaacacatgacactcaattaatatttgtggaaatcttgagtcatcagcctctcatatctatgacatacatcttggttctgtatttaaatgtaggacaactacatatcttgatagccagtgggaatgactgacaaagtccagtaagtctactcttgagagattctagaatgtagagatagcagctggaccaggaagccctagctttatcatgtgccatctctgagatggtggatgtgggctgttcccactgtgcctcacttttcccatccactgtcatatattttatggtcttgcacacactctgggattaagtaacatcaattatgcaccattgattggagttctttggtaaatggtactacattcctaaaatattcatgtgtcttactttgtcagggagattatatccgtgacttagatatcatattctagtggcttaagattatgagctaatattttgtaaggtctgggcattgcacagaaaaccttggttgtaatacacattattattacattgatttgaatagcaatggtacaatcatagccccggaaacatagcgactacataaaataaaagcttccgttaacactgagcacagcagccaggcttccgcattgttgttgtccctaggatttggctgttgtattgtcaaatgccattatgtcttatctaataagtttctccctgcatatgtgagtaaacgaaaatgctccagtatagtaaatgtctcagcaaaccactcctgtacgctttggaaacagaacattaacaaggaaactatcatgagagcagacctttctgttctcatgaatcacattcatatgatgtttattgtccacattggagaagtatagagaagaaaaatatgaagggtacactctaatggaaaggttatagtggaaatgcaaggaaaatatatccctttacaaccagcttctaggcattacctagaagtaaaattatgacaataagactaacagcaaataacattgagcacttactctgtgccaggtattgttctaggccttttacgttacatcatcttatttaatccactccacaactaagtggtttggatgcagttattatctccactttatgtacgagaagaccaagacccagggaggtagaagaacttgtcagaagtcagacaggtagtgagtggtagggctgggagttggacccggacagacagattccagatttcatatttatcgtaacctcagctgccccacccacatgaaatgctaccccaaggctagtggcagcaaatataacccatttcatttgcattgtttggtatgtccaactgggtgatttgtcctacaaaatttgaaacaacgtctgcttatttatgtctgtgattttgatcaaataaatctcacccagaatttcccactgtcttattctatggtatttgcagtttgtaagaacctctgtcttttggattgagacgtttttattctttgtgtccaaattaacactgcacagaacatggttctctgtgtgtgtgtgtgtgtgtgtgtgtgtgtgtgtgtgtgtgtctgtgtgtgtgtgtagaaaccgtcttttcttttggattaaattcttgcagcctggctgagtgaggagaatttctcccactcttcgagcctacagcagacatgttaggagaatgctgctgcttgcaacacacccagagacggtggggcaggtgacactgcgtgtgtgcccggtgtctctggaagtgtctatacagatgtgtgctgctgctgctgctgctttctgccttaaaatttctggagccaacacccacccactcttacagcctctgtctctttattttcaaggaaaaaagaaagaggcagactgaaatagaaggcaagcgacaacagcttgacgagcagatacttctgctgcagcattccaaggtaagcagctgatcccaggaacctattccattattagacatgcagatcacactccggagagctgggcagtgcctgccctgccgtgaaggcgctgccgccaaccaaaccagcctttttcattcaatcaggaaaccatctcttggcttttcttgtgaatttctcaaattcagggcattattacagcattccaatttctgcaagcataagattacagtgtgcatgtggacagggtggagggtttgtgcgtgtgaagtgtggtggctatatatagaaattggatgagaatacttcacagggtgggtgaggcagcatttcaggattgtttctcccatgcataggtgctgggtgtgtttgctcagagaccccaaaagatatatttcacggaacgttctttttattcacttaaaaatattagtatttcctttcttgatatggagaaaagggagattaaacgatgtgatctgataaaagaacaacactgtgtatttcagattattcatttattttatttgtactttaacaattttgaaagtgttctgtgagagcaagcagttggtcaaagatggctttgaaatgatttgactcagacgggtctccatggtaccatctaaaaagagagagagagagagacagcacacaagagctgtttattttttctttaaaacatgatgcacttaagcatcgtaattgattacagctcaggagaaagctctgtcactgtcacaaggaccccactggttgcagaatgttgcttttcacatgttcagagaataatgtgaccacattccaatggccagccgggagttgttgcttgcctttgactgctcctgggctttttggcaggaaaaccttctcctgcttacctcatgttgctgtgacattgcctgcacagagctgcattgctcagaggactgggtgggaaggtggtgctgactttcggggtgatgctcggtatgaattatctagatttttttcaacaagataaacctttatggctacttttcctgtccttttctagaaaacaggattgtgctaaatgaatacccaaaatgagaaccatcagcaagcgagttactgattgaaaatagcagcatgacctatatctgcttagcatgtttatcagtttttgccatttaccttaaccagagaaatgtgcttaaaaggaagaaaagcagcatgatactaaggatattgcctgtttctctctgttcatcatataaattcattgacagatctttctttgtaggagcttgctctgtatccccggtgctgttgctctttccccacaacattcctgagggaggatggagggctaaaattagtatcctcttctcacagagagggggccttaaaaacacctaatagaactgagtgaattgttcaaggtcaatctgcacagagctaggtctctggctcagagtacagtccattcagtacggtgcttgtaagagaccaacatgtactaaaacctcagtgaatttctggttaaaggtgaacttttaaataagaggaccgaatgaaaaaagagaggctgctttgggctagacagcctcactttaagctcaacgtagttctttgcttttgtattccctgaatccagtcagggaataaacatatgtcaaaacatcaagggattttttttctttggtctcccttctcatgatcctgggtgccaaataagataccaagggctcatttattgctgatgtccagtgcagtattagtatattctgttcatattacatctattcatttttttatttgtttgtttgtttgagatggagtctcgctctgtcgctcaggctggagttcagtggcatgatttcagctcactgcaagctccgcctcccaggttcacgccattctcctgcctcagcctcctgagtagctgggactacaaatgcccgccaccacgcccagctaatttttttttttttttggtatttttagtagagatggggtttcaccatgttagccaggatagtctcgatctcctgacattgtgatccacccgccttggcctcccaaagtgctgggattgcatattcatttttcgtctatgcatccattcatccatctttccatccatccatccatccatccaatcaacagaaacaacagtagaaattaacttggtcttgtatgcggaagcagtgaggtttttctcaaggacttggaaacaagggaatcagctagttctttatggctatcttggtaaaattctcacacagttgatgagattggctatctgaaggaacacccaacactcgcaccatggcaaccttgctattgcagggcaggaggtgggtgaggtggggaggactggaggtgatggtaacttactaagtggaggtgagtgcattgtatgtctctgggaaaggcttgtgtggacagaatgagggtgagttatttgccttgaatactgaaaaaggaaagctcagaggttccaaaggtggcagtggttgtctagtactatctgcagagagacccccagctttgggaggtcctgaatttctgtatgctggtgaggtggggtcagtggtaaggtgaggagggtcctcaggccacagtgaggcccaagtgaaacttccctcaggaccttgcctctctttgttctgaattcatcctccctataattattcagttattttgatatgaggaaagggttgcctgattgaaggatatgatcactttaggcactaggaaggaatatgtttcactttaaatcaataaactggtgactgaacttgaatagcatgggactttttccctgtaatcatccagtttgcagcctagtggcctcgcccctggatggaagtacattcgtggaggttatattttcttctctgtgagcctctccaaggagtcagccagttttctcctggtagcctgttagccaccgtcagtaacagtcaccatttttttgagtgcctaacacgtgcctggtactttaaacacataccctcaataatgaccacaagacagttattactctgtcttacagctatgggaacaaactcatgaggtcaagtgatttgcccaagaccatagagactataaatgagggagcctgagagaaactcctgggctgtctgctttcaaagaccgagctctttccaggccaccgttctctttgaaagaaatgtttcctttggaataattcatttagtgagatgccagttaccatcattgctgtctctcttactctaaatatattgtgatggactccagaaaatttagatcatgtggagacatgtcacagtgattattgaagttccttgaagtagagaatattaggaaatatgtcagtaatcaatatttgtttcactaatttgcaaaatcctagatattctctaagaaaaaaatattctccttgcattagagttagttgtcatgtttataagatataattttcatattctttatataattctcatattctatgtcttaagataaaattctcacatgtggcaattatcagatagcctgtggacacttattctcatgcaatgagatgaattatttagacagattcacctgtctgtggtcaaagcaaataaatagaatgcaagatagtagttttggcattcatatatatttttagaagacttacttattgcaatatttaggaacatatagtgagcaactctacaaaatggaatatcatcactttgtatatggacttcgagcaaattccacaatacagtaaaagactaaagtataaaatggtaaaatactaactgctacatcccagtgattaggaaacctcaagatactttgaactccaggccaaattaaactcagatgtatttttaaagcatccttagctatacgtagtgtggtgtaataatttctaagcattacaagtagaactagtaagcaatttttatagctatattatttttgatgattacaaaaggaaagaatgtataatcattgcaaaaactaaattaaaaagtacagcaaaatataaagaaaaaacatatgtactctatacttaccattcagatagaacccatgcagaggtaaatccttctatacttttttccccgatatatttctgtagattaagatatgtaaccatcattcacagggctcaccaacctgtgggtaaaatgaaattatattaacattagcattggaataacattaacctttacctcttttttatgtgggttctttttaatacccatacaaaaacttataatttttataaaatcccatggagcattcttttactttaggataactgactttgatgtcttccttgaaaagaatgtctccatctcaaactcttagctattatgtttcttatacttcaatagcattaattcatctagaatttatttacagacgaggtatgcagtaggaatataactttactttttactgatgctgagctgcttgtctcaatgtgatttattgattaattcatcctttccttcactgatttaaatgtcttctttatcacctacatatttctgacttacatttgagtctaccatttatggattatttttattccattaatctgcccattcctgtgccagtattgttctcatttaatccctatagctttttaatatattgtaatatttcataagacaagaactatcattattcttttgaaaaattgtcttggctttttatttcataggaacaattatttatttttattgtttttataatgagacttgtgatgatatggatttttttaaaataaatcagctactatatcatactagagcagaaggaatttaatatttccttctgtcccttggttgaattgccagagatttgtctattttattggtctgttcaaagtcccagcacagagtaggcactgagtacctactgcaacatgaattccttggagactgtcatatttacaaaggtttgcctgacagagttggccctgtcagaatcaaattgctaataccacgtcttcaatacataaactgcctttgaattacttattcatgagcggggaaccctcactagagttttcttctaatccaagctataaaaattgtcattatatttggaagaccacagccttttcttccaagaaagctgaatgaaaaaagatgaaaggctgaattgtgaccctgtgaaatatttgttgtcaacccactaaggtcatttgctgaagagcctgaaggtatcagaagacttgctacaaagatattacagtgtctttcccggttttgaacatttagcactaattttagactttttcttgttactgggatgtgtgaaagacttatttcaaattttaaaatattgaacagataggcacagtacacagtgtaaagtaaccttagatctcctcccttgtttccatacccagagcttgaatggaagttaaaacctgatttcttctatcagaagtcttgggtcggcttctccctgggtggactgaagcatataacaaaatctcaaaaccaaaccaagatcttatttattgagagtcaagaaagaggaaggaaagagtgggaaggataggggaagagaaagagggacaggacacagataaatgactgaaaacacaaacacagctattgcctcatgctgagtttaacccactttctgttagaaaactgaatttaggccaggcgcagtggctcatgcctgtaatcccaacactttgggaggccaaggcgggcagataacctgaggtcaggagttcgagaccagcctagccaacatggcaaaaccctgtctctactaaaaatacaaaaattagctgggctacttgggaggctgaggcaggagaatcacttgaacctgggaggtggaggtcgcagtgagccaagatcacaccactacactccagcctgagtgacacagtgagactccatctcaaattaaaaaataaaataaaataaaataaaataaaataaaataaaataaaataaaataaaattgaatttagccatattccaaccatcatccactagaatagccaatatcagcttcagccagattacaaatgaatgaaagatccagagtaaaaagtaaaatcatgaaagtacacaaaggaatcacaggtgaatatttttatagtgagggtaaggaagtcttatctatgtatgacatcaaagccagaatgtgcaagtaaaaaagattgccagttatgactttataaaaataacaaacatctgaccaggaaacaacaggagacttattacaagttctcattcacctcctacttccccaatctgccccacccagcctctccagacatgcctcactcttcaccggggtcacctcaaaaagtggtatctaggctgggcacagtggttcatgcctgtgatcccagtacttgggaggctgaggtgggaggatcatttgaacctaggaattcgagaccagcctgggcaacatagattccatctctacaaaaataaaataaaaaataaaggaaagtaagaaaagtgacttcattgcagttaccttagctgtagatgaaaaagattgggttagatgatctctgtgatctttttttagctttagtgatccaagattttatatttgctaaagtacagtgtatgtgcatgattttccaagaattcctcacatgtcagcctccgtggatgaataaaagatacagtcctgactgtgagaactcaggggcaagtgggggagagagagcatcaatatggaacccaccattagaggagctgaaaaatagttttccatgttatgaagtggatcagtggcacctgatgattttgtaaatcctatttgagcaaaaaagaaaaaaggattcttgggtgatcttacacagaggcaagatagtagagtgtacctcttggcttcaaatcccagatctacagctcactcggtgtgataccatggataagtcagttaatgttagcacctacctcatgggatgcttgtgaaagttaagtggatttacatgtaaagcacataaagcagtaagagttctataagaattatcattattgtcaccatcatcacccagtactatggctgcaaataccatttatgtatatatgactgccaaattgagaatcccagtcttccatgttcaactgcttttctgacatgtccgcttagatggatgtcactttcatttagaagcctctgaaacttaacatgcccaaaatgaaagattttattttctgcttttctatcatttgttctactcttccctgtctccagttgatgataccactattcaccctttcactcaaaccaaatatctatgcattgccctaatccttccctttttctcagcccacatctaatctgttacaagtcacactgattctacctccagaatgtaccaccatgccttttgattcttctgtctctcttctgtttcaagctaatattctctgtcacttgaaccatgcaataaactcccatcacttgtactttgtaatcctgccccttgcaatgtgttcttcctattgggcttagaagacacagcaaactccttaacaaggctacagaatcctacctaatctggcccctgccttcttctccatcttcagtttgttctgccctcccaccccaacctcacttattatggtccagccactcgggcatttgttccggtccacaaacacaccaaactctgtcctaccaccaggctggtacatttgccagtccctccacctggaacacccctccggatctcagatctcagcttgaatgttcaagtcatcagagagacctttcccactttaaatgtcctcccctggtccctctttgtcacattgtcctgtctacctcttcctaggcagcatcatagtctgagattatcttgcatccttgtttattgggatgaaggcttgagtgagagtagggacttgcctgtcttcctgagctgtgacttcagggactggcagagttcttggcacctaggaaagggataagagagccactgctcctgagttggggacacagaaggagaggatggggagttcttttagattatggtgtttgaccagccattgagaaagcttgtgtattcttcaagcatttggatagtcataggtcctcatgctgtgctactcaaatcgtggtcctcagtctggcattgccagtgacagcatcacctgggaggtcgttaaaattcaaattcccaggccttatgcgagacttagagaatctgcatctccatgggtgggtcctggaatctgtgtcttaggaagttctcctggtggtccttatgcatactgaagtttgggaaactcagttcttgctttttgttttccaaagctggccaggccagtagagccagaaacagatttactttgggagttccttctgtcctcctttcagaagcccctgtcaagtttccctttgtccagctgccagctccccacctgctccttccttgtattgacttgccatgatgacattcgtttgacaaatgtgaagtttgacagtccttagcaccttgggaggagtttgagaccagcctggccaacatggtgaaaccttatctctactaaagctatgatactatgttagctatgatacttttttttgatgtatgttatttagacaataaaggccacaaacagagaaaagttttttttaattttaatttttttatttctattgagctctgcttccgctaaattctgaaacactgaggcagccaatacaagctagcacagtataggggaccctgtgctttggatggtgcactcagtatacaccattccatttggagacatgttggagacaacataagggggatctggagtcagttaaggaagccttttgaattggtgatttcccctgaaagcatgactttggagccaagtagaaaatcaactatgctttttcggcttcttaaaaatgtctaaacacctttgtgaaacaggattctctgagaccaggcccactgccttttccagttttttttctttctttcttttttttgagacagagtcatgctctgttgcccaggttggagtgcagtggcgtgatcttcggctcactgcaacatctgcttcctgggttcaagcaattctcctgcctcagcctcctgagtagctgggattacaggtgctcgccaccacacccagctaatttttgtatttttagtagaaatggtgtttcaccattttggccaggctggtctcgaactcttgacctcaggtgatccacctgccttggcctcccaaagtgctgggattacaggcatgagccaccacacccagccccactactgcctttgtctgttggagcctctcttcctggctcctcctgttgggatgttcttaatgatgtcatgcctatatcaagaaaagagatggaagtagagggacatgcacctctgggtgaccagagtcaccaggctgctctggccagagctacctgctgatggtggcagctaagttggtgagaagtgaggggctagacccttcatgtgatggcaggaggcactgtgtgaagaacagcagagagaacattccaagagcagccatttacgttgcaagaagttgtggctgcagaacatccctgctggtgtggagacagccaggactgtccatggctgcttttccagaagggtccacaccaacgccaaggcttccaggatgtctatcccccagaatcctaaggtttttactatctgtggtttggacatctttagcacaggaagcaccctgaaagtgtggtccctacccctcccaaataattagagagaaggaaagttgagaatttcccagttcatccatttactcattcattatagggaattgggctacaattccattgactgaatgaataaatggatgaattgggaaattctaggtgacacagtgaatgtgaaggtggataaaggacagtcctagccttccaggaaccagcaggctacagggggaacagatgtaaaaagaaagaatttgaggatagtatgaaagggccatagagtgtgtctcagagccagtagaggtggaaggcttctctggtggtattttacttgttctttcttaggtaaataaagcagaggccaagggaacaggatggacaacaacaatagtaaacatttctatagtactaagtatgtgtgtggcccttttagcctataaactcctttaatcctcataacaaccctctgagctgggcactgctattttctccattttacagatgagaaaactgaggctcagtgaggcgaaggagcctgtccaagctcactcagctggtaaatggcagactggttccagagctcaggctgttagccactgttcagcatggcctcttgcagtctctaccctcttcctgagagtaaatttcagagccaagttatagttcaagaaaagcaaagcaataatcattcttctacttcagaattgctaccaatgaacaatttattttgtgcctacaacagattaagtatctgaataaaaatataaaaacatgaattgattaaaaaatggcctctcataatgtgcaaaacagggtctgtcggggaaattttgagaggtttttgtggagaacaatggttctgaatgttttgtagaaagagcaaccgatttgccccaccctttcccactttccaatggaaaagaatctctgataaagctttgataagcaaccaacgtaagcaaattgtactgccctcttttacacatgattttatactatcatacgatgccctataatgtaaaaactgtacattttaatacctaccctggtggtagatgcacactatttatacagagcacattcaacaggcagcatgtcaccagtgatgcatagctgtttacgcatattgaggtgtgggggtggatcctgtctataatcactgtaagagtatagttaggaataattctatgtgaacaaactcaagtctttaagcctaattattaaaaaattacaggtcaagtaccataaatttgcctatgtgctgcaagagtaatcaaagagatctctacaaacaatgatttgtaatgaaaaggcaagaataacatcaataaaaaccatggtcacctgaacccacactgatgatgtattgtcaacacagagtctctcctggaagtgcaggaattccaggttgattgaacttgctcctgggcatggagcagggtgtctacagcaccagatgacccctggacttctcaatagaatggtgaatcaggaccattagtgaagtctaacttactaatactaagtgttggtaatttttttttgagacggagtttcgctcttgttgcgcaggctggagtgcagtggcatgatctcagcccactgcaacctctgccccccaggttctagtgattcttctgtctcagcctcccaagtagctgggattacaggcgcatgccatcacacctggttaattttgtatttttagttgacatggggtttctctatgttggtcaggctagtcgcgaactcctgacctcaggtgatacgcctgccttggcctcccaaagtgttgggattacaggcgcgagccaccgtgcccagcccagtgttggttatttttaaagactcatcagttcataataaaatgcccttaatgccgcatacaaatgagagtctatggaattgtgcatccttcgctcataagagcttcagggagtgctccaagcctccattccctggctctcagtctttagaagagttctttcctttcacctcgctcaccctgcctgatgagatcaaacgaaattctggacagaggtgatgccagtgagccagggagccaaagagccaggtctttattctgtgttaggtggcttaatagtcattgctcctgctgttcctttcgttgcttactatttctgggaagaattgttcatgtgccctgcatcctcactgtggtcccctctggtgaccactgacctgcccatgggcatggtcactggtccttagccatgatgtacagggtcagtagctgctgccgtctgccatctagggaccatataagtggaacctgaatcaaaattatcctctcacatctacctctccttgctcttccttttagggaatttcaacatgcttttttctggaactgttttcatttcccttctcaaagcagtaattgctgcctccgaaccattgacctgaaacaaaagctttttattccactgtactgtatcgtagtacacttgcaaacatgggatgtatggtttttttttttttttttgacagggtctcgttctatcacccaggctggagtgcagtggcacggtcacagctcgctgcagccttgacctacctggctcaagcgatcctcccacctcagccttcccaagtagctgggactacaggcgtgcaccaccacacccagctaattgtttaattttttgtagagacaaggtctcactatgttgcccaagctggtctacaactcctggaatcaagcaatcctcctgcctcagcctcccaaagtgttgggattacagacatcagccacggtgcccatctaggggcatatgatttttataacatttggagattattactgaagatgattgggagtcattaaagaagggagtcattgaagaagagtcttgacaatctttttaaaacactttaatatggaccagatattaggtggtcttaggaagttttttaattaaattacagttgcatagaaaaatgttcttaatttttagagactcatactgacatattgttgggtaaaatatggttgttatttagtttaaaatcatttgatgagaaacatatgggaaaatatggcaaaatgttcataattgttaaatctagatgaggttacatggtcattcattatacagttctatttttaaatttttttaataatagaaaatgatatagagataaatctccttgggtgttgatctagagggaagtagggagccatgttagtgaggaggtgaaggcagcgattcaggcagcgctggtgaggggtggagctaaaacagcaccactgcagagggagaggacagtgtggactgaaaagtatcatcttgtctgttgtcttccctcacttccacagtccaaagtgcttcgggagaaatggctgctgcagggcatacccgctggaactgccgaagaggaggaagccaggaggcggcagtctgaagaggatgagttcagagtcaagcaacttgaagataacattcagaggtaggtggcttccagcccagggaacccatgctacagtttttcagtgcagtaaccactgctctcctctaggtggcctttctcaatactgttaccttctcctgtacttgagaattttcttcctaaacaaagcacattgatgttgtttaaacttttccagatgacccagagttatgacacagagtactaataattttttatttttatttttaacttttattttaagtttaggggtacaaatacaggtttgttacataggtaaacttgtatcgtggggatttgttgaacagattatttcaccacccaggtattaagcctagtacccgttagttatttttcctgattctctccctcctccctcccttcaccctccaaaaggccccagtgtgtgttgttcccttctacgtgtccgtgtgttccatcattagttctcacttataaatgagaacatgcagtatttggttttctgttcctgtgttagtttggtaaggataatggcctccacctctatccatgtccctacaaaggacatgatctcatccttttttgtggctgcaaagagtactaattattgcactgggctgtaatacagcacagtgatggcttcatgggcccacaaggtgttgtgagcagcttgccccttcactaggtgctccctttgagttcttatattagctttcatctttttcctccttcgggtcaggttgttagctgttattgctgctgtagtgagtctgttttcaaatttgctgtatttggtcaattcgaaatgtgaaaactgtagtcaacagtcttgggattgaaatgaagagtgtggaagtgctgagtgagagcacctctgtaggttatgtgcccgtgctctaaaaattaactttgtattgtctgctttcactgctcagagagtggtttctttatggttctcaaccaggatctgatcacttcaatctgggagataagcgacctgtctgtgggcaataactggccaggctcacacaagagcaataatgtaggtttttacttgggagctatagccactccaggtcccaggacacctagccagagagatatgagatagggatggaaggtggtaagcatagatgccttagaaccaaatctgtccctccaacccatcccaccaaattctacctgaaatctcaccacctggagcttcatctctgtcttctgagcttatgagctctttttttttttttttttttttttttttagatggagtctcgctctgtcactaggctggagtacagtggcacaatcttggctcactgcaacctccgcctcccgggttcaagcgattctcctgcctcagcctcccgagtagctgggactacaggcgtgcaccaaccacgcccagctaatttttgtatttttagtagagatggggtttcaccatgttggccaggatagtcttgatctcttgaccttgtgatccacccgccttggcctcccaaagtgctggaattacagacatgaaccaccgcacctggcatgagctcttttaaaataaagggtaatagctaagctgctaccagccatttataaccaacagcaaattaagactctgagggcacctgtaatagtgtcactaaagggaaaagcaagccaagtaaatcccaaaggcatacgtcagcctatgtccctactttgcttaggtcctcacatgtcttaaagagctttcagagcagcttggctaaacattgtgaaggaaactggccaagaaaaagtttggagggtttgtgtgtacatatacatatgtatactcacacacacccgtgtacatgcacatgctttttcttagaatacaaaggataaaggctaaactgttaccaaccatttatatcatatacatatatatatagagagagagtaggtgttattatagacagaaggcagaaaggatttggaaaataggataaaattagttacatgaccttttctatttttctttttgtttcttttttttttaagagatgagatctcactctgctgtccaggctggactgcagtggtgcgatcatagctcactgcagcgtcaaacttctggacttaagctatcctccgacctcagcctctcaaatagctgggaataaaagttcatgccactgtgcctagcattattattattttttttttttggtagagaaagagtctcactatgttgcttaggctggtcttgaactgctggcttcatgtgattcttcccactcagtctcccaaagtgttgggattacaggtgtgaaccaccgtgtccgtcctattctgtttttcttaagtgtcactgggaaacatggtcttccaatcaaattggcagtttaaccttggcttgaatgcaaatatgttgttattatggtccaataggtggtaactcgcacttgtagaatgagccattgcgtgtggaggctagagtcttaaactgagactcagtttctgggtaaattgaccattggaaggaggtgttgtgggttaggggctggtttattattcaggtggtcatgattatactcaaagaaaagttgttaaagttctttttatcctttacgtcctttacgtcaatggaataaagagcacactcaatgtatgcaggcagtctcacccatttagagctagaatcccaagccagaggaaggaaatcacaatagcctacaggggtggatggtgaggcctggattcaggggccatttcttgtgtcttagtcatgactttgggccaaatgggcactggatgtgtgctgagatgagctgtgctccctggagctgctttctgtaggagcaggactgtggtgagcatcgtttcctctgcagggccttctgagggaggagtttcttctaccctggaagtcagcttctgcttctcttcatcttgctggcatcttctctaccacaatggttattagtgtctttaatcttcaatcccatgggaagaaagagctgttatctctcttcccataaaggacactcagtcacctaagacatttctctgtagttgaacatagcttagttctcactcacagaatgacatttgaatagttctaaaggctcattgcaaacatgagcaccctacggtgttacaaagtccctgtggattggctggcatggctctgctgatagggctgagctcacctacgtgactctaatctgcgtgttgcctgagtccactcttgtttaccctgcactaacaggctaaccatgatgctgtctctttctggcaatgggagaggtacaagagggctgagcagaaacaaggcctaggctcagactgcccacaagccatctgccaaaccaagtcaatgagcaagcccaaaaccaagggaagagacagccagccaacttttagtggaaggaacacagatcagggaagggtgaagaatggggatgaataattcagttttccaggagcatgattgttgaattgaaaactgcaagcattcaggaaaatggaccggcattagggaaactacagaaaagacatttaaaaagaaagaggactggctgggcacagtggctcatgcctgtaatcccagcacttagggagaccgaggcaggtggatcacccgaggtcaggagttcaagaccagcctgctcaacatggcaaaaccccatctctactaaaaatacaaaaattagatgagtgtggtgatggtcgcctgcaatcccagctacttgggaggttgaggcacgagaatcgcttgaacccgggaagcggaggttgcagtgagctgagatcatgccactgcactccagcctggcaacagagtgagactacatttcaaagaataaaaataaaaataaagaggactaactaaaacaatgcaagaatgcagagagaaaggaagaagagagtaagagagaatatgagtgacttcaagatcaaatttgcgatctgatctttatataataggaatcttgaaaactataagatcagatgcagaaccattaaataaaggcattttaagggaaatcttcattactcaaggcaaaacattaatctgtagatctttagatttgggccccctagtctaagtcacccccagcaatcaattagattctcctaaagagatacataaactggttgcaaactataaagtatattagtacagttgtgccctgaaggtattttcgtccttgttgttgaactaagaatagcttgaagacactgaaggaggaatagagaatagtaaccaaagaacaaggaacatttctacaaagaaagactaagggaaattgggccatttagtttagataacaaaaggataatggtatcataactcagaacttcaagtgtatgtaggatctaggccatgtcttaattctttatgtgcaggccattttgaatatggcaaagacttcaaataaagcatgcaaatttctacttagatgtctatttccctagatacctcctagaagaaagaacataatcaccttttaattcttattctgtgattctttacagtgccagtaactgtacaagaagttccaggtttacagacatgtttttttccaaaatgttatttataaattggtggtggtttggaagggcgaatgttgttcctctgccagaattattatatgtggtgcttagcttttgagggcagcccacgaagaaggaaggaatggaggaaggaaggatggaaaaatgtaactagaatattaaaccctgggcattagaatcacttgggaaggtttttaaaaataagaattaccaggcctcattctaggaaatttggatttagtgatccaagtaaggagtcctgtaatctgttttttaaaagggtgttccagataattctgttgtatggtcaggttcaagaatgattgcagtaaatggaaaaaaggatagaccataaatgaaatcccattttaatacctagaaaccccccaaggagagtgggaagtaaatcatgtttataagaaaactggcttcacacacaaggataaaggacaacccaacccttgattcagactgtttctgagccttcctactttgacccaaggatatgtgaaacctgctttggggattcctgtaggtgagagtagctctggcttagagctgaagtctctcctccataggccccacagtagagctaagctttcatttgaagtggattagaaacagccttggtttaccaggctaaagatgatccaggtcaggaaaactgtgtgctttaccaaaggccagaaaattctaccattcttccaagatttcttgctaaaattcaaagtaatgtggtcttgaaggggtgacaccaaagcagctgcaaaggaagaggaaaacccggctgccacagtggagaaatagattgtcattcttttgcacagcttttccctgggtaatgtcaggattatatttttggctccctggaaaccagaattaaaataggctaaataagattggaattgttgaaagcaaaatctgtagacgtttccttttttgaattttttgaatgtccacatcttctgtatgctttgcttctttttggagtgacgtattgagaaagcccaagagattgtttctggcttgggcccattgccagccattgtccgtgccattattgtgtgtggtgggtccctggaggccacatgtggacctcgggttgatactttcggagattgtaggtagttcgagccacactagccctgtttacttcatgtctgccccaagcatcaagtcttgttgtttaccttgtcactttcccacttaagattctctttcatttcactgggttttactaaagtgtttgaaatacagggtttttaacttcctttgattagtgagaaatatggggaaaatttatctcccaaccttatcagttgggggcagaccaaccccagtgaagatgagaaacttcatggagtattaaatgaaaatgggatgagctgtcacaaagccaggatgttaattctagctctgctgatcatttgctgtgtgaccttgggcaagtcttttgctctcttcagtctcagtttcctcatatcttcagtgagccatctctcgggatcttccagctctggtattctgagtttctctaatttgaggagttggttagagatctcttttctcaacagtgtacctgttccgagaaatgttactgttatagaaggaagtggttttggaaacgggtcagagtggaggaaagaggttgagttctcaaaaaactaaaggctaggtataagtaactgattcatcacagagatgactaattcatcagaacagctgtctgttctaaaatatgtcacatcaaatattcattgaataaaatattgaagtctcaactgctaacctagagagagccaagcagcttttaaaaaatcaggatagaagtgtacttttcatttccacattggacctgtgattctctgagtacctgtgtgggtctctggtaaataccagaattcacttaattttccatattgttaggaggctcaaagccaaaggcgtagagacattaggcataagcatatgtatcttattaagcatctgtatgttatgttgtggggtttggcaaccaagaagatgacagttacttacaactgttctagaaaaggcaaccactgaaacattcattgaaatcacaaaggacacttgcttgagattcattgtgttcttcacatttgctatttttaactccatgattcactgttcttttgagcagggaggggaacactccacagtggcattccacatctgtgcacttccagccggggtccccaccccacgttcagccacatttgcagcccaattattgtttccattcttttgtttccttccaaaataaaactatatatgctatgtatacagtaaactatatagtagtgtctctatattgtgtaatatttcctgttttgtcactcccttctgggtagcggcctagcttttctgcctccatttaattcattaattttctaatttaagccttgtaatactcccatgaggtagtgatgatgatgatgatgatgaagagagaagagaagcacaggaggtgaagtaacttgctgcccccccctaaaaaaattcaatggaaggacatacaagatgaatgaaaaataattttaaaaaagtgaaagagcaagtatttgaactcaactctgcctaattctaaagcatgttctcaaaaatcccaacagaagttgttattttaagctaaatttttttgagacctctgatattgagtgaaattacactaacgtgcacctcgtgatgtaggaggagggacaggtaatgtgattctccctcctcaacctccacacatgcttcttcagaaggcggtgcatcagacgcaccatgactctggaggtgccggtcttcagcctattgtgggtggtcatcatgatggtgagactgcccccttcaggttctttcatgaagtgcaggtttcattttgggcttggctcctttctgtctcttttggaagccctttgttcctgattgcactttctagcctgtgtacagtctaaacctctgcgggaaacagtgtgtgcttctgaaaagggctccagcatagcaaactcactagaaagccggacctcagagcttgaccaaacttggctggagtcctagttctgtatttacaagttgtttgatcttggacaagccatgtaaactctctggacttaagtgtcctcgcctgtacattggggaaaactatacccaccttgcagtgctgttgtaatgtgtagaggtcaggtgtgtttgtgaagtgccaagaacagcaggttgtcagtaagaatagtgctgttggctgggcactgtggctcatgcctgtaatcccagcactttgggaggctgagacagatggatcacctgaggtcaggagtccgagaccagcctggccaacatggtgaaacctcttctctactaaaaatacaaaaaattagccaggcgtggttgcaggcgcttgtaatcccagctactcaggaggctgaggcaggaaaatcacttgaacccaggaggcggaggttgcagtgagccgagatcgcaccattgcactccagcctgggcatcaagagcaaaattttgcctccaaaaaaaaaaaaaaaaaaaaagaatagtgctgttcttattgttgtttcttccatccccctacagcagagtttcttaacagctgtgctattgacatttagggctggatagttatttgttgtgagtggctgtcttgagtattgcaagatgtttagtagcatccctggcctctacctagtggcttccaggggcaccattgccctttcccagtcatgataataaaacatgtctccagacattgctgaatgttgccttgggggacaaaatctctccaagttgagaactactgctcaaaagcctggcattatgtgtattgatactaagatgagaatctcaccaccgagtagttccagaatacagaaccctaaaaagatttatgaagataacattagtgattctcagtgcaaaatgacaaagtgtttcagttacttgaaaataaaaggcttctcttatgcactgagccatgaaagtctgttcagagttaaaaagaaatagttgcttttttggtttttgcattcagtattgtgctgcttttgcaaaggcaataattttatgacagttcataaaaccatggaatcttagagtatgcataactgacatgttatgcggatcaactcctatctgattcttgaatttgcaatgaacgtaatgagtgggagtgaaaaaacagtctctccccaaagcctgaaagtgacaggaaactcatttacttgcaaaataaaacccaagtatatactggaacaactctaattattacagaggatcctcctttgggatgaaagttttgttccctgcagctcctaccctctctctggtccctgccctatcctccaaggaccacacagaaaaagccctcttcactgactgaaaaaatctagatgcttagggtttgtggtcagctttgcaagctggcacaggtaagggaggaaacactctgaaattgcagtgcagcatttcaacatttcatgtgtgttacttagcaacaatagcaggaggcctgccagatgtaccagagtcatcgtgcctcgctcaggttttgtaggatccattataatcatctcattattggtctggcaaattgggtttatagtgcccagaactatgaaaatagtagttgaatttcttccatacactgaggccatgtaagagccatatttgggaaatacatgcatttcccagccctcagaacaattgctgcaatggaaggaattctgcaaagtcaacttttttggtagccagttccaggctttttggcctatgattgccacaccccaagttttctctctacaaaaagctttgataatagtctttttccaattttaggtcaccttgcatagcccctctggcttgtaacgtggtcatttccaaccgttctacattcttgatgaaatgaaaacagcaagcttcctgttgacatactcttccacagttttcatgaattatgcattttgaaggcagcagacaagatggtgtctcagtcctttccagcgattctccagcatggaggtcttatttggtacatccatcacaagggcccggagccaagatgatctcttgagcacaatccccacttcgtgtttccccttttcactgtgtaggccacagggaagagtactgtgggacccgaggctgcttgatactcatcaaggcccgcttcctccagccttcctagcttctctttccctcaggtctaggcgtggagccctccaggacagcgaacgggtgataaaatatacaaactgtctctgattatgggattttggctccttagccaatgcatgcaaggatggtagaaaaaacactcatcttccttctactatcctaaaagcaacttccgacatcaagaatttttttggatctctcatccaaaggtataaaccttaacagtgggaaattcagaccaggtgagaggaaagggttacacactaagagatgacttaggtttgggtagtttcatcaggagaggtctgcctgcatcctggttcctgtccttgttttgggaaactctttttagcatacttggagtacatattcagttaaacttgcaaagtgaagaatcagagaatggaggcctaaatgtgattcacctgaggccacacgcagagtgaggagataccagtgtgcttcctgcagaagcatctcccacatctctgccaagcctttttatctcctttgaaacagaatctctaatggaataaaccactccagggatcctagagtcttgtgtttgttcctcctatgcagaaaggcaaaggaaaaaattaaataatatctgaataccgcccagtgcacagagagtacctgtgaaattacagggacattcagccagcaaagaatgtccccctggccagggtgcctggaggaaggcttttaagcattaccatgctgtacagcatggggctgccagcttgaccagattctagctggaaggatcaggcatctttaaagaccggtagcattcagggccattgctgggccacatggctcctttgtgcaattagaaaatgcagttccacagggtaggcagcacttagaaagccactggctggacttcacctccctttgttcccttggctagcatcttgggcaacaacattctgtacaagcatgcaccatggccctgctggcttcttggtctccacgtgcctccttcttgttggtcattaaggttatgccattttcccccattattaagtaatgtcaggtaaggtctgaggagatggagatgaagacttttacaggtcgcaggggaacactgacatgtcactcatcattttgtgtgtgtgtgtgtgtgagacagagtctcactcactctgtagccaggctggagtgcattggcagaatctcagctcactgcaacctcccatctcctggattcaagcgattctctcctgtctcagcctcctgaataattgggattacaggcacccgccaccatgccaggctgatgtttgtatttttcgtaatgatggggttccaccatgttagccaggctggctttgaactcctgacctcaagcgatctgctcaccttggcctcccaaagtgctgggattacaggtgtgaatccccgtgcctggccatcacccatcaatttttaaatggtggagtagctcccatgatggatgttatgaaagggtctatgggtgcatatgaaagggagtggtcattactactcagtccaggtaaaactccctggatggagggtgaagacaatgtggtttgagttgttaggtaaatgtttccttatcatttttcattatatgttacatttacattctgttcatccctaagatataactccttaagattacatctctcagatgtaaactccaccagagtaaggactgtcttggttacctactgtgttcatttcctgagactgatgtaacaaatttctacacgttcgtggcttaaaacagctccagaggccagaagtccaaaatcaagatactggcagggctgtgctttccccagagcatctagaggcaaatccttccttgcctctctcagcttagtgggtccagacattccttggcttgtggctgtgtcgctctaatctctgcctttgtcttcacatgggcttctcctcttgtctctgtgtcttctcctttgtctctcataaagacccctatcattggatttagggccctcctaaataattcaggataatctcttctcaagatccttaaattaattacatctacacagacccttttatccacataaggtcatattcataggttctgggggttagggtgtggacatatctttctagggccatcattcagtgtactatatctgagtgcctagattactgttttacacctaggaggttgctcaataaatagttttcaatttaatttatatgtttcagccttagtttatccataagcttgccatgaggttcagaaaccatcatttatatccagagatggtataaggcagtggttaggggcatgaacatccgcgtaatacttgctgggttcaagttcagaatctctgcttgctgcctgtataatttgaggcaagttctttagcttctctctacttcagtttcttcttctataaaaagaaataataataataataaagatcaactttattggggaggggtgactattaagtcaagatatgcaaagagtacccagaactgtcttggactttgtgcccaataggttttggcttttattataaaaataaaagaatgatatgacaatgtacaatatataaacaatctcaaattgtttgattttatcagactccctctccactttcagaaacagctgagagggctgtcactgcactgagattagcatggcattccagaactcgggcccggtaagcatccaggtccaagggtgccttggaggggtacacctcacctttgcagtccagggcagaggaaggcagggaggctaggagtgcagcactgagagagcagtggccactgccttacaaggccaagaagcgtcccatctccccaacaactgtcaggttccttcctgccctgggaacagctctaatctgtctgtttaccacctacctgccagccttcagcaggaattccaggactgctgggcctatcagctgaagtagaggatgaaaaagaacaaatccaaaggcagaagaaataggacaatatgatagatggatttgacaagaatccagaccaattgtgggcagaccaagttgaaaagcgtgagaggctagagttatctcagcaggggtttcgttttgttttgttttgtttttgagacagtctcactctgtcgcccaggctgaaatgcattggtgtgatcttagctcactgcaacctctgcctcctgggttcaagtgattctctcgtgccttagcctccagagtagctgggattacagttgtgtgccaccacacccagctaatttttgtattaacaccgtagagatggggtttcaccgtgttggccagggtagttttgaactcctgagctcaagtgatccatctacctcagcctcccaaagtgctgggattacaggcatgaggactgtacccaaccatctcagcagttattttaaaaaatgtttagccttctgatgagaacacgtggacacgtggtgcggacaacaaacactggggccagtcgagggggctgcggggagagagatcatcaggaagagtagctaacacttaggtggtgggttgatctgtgcagcaagccaccatggtacatgttcatctctgtaacaaacctgcacatcctgcacgtgtaccccagactttaaaataaaagttgaaggaaaaaagttcacttttctgctttccagttgcttatttaaaaaaaaaaaaaaaaaaaaagaagcatctggctgggtgtggtggctcatgcctgtaatcccagcacttcgggaggccgaggcaggtggatcacctgaggtcaggagtttgagcccagcctggtcaacatgatgaaaccccgtctctactaaaaatacaaaaaattagctgggcatggtggcgggcacctataatcccagctattcggaaggctgaggcagggagaactgcttgaacccaggaggcagaggttgcagtcagccaagatcgcaccattgcactccagcctgggcaacagagcgagactccatctcaaaaaacaaacaaacaaacaaaaatgcatctaagttgtctgagtgatgtcctgctcaagtccataagggacttgctttattacagaaaagtggccaaacccagtaatattgaaagtatggtccagggactgcttctggtcaggcaactgtttattaccagtctgtgacaaagacagaaattgccagtaaggtgtttagaaactttaatagcaatatgatatcccaatgggtgatcaatggacccatcttactgaatagggtagagacaagtttgagtgtcgttgcactcacgtggtgagctgcatgtgtcgtgggctgagtgctagtattggtctgtgatggattgggatcagacccttgtccatgaccataaaatcttgagcaatattgcagcaagccaaatggcaaagatgactatgtgccccaagaccacacttttttttcctatagtttttttaagagagacacggcctcgctctgttgcccaggctggtcttgaactcctaggctcaagcaatcctcccatctcggcttcccagagtgctgggattacaagcataagccactgtgccaagcctccctaaatgtttaaatcttgtcattgccaccattctgcaagatttacctttgaatctagaaaagaacttggagtctttctactaggcctatccccacaccacttcccatcatagaggtgaagaacctgaggccgggacacaccacaggactctcagaatgacacagccagtcagattttcctggcacaaaacccagtgttctttcaaagccaccattcttttcctgtaactaatgcaaaagcaaatcttagcccatgacagggaatcacagattccaaatgagtgccctcagaatgactggtttccttgaaagcagctgtttcataaacatgactttgcgggggcagctcaggccttccatgcagtggagtctgctggtcttggggctgctctgttaagcaaaggatgggaaccaaaggtactgacattttaatattagccacacagatgtcttggcttgtaatctggagaaaatcagtcagtgtcccagctgaatctgtaaataggaacgacaataagatttgctctctctcgggacatcctaagaatttttgtcaggctagaagaggcagcctggagagatttgtttgatctgggaaagcagaagtcaaacttggtttttcattcggtaagatccactgtggttaaaatgtggtcagagggctcattcagcctcctacttcaggtcgaactatacttaccttctcttacttttaaagaaggaagggagattctgtaaatgagtggcttttcttttagtcagtgctgtcatatgccatgacaatattgtatttaagtctgttctcacagtgctaataaagacatacctgagactgggtaatttataatggaaggaggtttaattgactcacagtttagcatggctggggaggtttcaggaaacttacaatcatggcagaaggggaagcaaacacatccttctttacatggcagcagcaaggagaagcgctgagcataaggggggaaaatctccttgtgattcatgcctgtaatcccagcactttaggaggttgagttgggtggatcgcttgaggtcaggagtttgagaccagcttggccaacatggtgaaaccccgtctctactaaaaatacaaaaaattagctgggcatggtggcaggcacctgtaatcccagctacttgggaggctgaggcaggagaactgctcgaacctgggaggcggaagttgcagtgagccgagatcacaccattgcactccagcctgggcaacaagagtgaaactccgtctcaaaaagaaaaagaaaaagaaaaagaaaccattagatctcatgagaactcactatcacgagaacagtatgagggtaaccactcccatgattcaattacctccccaccaggtccctcccatgacacatggggattatgggaactataattcaagatgagatttggatggggacacaacgaaaccatatcaaatattaatagagtctggcagggaggaagcatgacttcatactggtggtgagtcagaaggggcatcttcatattttaaggaaggtggcacttagattccaagtgcgtcctgtgtgcagtggagtcatatgcagctctaataaagaacattattcaggccaggcatagtggctcatgcctgtagtcccagtttgttggcagcctgaggcgtgaagattgcttgagcccaggagttcaagaccagcctgggcaacatagtgagacctcatctctacaaaaaatacaaaaattagccaagcatggtggtacatgcctgtcgtcccagctactcgggaggctgaggcgggaggatcacttaagtccaggagtttgagtctgcagtgagctatgatcatgccagtgcactccagcctggacaacagagcgaggccctgtctccaaaaaataattaattatttaatttaaatgttcgaaagaacattatgcagatgcttctcaggcttctcttcagatggcaaaatctcactggttttcaaatatcctaactgaaatgttcagttccagctatcttttgcttcatccagtaattagtttcaagtttttttttgcctctttttagatatgaatcccatgctaggtaacaaattatagtgacaggaaaatgtggatttttccataaagtttaaatattcaccactcaaccttttagcagaaagctctgggaccaacctagcataagtatagagttgagggttaagagtaagcattcttcccttcgtcacttatgtggccttgaaccaattagttaagattttgtgcctcattttcctcatctgcaaaatggaaataatcataaggtatactttggggattagtgtgaggggcaaatgagttaacatgtataaattgcttaaaatagtatttggcagccaggcttggtggctcatgcctgtaataccagcactttgggaggctgaggcaggtggatcacgagttctggagttcaagaccagcctggctaagatggtgaaaccccatctctactaaaaatacaaaaattagccgggcatggtggcgggtgcctgtaatcccagctactcgggaggctgagacagagaattgcgtgaaccccggaggcagaggttgcagtgagccaagattgcatcactgcactccagcctgggcaacagagggagactccatctcaaaaagaaaaaaaaaatagtatttgacaatgacgatagctgctgttattatcatgacccaaatgctatatttgcttcaagcaaatggaatgattctcagaccaaattttttcaccaggcatttattagaaggaggtttcatgtaattctgaattatgctccgaatcatattcacttcattcaatatgaaaagcaagtatagatttacagtttaattgttttgagacagggcaggattcctaatcacatttttagaaatgacttttgtgtctcatattgttcatctcctctatcctctcaccaagattccactgtgtttcataccagcttgttcagttgaacaaggtggagaagcccatttactgtttggattaaatttttttatcaccagtgtatgaggatttgcattaaataaattataggtaattacattaacaaaccaagaagacttacagttaaagagggcaaaaatataatttacttaactgctctatgaaatctatttgtggatttctctcttctcaaaggagaattaatcagagaacaactttgttgttattgttgttgttgtcgtttaagaaaaaaaagaaagaatgaatgaaagatcacatagtagcagtggtaccctattcaccttgcaacagttgtactctgcgcacctgccccaggttatagcaacatcaaggtcaagctcccaatatttcaagtacaaataagacttcacctgtgcacaaacatgtgcttacacacttccatcctcctgaattttctttccagactgttttacagataaggaagcagctctcaaaagacctctctcagacatttgaaaacacattttttttcagagtgctaaattcatgcttcttattttatatatgttagaaataaacacataaataataaacagtcttgcctggactggttcatgttcaattcataggcactgagtattctttattaggacatactcactattgtttgttgaattattgcacttttaagaaatcaatctgaagattaaacattaggagtctcgataaaaaacaagtctctatactttatgaagatcttaggaatttctaactgactttggaacagccatttgttaaaaaacactttcccatcccaaactccactgactccatttttcttctgcactaactctcccttcctcctcccccatatttggagcagcgtctctatgtcccattcactctcctacacctgccaaatcaccagtgactatttaggggctaagtgcaaaggagacttctaaatcctcactttcatcaactgttgagcagcaacggaagctgctgaatgctccctatttcttcttgaaacacactctctccttgtttacttgagatgacactatccttcctctgtccatctgggaaatattggtgctttgaggttcttgacttggggctcctttcttcacttctcccattctctgagtgacattgtctgttcccatggcttctgaaatataggcattctttgatctaattttttctccagacctacccatatagccaactgccccctaaccatatccatttggatccccccagacacctataactcagcatgctaaaaattcattagtcattactttctctgattgattccttttcattgattcttaatctcattgaaaaacatcaccatgcacccagttgcccaagtctgaaatcaggacattgtccttgcttcttttcaccctttcaaatcctctatctaatcagtaattttatataataaaaggattcttgattccttctacactttttctttcccacttccatgacagtagtccaggccaccattatctttcatggggattgatgcaagagcttctcacctagtctcccttcccctagtgttgtgtccttctgacctaacctctgccacccagcagaagtatctttcaaagttcatatttgatgatgctactctccagcttcaaaccctttacctgttttccttggactataagataaagttcaacttccttaatttagcttagagagtcttttatgatgtgacctcctcttacttctctggccttgtctctcataattgtgtcattccattgctgaccactccagcaactacctgccattccttggatgtaccaagctctgtctgtgtcccgttctttggatctactgtcccttctccaaggaacgttcttcagctgctctttatgtggttaactcctactgaaccatcaagtctcagctgagataccactttccctgagccctaaaccctggtttaatgtttcctgtgggcatatttaccttagagcttactgtgtcatagtacattggaagctgatttttttctctatcctcctctagcctcagctgcctaggggtaaacacactacagtgttcacccttgtattctcagatcttagtacactgccaggctcaatgggttttcaaacatatttacataaagaaagaaaacaatgacaaaagtgcagatgacatgcccatggatactctggacataaatgcttgtaatatttctctctgtaagcgtttccagtgggaagttcagcttttgtctcaattactctgattggcatgcaatcatgacaagaaactaaaggaaggagattgttttcttgacatttactgagaagtatagacaagtactgccatgaacaaacattcttgctaacaattcttgctctaaattggttgatataacatccacttgagtcaaaatgattaagtaggtatccattgagtgtcatgcatcgcaatggcaaagcattggagttacagaaaataagtaaaatcatctcccttgctcttacagatctgacagtctaggcacccaatagatgggtaaacaagtactgagagatgtcatacttgtcctcaagatagtagaaattcaagaaagtagtgaccatggaggaccttaggatttgggcttttaccccagtggtgtttggctgagttaatctttctaaaatgtattcatcattcaatcaagtgcttcttctggaggccaagcataattagagatacagagatgaaaatgacagtcattaccctcacaagacctataatctacccaataataatgggaggcaagcctttagagttttttaatttggagttttcagagatttcctgaagcttctggactgacgtttctattgtacttgagtcccatcatttgacattagaagatctccttccaagaaatatttcttaccaccaaaagacagttaactttgacttcagacagaacattctggtctgcacccagaacctttaatacctgaatcttttaaatcagtgatggtctcttcttctaaaaagtaaaaggtaaatcaaattcagtatgtctcaattaattggaagggagtttcaagctcataggaaatgaactacgaagccatgttgggatatgaactgaatggttgctattgagatggagcaaatgtacctggatatcattaggtggaaccagactggaaaatgggggtccttccttgacctcagtgaagatttggccctttcagcctcaagtagtatcccagctccagaactggacctgagttactggataatgctgtcattaggaaactgtgaccacctaggagttggactgctaaatgggcaatgtcagcaggttgttacagatactctatgcagaccaagcttatttggctcttctcagctcagccacctgttgtaaacagctgagaggggcttagctccacgtggaggttgtcactatctctggtatgttgtctctccctgggaacggacatgagtgtggaaacagggaggacacagttgattcctgctttcactgagtcactctgtccattaggagaaacagtccaggcatggccagccaaagggaggttcttcgcaggatcttctgtctctttgaagatgggataatctcaggcctaaccacagaagcagttctggagaagagtcagaatagcagattggaaacagctcacaggggcctctgaatgctaagtggagggacttagaatttatcccagaggccacagaacactattagaagtttcagaggtataataaaggccgttgtgaggttaggatgctggttcaatgtcacaattagagcaaggcaggaggtagagaagtcaagggcagactgggaaccagctgggcaggccactcattttggttgaatttggcaagactgaggaagacaatctaccaatagaggatggatgagaacaccagaaagcaaataaaacaagtcattcaaaaatcccaagatcatcgtggctgggccagagaaagaatcagacagaagcagcgcacggctctggagagttgcagggagaagcattgctgcatccgctgtctccttttctttttctttttttaaatatcagcaatatcttggatctgaatagagttctatcacagattagggtttctctttccccagggttcccaaagactgagcaggatcttattacagatgcagcgaaaagggtacgtttttcagtatcagactgacctcatctgaatctcagcctcacatctcattaactacatgggaccttgggcaagctacttcacccatctgcaaagtgggaatcaatgatatgtatctcatttggctgttgtaaatcttaatcaagttaatatatgtaaagtgtctcatcagtgcctagcgcatagtgagttcccagcttctatagcaccctttcatctttctctccttacagcatcagagagcttgtcctctgtggctcccgtttctctctggccagaggcagagcctccatgggagcatgggagggatataatcagaacagcagcattctttcattatgacgtcaattcagccatccctcaatttactgagcccctgaaaggccatacagtgagccatcattgtaatgaagtaaaagtagctggatactccaggaagcccttctagtggcactttgttaggtgagatgtgtcagcattgacttcttttgtaagtgctacttctgttgaattcaatgcgttgaaaggtggaatgcattgatgaatgtattcagtgccttggccacttctcagttagcttttagagtagaggacctcatggccacatgacagagtctaactgtcagtttccagacatttactgtgcccttggccctgcttggactttggaaatccaaagatacatatgaccgacgcctgctctgggaggaattccctgtccatgtggaacacatctatgcccttctggtccaagtgagaagagaacatgaaggagcaagtgtgcatgcccataagtgccggtccctactcagttctcactcagtcccacagatacccaggtctactttatgtaggtccttgtgttggtttctggcattgctgagatgacagaggccccagtctctggagcctcagagatttcatggacacctttttctgcttgagctcatgagccagatatcactcctggcccaggtcactgggttaccagatgcacgggtgaaagagctgctcttgagcaaagggcctgggacacacatgccggagaagcatggtgagccagccgcagggaggaagagcactttgcaggagcatgctgtgcggggtcttgctgctgcttttcagaagcaggagagccatgagccttggggttcacatcagcaccgagactggcctttggtggcagggaggatatgcgtaccgggaggggttggccatactggaccacagggccactggttgggttgttcataattgatctttggggacacttactgcaacccatttattaggtgccccctctaaagtgatgatctcaatgaagatggttcacataggcccactacttctagaaggcccgaatccctggaccttcccaaccactttttctccctgttcctgggttacatggcttagctggatatttttgcacacagcattaagggcaagtgcactgttcctttgaaaacaacaagggaacaaggagttcagtgttgtggacatttaatgaactttctcctcctaagtacacaataccaaatcagcagaatcacagctgtctcctcccagctttacctaaattcccacatgtgctacctcagttagggaactatgacttcacctgccactagatggccctccatgtgcacataagccgctcccacatagcgaacttgcatcagattttctggatttttttttttttttttacatgtagacacacatgtgcatacacaatcttaacttttaccatccttgaagccaataatcaacactttagttttccttctggcattcaaatgatagaatgtattctcattctctggaaaatcagtttaacatcagaatctacagatattcctgaatattgtgggccacaaagcacatattaagatgaatttgaatttattctattaaatagtatgctttggtttatcttataaatgctgtatttaacagacttgtttctaaattaaatttttttaaagcactggaagagaaaggaagcacaaacatttgaatagtacttgctccatggaggcgggcagtgttctgaggtattttaaacattagctcatttaagcttcataactttgatgtaggtattccatatgcatcattataaccattttatagattgaggagaaaatcagattgcagcatgaaaggtgtttagattcccttttgccttcctgtcaattttcttacctataacatgggaataaaataatccctaattgctgtgaaaggatgttgtaaactctaaagcattacacaaatgttgttattattattatgacttgggtttcatgggaatataattttcttatgtgctcaggaggcttgtgatcattcattcattcacatgaaaacatttatgcaggtcccaggtcattgcctctgcatgagacgtctcataccgagatgcctgtactatttctaaaacaaatctagtctgtcttgaactctcttatagctgagggttccagggaagttgctgtgtgctttcagcaggtaattctcccttagtctcaggatttagaaatgatggatgtggtaggacaacttcaggggtgggacctctgctgaacacagaggtggccggtgctgatttcacataagccaagccagcgggaagaggcaggctgttttttaaaattattattctggagcacgatgtactatctctgtatccaagagttcacatttcaagtggactatcagatcatctctgtgacagagggctttaattaaaagcataagtctctgggtggattttaagtggcattgtttttctttggacgttatgcaagccacttctgtgctgtaaaagggcttttaaaatttggcttaaggaaatttgctttacccctcaggctttgatccctgcgtgtgaatcattttgtatctggaggttccaatttgcagtctcctgggtgtaaggaaaattctaccctcacagaacattttggatttgaaaactgagaaatctgcatcattctcgacataatagctgttgtaaaatagaattagggctgttaagtctatagggataaagttcaccaaagaatattttaaactttagttttagttcctaaagtttttgtctccaactcccataataaatgtactgggacagtgacctacccactcaacacctgaagctcagtgttctctgcactcaggccaggtggactcagccatcgaggccattgtccctgtccagcctcccagggggcacgcatgagccagggccaggatacagatacttctgcctcaacaccatctgtaccaccagaaaagggccccaaaggcccttctcactgccatttgtaaggcaaaatgtctctattttatctaagacaggaaaaaggcagagagatgccagagagaatgcaacgactgtgcccgtgagaaaccaacagtgcagggtggcgatctacccgcagcacatgcaggatgcagcgttagatgctgactcagtttctcagccatacaggagaaaagtttcagcatttctcaaactccatgaccatccttcagtcggctaccccaagccccgttttgctgcagccgggtgagggcagtaatgcagctcagtaggttaaggggccaggctgtccttggacttcagatgatatcagttcagtccctgggacatcttaaattagggcctcaagcttcaaattcatgccttggccaacacgttaccataaatgatcacagggagaagaaacagtcaggccagggatggtggcaggttcctgtaatcccagcattttgggaggctgaggtgggaggatcacttgaggccaggagttcaagaccagcctgggaaacatagcgaaaccctgtctctactaaaaataaataaacaaataaacttttttacaaaaaagagaagaaatggtcagtttacgttgcatttccttcttttcctcaagaagaggtgccccgtggtgcctgggacagctgggccatcacatggaagtggctgagaggtgggctggaaagaagaggaaaatccagggctcccaccaaccccagccaatctctagtcactgggcaacctcaatctacttctggtcatagttttacaattttgcgggggtaggggggatggaatcttgctctgtcacccaggctggagtgcagtggtgcaatctcggctcactgcaacctccaactcctgggttcaagcaattctcctgcctcagcctccccagtagctgggattataggcctgtgccaccatgcctggctaatttttgtattttccgtagagacggggtttcatcatgttggccaggctggtcttgaactcctgacttcaagcgatccacctgcctcagcctcccaaagtgctgagattacaggcatgagccactgtgcccagcaatagttttacactttaatattgccaactttttttcagcccagcctgtgcagccacacaaatgcaaaaaggttagcttaggaagttgtcaacatcattatactataaaaatcaataaatggaaccttcttgcttcccacagtagtccatgctaagcttggcttcaccatcccttgcttggacaactcctaattgttctttatggtttcactctgtaaccctttcatacatccaaatccgttcttttcacatctgtccacatggtctttctagaacatagccaatcctatcactgacttaaagcaaacacataaacaggcagacagacaaacaagaaactcaaatggctttctgttactttccgaatcagactcattagtgtggcattcaagagccatcatatcctgagcctgatcctccctgtcactttctttccctcatgagtgcactcagataggccagtcctacagaggtcctcattcactcacttgagcctgccttgcacatttctgcatcaaagcccctttgtccatgttatcatcctagcttgaaatgctgtctgaacacctctatgccttgatcatttttctcttcaagatcctactgacatgttccaacctcctgaaatcctgccctgcctccccacaagcagagttactcagactctcttctttgcattcctgcagcattttggtcttgcaatttgagctctactgtgcactgcattgtaactattcatatagcttcctccctcatgagatgatgaatttctcaaaagtagagactgggcagctgttactgaatatagcccaacacttgcttgataatgctcgataaacatgaatgagtgacccagaacatttcaaacttcccttccaagacctgaaagactcatatttctgggtgttttaagctctgtgatttctgctctggtcacctgggccaggaactgcctgcctctattttcatttcaggcctttctctctctgccagatgccttgatctctgagccgagtataccttgacccaaagccatgatgcagccctcagcttctgagaggaaggggtagggttcagtagttgcgcctctgagaacatgacagagaacaatagcaggaagcagccaagcgggaaacaatcagcccggcacaacccatgtggaggagcttcctgattggcttgatctggtgggagcaggaactcttacaataactctggaattatcccagtgggatgacaaatttctccactgaggagaagctgtcacctggtaatgtcaagcacggaaaacacagttagcaaaaaacaaaacaaaacccaagacaaagttctcttgaggaagagcagtttggatcagttggaagcctcccagccactgccatagcaccccatgccgacctccttcctagtctctgtttcaggtacaattaagtcgtcatctctaccttccggatagatatcattctgccgtccatggctcaaaggtcagaggtgctgtttattctttggtgtccttttgggtagtttagggaaatccatgctgtaggtgaccacaagagagaatgttcccttttagaactatattgattgagcacaggctgtgtgcaaatactcttctaggcactgtggatgccatagcaatacatgctgtttctgctttcatagagcagtgatttccaaatcctgtgtatcctatggaaagaccaagccaggcaaggggtggagtgacaggagctcccagtcagctttctccttaaaccacagcagctccctttgatcaagatgttggaaaagaaaaatctaccccaaaaagaggaaatgctgaaaacatttggattgggagtggtttcatttgctcttaggcaggacacactgcagggtagcagttaatattctaggctctagctacaagcagacctgggtttgaatcccagctctgccacttactggtggaaggtcataagttgcttgaactctctcaacctcaagttcttcatctgtcaagtgcgaataacagtagtagatattttaccaagtgcaaagaattgaataatgcttacaaaccatttagcatatcatctggcattgtctattacagtaaatgctcagtaaatgtgaactattttacccctgttgtttgacgttaattttttttcaatgaatgactcattgagatactaactcatgcgtcttgaaaacactaccagtctctccagagtaacctccaatatggacaacaggcaaaaatatggtgattattcccagtttgggcatttgtgaaagatgtggctgaggctgtatggatgcgtgtgcacacacacacacacacacacacacacacagaggccgatgggaaaatctaactcagcaggaaagctatcacagagcgctggatttaggcacaatgagtaaacagggatttggaagagaggaatgcaccacataaacaattttcacaatctggtatgaaagcccagatgcttcctgcatgaaggggtgaactcagagagcgtcacagggcaaaatgaagtaaatgctgagactgtccatcattctggcccaattcctacatatctgtgcatcttctacttatggttttatttaggtgagaataaataagagtacctcatagtagataagaatagtacattacacacgcgcgcacgcacacacacacacacacacctggggttagatgaaattgtatatttggggaacttggggtaaagagtacagagccacacagcagttaccttctgcatcctcctgcttcagagaaagcaaataagaccagtttctttttaatctgttgtttttactaagtccaggattgatgttaatttgaatttgttcttttaagattcatttttgactgaaagaactgagccggaaggtctgcttgaggctacttccagttgagaaacaatttatgtgttcattgagacagtcatttactcaaccaacacttactgagaactttcaatgaggcaggttccttgctagatacaggccagctagatgctagaagccatcatcaaaggaagatgaaaaagtgatggtaattatcctctagaggtttgtaaactggagttagggaagggagcccaaaatccatgaatgagtgattaaaatacagtgggataaagttggtggtagaaatatgtccatgagatatggcagcaaagaagaagagcaccttcatgggaaaagtccaaagaagacttccataaagagatgatacctgagcagatgctttaaaaatgagtagtaattacccatgggaaggggaagagagagaacaagggcaatccaggcagaggggtggtatgagcaaagtcattgagccaaacaaggaaatcttcatttctgcaggtaaatgagaggctgggagtgtgtcatatccatgagctttagcagagagcccatgaggggttttcagcaggggagtgctattgtggtgtgtctaggcacattctggattttagggtgatggggctgcatagaagcagagagattggttagaaggttgttgcaggcatttaggagagagcctatactagggctgaagagaagcagctatgaaaagagatttgtggggcaaattggcttggtggctaataagacacttagttgacctggtgactaataagatacatgtacgtgatgatagtaagcgagggtcaagccagaggtgaagacaacatctaggtttccctcctaagtagaatggattaacggtggtaccagcatctgagctagagaatagggaggagcagctctatggagaaagatgagtttggtcctgtatatgttgtgtatgtggaccatccgggtggagacattcaaaatacaattgtacataaaggctggagttcaggagagatgctgaagatatagtttggatagatttaagcatgttcggtaggaattaaagcatgaggctggacatgagtagccaagaattaaatgttaatcaataagaacaataaaacaaataaacctttagtggtagagtaggagaagaggtgcccatatggagaacatggcgtcatggtctcttcatcatggaggaagagtgatcaaatatgtttttaaaaacgaagaagtcaaacagatccacaccaaagagggtccgctggacgtggcagtcatggacttgactaggagcagacgcagcagggcatgagggcagagggactgaggctgaggcatggacttgactaaaagcagatgcagcagggcggtgagggcagagggactgaggctgaggcatggacttgactaggagcagacgcagcagggcggtgagtgcagagggactgaggctgaggaggggtcaggatgtgaggatgttgaggcagtaagagatgactggccttggggaagtctggaagagggattcagcagcaactagaacaggatgcagggtcaagagaagttcacttatttttagtatggaaagagataattcttgtttattgactagcaggaaggaggcatcttggagagaggtgaagacacaggggagaggggatagttaatggggtatcctcccagatcagtctgcacaagctcaggtgcaggggtggaggcgctggccttcaacagacagtctgagtcagaggctggaggtcagaaggtgtggctggatgggactttttctcttcctagaaaaaagggacatttttagggggaaaaggagggggtttaagctattgagaaaagtactgctttgaaatgaaataatctcactttcctgtaatcaaaactctttatttctgatgaaacagactcaaataagaatcacaacaaagaaatcagtgctcagctcaagcctggaaatgatttcctacacggaaatccacttgcacagattctgatagtgtgagtcatgtgattccagatggagtaaatacacatgaaaaggagagaaaagctggtgtctccatgggctgaagcacacttatggagagagaaattttcatttatttgtatttgggcttcaatatgattacatcaccatcaataatgaaaagtgctgccatgtcccagctgtatacttagatcaagatataaatcagtccaatattgttcttttttctcactgaatatctaaatttgtatatttgaggggaaagtagaaaaaccaagccaagattttaaaaattacatttactatcaccatctccaagttacattcactatagaatcctttagaagcatgttcttgggtagctttgctttttatgcactcaacaaatatttattgagcatctgtatgtacagggaagaatgtgaggtacagtaacacaaaatatatagtcctatctcttaataagcctgcacttgggagaaggtatagatagggttgggaaggataaatatatttttaacactctaatacaaggcagagtgtaccaaaagttagaaatgctgtggagaatcagaatgaatgaacataccaggctgggttggggggctgggggaattatggaaaacattcctaaagagatgtaatttgatttgggcttttattatgatatctgttttcagacaatggagttgagagtggggagtccttcctggctttgtcaggagcagtttgaggtcttggctgaagacaggaaggcataaggctggaaaggggtgggagcagaacatggagggtgtgaacttccagccgaagaagtttgatggggtttgggaaggaggtgagagggagccaccaggaaaggatgtgagctggacctttggaattcttaaagggacccttgtcttctctgccatatttctgtctcagggatgacgtgaggaaaaaaaaaaaagaggaggaaatgggcttgagtttccactgacaccttacagtcaaggaaggccctgttctttcataaggaaaagtggaaatcctctgtttacttaagggccattaacatgttttcatattaaaataccaaatgatctgccgtgactccagatagactcatctaaataaaaggaagctgtttccttacaaattgagtcacaaaggataaatatttgtggagtgccatagaaacaaatgcgctgtcttcctgaaatgtggaaaatgaattttgtagcattgatttgcatgaaaacaatattcttcccagtgttctacctagaatattgaaatggaggtattaagatagatgatagataggacagatagattgctagagagctagattagatagatagatagatagacagacagacagacagataagatagatagatcgatgaggttaaatattcttaggatggaagaaggggtcagataatcacatctcagacagatctggaattccaggcagcaggaactaatgaagtggtctcttcagagttttaccatgggacgaattcacccccgattagtttttattctttgagtcacttctctcaagacaaagatctttgggcaagagttcagttggcctagcttagatatgtttctactccttggccagggatgtgagccttctgaccaatagtttcaccaaatctacaaggaaccctagagagacttttttcccagtggaggagctggatgttgttcctaaaagaaaagggcagagggaccctgggcaggcaaaattttcagctgcctgccaccttagcccctgtccccacactcacttctgaaccacatgtgatcagtcttctcttcccaccacataactgaaacttcaaggtcatgggtgagctctatgttgttaagtcttatttataggagcgatcagctcgctgcactgcaaggctggaaaggtgtttaaaatgtatacttaggcatgtcttggctctttctgatataattcagctggcaaaggctctggcaggaagccagacggacacaaatagcgcaccaaagagatgctaagacatgggtgattataattgtgcaaggagtagaaacttctctgctgagactttggatgtggcagagatttggggagtagaaggggggcaaagcacagttccagccaaccccatttacaggcgttgattagcagtaatgaattcacaaccttgcaattgctcatttttttttcttctgctgctgagtcatggataagactctaagctctgattagctgtgatccctaattctcagcacaattctaagagcattccttcaaattcaacaatatgtggtaagtgtcttgtattaattaggattccatgtggatgcaaggaacagagacccacaataacagtggcttaaacaagatgcttatttctttttttttttttttttttgagacggagtctggctctgttgcccaggctggagtgcagtggcgcaatctcggctcactgcaagctccgcctcctgggttcatgccattctcctgcctcagcctcccgagttgctgggactacaggcgcccgccactacgcccagctaattttttgtatttttagtagagatggggtttcaccatgttagccaggatggtcttgatctcctgacctcgtgatccacccacctcggcctcccaaaatgctgggattacaggcgtgaaccaccgcgcccggccaagatgcttatttctcccttcaataaaaatccacaggtctgcagttatgtaaacatccacaggcatgcagttaagagctgtttggtggctgtgccctgtgaattccttagggacccagacctgttccactttaaccctaaagactgatccttgtcaacagtgaccaagatggcagtttgtgcctcagctgcatacatgtgcatttcaggcaaaggatgaagaaagaactggagaagaaagggctaaagaagattctaggagctgacatatagcactttcacttacatgcctttggccagagcatgtggctacaaaggatgctgagagatgtggcctttactctgtgtggccatatgcccagctcagccacaggaatgacattgctttgagagaaggggaggatggaaattgagcaacttagcagtcccctttccacttttacttgtgctgaattcataaacatgtgggcagctttcctctcctctgagcagcaaacacttcttctgaggttcttgttttggcaggttggccagacaggcaccccacttgactgctcaactatgaaactgcagttccagagaagagaacaggtctgaattaagcaccttaagccagttggtcagcatctccttttattcggagagtagttactgagattcaaacccatgtcaactgagtagcaatgtgtttggctatagggtagggcgtaaccctagtctatgtctctcaatagtgagttatttcataaaggctcagcccatcgtcaggaatatgctggtcttgcgtaagcctttttcagaagtgttcatagggtcctgagaattttgtgagcacttctttactgcttctcttgcctcctcttttagttggtgctgagttcactgcatgaagggtcccaggagtcctctttccccttggtttttctactcctttccttttctgctctttctaccacctcctactgctggacctctttgtatctgtactccaccatggaaaataagttttgtttgccccagatcttcccatttcccagagtggagcctttataattcatgatgtttactaaacttgatctctgccctttcaagggatggaactcagataatgaaagatatagggagggatacattgcttaaatctgtgagtgggcattacgatgggcctaagtgtcccaagagggattggcttgccatgggaggtggtgagctccccatgtgtggagaagttcaagaaggtgtgaaataatcgttgggtggaggacagttcaaggacttcatgtttctggagagcaattaagttcaatggcttctactcccagtctgacctgtgcttctgtgagcttgaaaaatatatattgtgttgcaatgtgcattctttagggaatgaaggtaaaagggcaagtggtcatgggaggatgtcaaggataggggcaaagggtactggttccccagccagaccaccagggtccaaattctggctgcacatcatctctgcaaccctggacaagtcagtgctctttctgtgtatccatccatctgtgtcatgggagttgcagatttttttacttcatgggatattgtgaagattaagtattataatgtacgtaaaacactcataacagttccaagcacacagtaagcactcaataatcctaatccttatgattattattgttacatatattactgtatctagcaaaaacaatattagaattgttagtattataataattattatcatcattgatggggaaggaaaaatgaagcccacctgagttcacagacaagaccctctccaaacagtaaaacaattaaaaaccaagttgtatttgtctgtgctcctttggattcaactgaccaacacccaggcaaagggaaaatatattggcttgctttttttttttgagatggaatcttgcactgtcgcccaggctagagtgaaatggcatgatctcggctcactgcaacctctgcctcccaggttcaagcgattctcctgcctcagcctcccatgtagctgggattataggcacctgccaccatgcccagctaatttttgtatttttagtagagacggagtttcaccacattggacaggctggtctgaaactcctgacctcaagtgatccacccaccttggcctcccaatgtattggcttttgtaagtaagaagggcaaaggagtagctgaggatctgggaagcaggaactggagattgaatggcacgggtccccagcagccagcatgctctgtcttcccttctctttgtttgggccttgcaggaaggtaggctctcagcagagccttgaaggccaggtatttgagagccaggcaagtgaagcagaaggagagcatgagtgagccattgggagtggggacggaaacggcgagaacctatccaaggcaccgtgctgagctatgaagctggagggcagcgcaggctgtgacccaaaaaggccacacaaggccacatgctcctgagtgacaggagggacatgtgatatgctgggccttggcccatgctgtctcctctgcctggctcattttctcctcttttctacctggtgaatgcatccttcaaggcccagttaattcatcatctactttgtcgagtttttctcaccacctgtatcagttgagaattgcattcagctatgatcacaacagaggcttaagcccataacaagcaatctggagccaggcattccagaagtggtgtactctttccatcgtgccctctgggacccaggcaatgtctctctttctgcacactcagacatactattgcccctgtggacataggattactgctctgcctatagcatcatatcccttgcagtaggtagaataatggacccccagagatgtccacaggctaagcctcagaacctgtgaatatggtaggttccatggcaaagaggaattaaaattacagatggaattagagtttccaaacagctgactttaaaatagggagatcagtatcctggattatctgggtacactttgtataaccacaagatccttaaatgtggaagagggaggcagaaatcagaaggaggggtggctgcagggaaggtcagagagatgcaacagtgctggttttgaagatggaggaagggacccacaaggcacggaacgtgggtgacctcagggagctgaaaagggcaaggaaatggattctcccctagagcctgcagaagggaacacaacgctgccagcaccttgattctagcctggcaaaccccgtgtcagacttctgacatacagaaatataagataataaatgtagattgttgtaagccactaagtttgttgtagttgttatagcaggaattggaaacgaatgcgtctctttagcaccaggtccctgtacctggcaggaaggaaggaaaggcaaatgtcacttaagccaacgctcctttccttttttttttttttttttttttgagacagggtctcactctgtcacccagactggagtacagtgttgtgatcatcactcactgcagtcttgaactcctgggctcaagtgatcttcccaccttagcctccagagtagctagaactaagggtatatgtcaccatgcccagctaactttttattatttgtagaggtgggggtcttgtcttgccacgttgctcaggctggtctcatcctcctgggctcaagcaatcctccagcctcagtctcccaaagtgctgggattacaggcatgagccaccgcacccagccctcctttcccttttagggagttgtgtggaagtcccttcggatcatttttacttacatctcattggccagagctgtcccatggccagctttatcttcagtggaagctaggatacataatttttttcaggtgggcatgttgccatccccaaccaaataaggattctgttagtttggaagagggggagaatagatattgagaagaccactcagcgtccccaccacacactcccaggcagaaccaactattctacagcatgttgttctttcctctattattgctatttttggtttgtattgtaatttatgtgttcacatggctgtttgcattacttgaccaagaagtctcatgagcagacactgtgtctgatttatttctccatccccagtgctcagcatagtgcctgatacagagaaggtgtttgcatgaagttagatggatgaatgtctaaataaactttgaaataagagcatgatcgatgcacttcccagagcgagagttcctttctgttttcttgtgaggatgatctattggggttaggtacattttataagaccatttggccatgattgcaacctcatctccagtaaattaaacctacacagctgcagtgtgtcacctttccttatggcttattacagtttgctttttgctcagaaggaactgagcaagcaggttagaggctgttatgtgcacctgccacagcctacggatcctcaattaaccttgcgtgtaaattacacttcctgcccattctttatttttagcacagcaacatctacttggctcttccagagaagactgcattagatttcagtcatgaaactacaaaacagtggcgtctgcagcctggctgggatgactgttgttaaccccatgacactctgttccttgcgaagctgctttgccccaggactcaggttttcctgagaaagagagcagcctggactgaccacaccctcagagcctggcccaaggccacatgtgaacttatagaaaaatctgctattggatctgacataaactctccatttccttcattcattgcatttgggttgaaactcagttgttgttatcacaaaggtttcatttcgttccttttttttctctccctctctcttcgttccttctcagttacacagtatcatgacccaaatctttagcacctgaaccatatagcgcagagccttgaaacccatagggccagggcaccccgtggagacaggccagccagtgggcatcaggtcgcagagaattcttaaccacttaaggttgcttcactggaagaagtgagttactgagagacagccattttcggttttagtcagccatttttatcacgatcttgtttgttttagaatcccctgtagtgcctagctcggagtccaaccaaacaagctccataaatgttgattttgaatttaaatagatgttggggtgctcccatttccccttcactagacacatgggaagctgaggccctggcccctctttcatgccacagcctgggagatgctgccttctcagcagaaagcctcaggaggtattttgaaaagggaatttgttgttttcattctggttagataagttacaaactaattttttaaactgggaaaatattgaaaattgttttttaaaaatgaaatcacctttaattccattactcagagacaactatcactgacatttttctgttttttcagtcttaattctcatgaaggtgtgccctgtttccctccagatttctcagaggattcaggattagggaagggaggagagggtgccttatgttctttctaatcgtttagctttgggtattattgggatatatataaatacattaacacacatataaatatatgtgtatatatattatataactggcatatacattattgggatatatattagtaggatgtatatatatatatgtgtgtatacatatgtgtgtgtgtgtgtgtgtgtgtgtgtgtgtatatatgtaaaatgtatacacacttctatttgacctgtaccagttcattattaccacaataatgctaactaacacgccctcaaattcagtggcttaaacccaaagtcatttattcttgcccacacttctgtgagtaggctgggtatttgctgatctaggctgggcttagctgagtggctctaatttcaggtgcttctgaactatatagctgagagccctgaaacccatagggccagggcacactgtgcctatctatgggtttgcctcaggtctattccatgtgtgttctttctgtggtccaggctgaaggggcagcagctgcccagataagttattgtcttggcattggaaggggtgcaagaggacaagctcaactgggcaagcacttttcaagcctctgcttgtgtcttatctgctcacatcctattggctaaagcaggtcacatggctgcggccagtgccaagggactgggaagtgtaacccatctaccataagcctagagcaaatcacatggtcaagattgacatcagtggcttggggaagcatgtactcttcccatggaagtaagggaggaaggaagggaatatttttgagaataatgtaatcttttttttttttttttgagatggagtcacactctgttgcccaggctgaagtgcagtggtgcaatctgggctcgctgcagccttgcagcctctgtctcctgggttcaagcggttctcctgcctcagcctctagagtagttgggattacaggtgtgcaccaccatgcccagctaatttttgtatttttagtagagacgggctttcaccatgttgatcaggccagtcccaaactcctaacctcaggtatacgcctgcctcggcctcccaaagtgctgagattacaggcatgagtcatcgcaaccggcccaagaataatataatctactgcacaccctaaatatctgctaaagtactctgtactttgagatttaaatcaaatctgctcaggccaggtgtggtggctcatgcctgtaatcacacctcaaataaataaataaataaataaataaaacctgctcagagcccacctggttggtagtatcatccagtctacacagggaacctctagtccagagctcctctactcattgaattaattcagtttctggataatgtgactgtctcgtgtgttgttcctatttcacactcatgtctctttacttactccccccaaaataatttacacagatgtgtgtagaagattttgctgaacatctggaccagcaaagaagttttacatctttatgttcgtatctctagattggccagccccctctccataaattctctttgcgtctcgcccacacacagcctctcaagttaaagcttgctgaagaattcactcttgtctccaaaattctgaaagtcttatcttggctgggccacacctttgcgcaacttagctcagctttttaaattcattcaatgtaggtgtattgagcatttgtgccctctgtctgaggaatttataatctagtaggggaaattaataatgtatgttactatttggggccagaaaattctttgctgtagggtgccatccggtgcactgtgggatgtttaccagcatccctggcctctacccactatgtgccagtaacaccagtcccacccccttgagctttggacaaccaaaatatctctagacattgctgaatatcccctgagggacaagatcacctcagttgagagccactgctctaatatatggtagacttgataagacttctgataaaacaaaataatgtgctaagaaatgttcagagggaagcgatgttatttcctggcagtgaaatctgtgaacacctcatgacaggtggcatctgagctgagacttcaagaatggttgggagtttgagttgagtttcctagaggaggaaaagacatggggtacatgtgggcaaataagagtggctctatttgactaatgcatgaagtgaaataggcatgttgttagagtggagctgataggtactgggaggctagataccatggggacttataagctgtaggacttctacttttaccctgagtgaaatgacaaatatttcagagctgtgttcatttggaggaggttaatttggatatagggcttgccttcataacccaaagtaattgctgcaaagattatccctccagaggtcacttttctgacacccaggaaggaaacagaaaggccatctgaggggcacagtatgtcgctaaataaattcatgcctggatcttggtgttccttacctttcagaaaaccccactctgaactccttattttaggtctaagtctaatggccagttcccgagagcagattaaaagatggaaaaagagggccaggcacggtggctcacgcctgtagtctcagcactttgggagcctgaggcaggaggattgcttaagcccaggagttcaagacccacgcaggcaacatagtaagacctcacctctacaaaaaaaaattaaaaattagctgggcatggtggtgtgtgcctttagtcccagctccttgggaagctgaggtgggaggattgcttgagcccaagaggtagaggctgcagtgagctatgatcgtaccactacactccagcctgggtgacagagtgagactctatctcaaaaaaaaaaaaaaaaaaaaaaaaaaaaaaaaaaaagatggaaaaggaggaaggcaagggaggggacttatataggcagacacagactcagcagcaaagcttccagcacaacagaggggaaagagaccaaaagaaaaaatgaatgaatgagtgattgaatgaatgaaccaatgaataaattcagatcaaataattcaagaggcacagcaatctagagttttagcaagagaacatttatcccttcattcttcctgaagacattgctgcatatcagtgccatcctactctgccaatatatgtaatgtttaacaaggtgggggatgtggagaacactttagatcccatgtggtaagagttgctcaatggttaggaacagggtctagagtcagagcacctggcttgaatccttgcttcaaggctctgtggcactaaagcctgctttactaggttacttcaccttgccaagccctactgatctcatcggtaaaatggggattccctactcacagggtcattgggaagtttggataaaataatccacatgaattcttagctcagttcctggcacagaataagtgctcagtaaatactggtggtaattattatcatttcactgaaagaatatggctgttgagactttccccaaatcatagctgcagctgctattctggaatatttccagagtctcctggcagtgctgaaatttcccttttataaaatacataggatggctgtgaaaattgaggaaagttccaaaaggcaggggcagttgcatctgtcttcttcatttcccttctttttggcagtagaatccagaccacagagggagaggacaccaggctcccaagggtactggccaccagctatttcttggcaacatacttcctttgagcaagaatggccctttactttttgaccaacctgagagagcacttactctgagccggtcaggagaatatgaagctattttccttctgatgttatgtcctatgctatgtaaatataatctccctccaaataagaaaggtgcacatgcatggtgttggcagggaaacatcgaaacatattgcatagtggtggctgtgaaccagtggaggcagtgctgtgttgatttcccttgaccaatgtctgcccagtggcagagctggaaacacaagatgctgtgtaatgtaaaaccttggcctggctcctcagcgtaatgtaaaacaaaggctgccaggaaggtacaaatcgcccaacaggaaggagctgctctcttgcccgtggatggcaggacaataaagtaacttgtcctttgtttgtgtgttttccaggctggagcaagaaatacaaacgctagaaagtgaagagtcccagatatctgccaaagagcaaatcatcctagagaaactgaaggaaacagaaaaatccttcaaggactttcagaaggtgaagaaaaccaaaacgatttctcaaagttatttccatggggaagtagggcctagcaaaatggtgctaactgggaaacaggccagtgggcattgatgagaaatctgagccacgaactctatgaaatgaggggcagatgtgtgaggaccaggggccatcctgaagctaagcatgacatatctttgggtgtgggaccatctggcctgctgcaaggcatagggaagagtcattagattaccccatctgcctgctctccggatccctgatatgccttgtgcctgaaaagccttctcttattggactctagaattctaaaaccaattctgatgaagcagaataaacatgctctttgtggctttaattatagtttgctttttgagtctttcattataaaaaggccagaagcaacaccttatgaagtggacaagaattccaaatacaaagagtgtaaatacatgacattttactgtatatagaaacagatggtgcctgtaatcccagcactttgggaggccggggcgggtggatcacgaggtcaggagatcgagaccatcctggctaacgtggtgaaaccctgtctgtactaaaaaatacaaaaaaattagccaggtgcggtggcaggcgcctgtaatcccagctactgaggaggctgaggcagaagaatggcataaacctgggaggcggagcttgcagtgagctgagattacgccactgcactccagcctgggcgacacagcaagactgcgtctcaaaaaaacaaaaacaaaaaacaaagacaaacaaacaaaaaaacaggtggtgccgtgtatcaaagagtagagtccgtaaaaccagtaggctctgaacaaacatctcaggacctccctccattttataactgtttctgctgtacctatgagtgacagaaaagcaatctaatgaaatcaatttaggatgggattttctgatatcattctccagcatgaccaaggatatttgctagatcattgaaataaatctctattgggagaaatttagtataaattgggaattataattttggaattctaaataaattgtccagaagaaaagagatcgttgcgtttccccagcacagtcaaattctgggctggggcatgggagaaagatgggttaagtctttaaagatgggaaaagatgggattgtacccccacatgtagagtaacgctctgccttgtttttgttcctacagggtttctccagtacggatggaggtaagtgctctctgccccgactgtagatgaatgttttaatcctggtcagcttagggggtttcattaacaggggcttaaggaagaggtactgtgttgatttgtaaaggcatcagaagaagtagcagcgctggttgcaggccactgaggaggtccacattccaagccttccctgcctctcttcttcaggaactatctcttggctcactgtttctcctcttacaaaattggcctggctcttctccttcccattagtcccaacactcactgcttgggcctctcttgaaaggtacccagcaaagaagagtactaacatcaggacctggtcccttgtagggatgagcccatttgtcttggtggttaggtcctcaggttgaaacatacgtgagaagtttaagaaatttggggaaaatatttggtgtttgggaaacctttctacagcctctggattttctttgctttctctctctctctctctgatcagacaactgtcgtttctttcatagaaacagggctgggcaaaaacttccctccctgtgtgggatagttggttcagagcataggaaggtaggagtggggtcctggcttcctggtggcaagagcaggtctttcaccttctctaccttccctacctttcctctgtcctctcctctccttacctggactgtggggatgaacttgagattgtgtacttctcacccttcaccttgctccctatcctcagctgcaaacccatgattcctactttcatttggccctcagctagacctgctttacaatgcagggacttgttggaaagaccagatattgtctgctcccctggctcttagaaagtcacattctagggctgggtgtggtggctcaggtctgtactgccagcactttggaagactgatgtgggaggatcccttgagcccagaagttcaaggctgcagtgagctatggtcacaccagtgcactccagtctgggtgatagcaaggtcttgtattaaaaacaaacaaaaaaggtcaacctctagactaggaagatgatcaggagccaggataagaattggcatcagtgttttcccagcgtcatttggaaatatacggggaaaggtttaaaaatgtgtttctctggattagtcaaaggtatttgcatgaaggatagttctgactttggcaaaacaaacaaacaaacaaacaaacctgtgatttttaatttttttttcccctagcaagagacctggattttgtctccccaggtgatctttaggaaggtactaaattaaacttcatgctctgagtacatgtaggcagggccaagtcatgtccaagctagcaaggactctaggaaaagcggacctacaatacttctaggaagtctctatggtgtgaccaagtcagggcacttgttctgtgctttgggggtggggcacggattgaggaagtggccttggggaattgtgggtacagcatggggaggatggcaggcttccctgagtctgggaagacctgaggcatgccacacaattagcaataatacagtgcatgtcaggctgggatgaagtgtgggacactgacccatgaacacctacccaaagagtgcatgtcggccttttatgctttcactttttttttcccttcccttctcaaatcaggaatttccctagacatctctctgatacttagggaagggaaagaccctgtatgtcatgttcctgaggagtctgtgtggggcatggagacctgtcatactctgtgacttgttaacaagcaaaaatgcagccgcatcataaactctcaccacctctttcatttttacctcaaacttctttcattttcttctgcattgcttcccattgttttcacttatccacctaagccatttgtagaggtggtaagaagcctagtcataactgaaaagagcctgcagggaaagttgcccacagactccatcctccaggatgggggagctcaggcttaagaggatgcaaaagtcttagggatctcatttcttgggaagtggcccagggaagagtttccgtggtcttacctgtcaccctgcattataattcctgccatctgtggttatcaccaagcctgggtgacctctttatctgtcataccacatctattagcaaagaaagaagtttgaaggcgggaacacatacatcccagaatgtgattgatgtatatagagtcacaatgtggtgaagcacatcccagttgagggactttgggatgtctctttatcttctcattcttcaatttcaaaggccccgagttgccaagaccctcttagaatcatccaacttgctacaaaaaactaaccagatattattatagaacaatggtgacttaagaaacacagttaatttctgatgcgtgcagattacagaatccaggtccagttaggattatgtaactatacagacactgcagataagcagcaaaagcatcccaactcgtgaggtgctatgagatagctgctggtgtctgtgtgtgtaatgaccccatctcaggtaacctaagtgtgtccctctatgcatggcagaggaaatagaggtaccgtactgctggatcaccagtggcttttgattgcatgatagcctgggcaatcaagaacaatttattctattcttgagtagaatctcctggtcatatacattctgacacccactctcctcccccgccaacacacactgttgttatatagcagaacgctcatctattgggtgggttggttttcactgtcttaggcataatgtcttgtacacctataaattgcatatagtatatatctggtgctaattctgttctttacccactgaggagggagctgatgcaaaactcttgccagaacaggcaaaggaaaatgtctgtcctgggcctatctcagtccttggtgtatgatatggatcttcttaggttcccatcccataccagtctgtggtggcttagagcgtttcccacatcaaaaccttcataccagttattcgcaaacctcaatcttcagttgcctgtaagttatgtgtttgtttgtttgtttatttattttgagatggagtttcactcttgtcgcccaggctggagtgcagtggtgccatcttggctcactgcaacctccacctcccaggttcaagccattctcctgcctcagccccccgaatagctgggattacaggtatcagccaccgcatccagcctaagttatgttttaagaagagttttcatcaatttgtttctctggctttagctgtttagattcttcatagctactgtaaatatttcagcgggattagaactaagaagcagcactcatctttaatttctactctataagttactgctttccaccttctctgtcagtggggagaatagtgttagactattctgactttggcaggaagagggcagcttattaattgaggccacctgaagaagtttttcccattgaagttttggcaagcctgtttgttactctttgtgctggcctatcagacacttcctgtctatataaccttagggtttagtacttaatcatatattgagggggctgctctgtcctctttctgatgccccattctccactcccttatctttctctcgctctcttttttttttttttgagtcagcatctcactctgtcacccgggctggagtgcagtggcgtggtctcagctcactgcaacgtccgcctccagggttcaagcgattctcctgtctcagcctcccaagtggctgggactacagacacacaccaccagtccaaatttttgcattttagtagagacagggtttcaccatgttggccatgctggtctcaaactcctgacctcaagtgatctgcctgcctcagcctcccaaagtgttgggtttacaggtgtgagctactgcgcccagcccattcccttatctcttaacagaagccatgtagcccaaccctctaagtgctgtagacttcaagcttgtagccagtaaacatctggcaaaggtaactccatcatccattcccatctggcagggagctatctcctggaggaggctgagacataagccctgggaatcacatgttctttcagatggaaaattccctgtctgtaagtagtttttttttttttgtttcttttttaaactgctaaaacattgagtatgcagacacacatgtgaccagtccatgagatctcacatgggctccagcctccatcttatttgaatgcagaaagtcaaattcaccaagatcccattccacagatttctggaaattatcagtgaatcttggaagttctacaaatctgctctggtcatcccttctttcctaaactgaccctctagtcctagattactgcttcactcttcccacggacaattgtcacccacctgcccctaccccctcaggactactgacctcaaggtgctgctctttctagttctgccttgtgctgctttggggcacagacccttcctacagccttccacagtgggaattaaaggaaagagaagtctgtgacctaagtttaagaatcatggaggtggctcacgcctgtaatcccagcactttgggaggccgaggcgggcggatcatgaggtcaggagatcgagaccatcctggctaacacagtgaaaccccatctctactaaaaatacaaaaaattagccgggtgtggtggtgggcgcctgtagtcccagctactcgggaggctgaggcaggagaatggcgtgaacctgggaggcagagcttgcagtgagctgagattgcgccactgcactccagcctgggtgacagagtgagactccatttcaaaaaaaaaaaaaaaaaaaaaaaagagagagaatcatggaggtgcagttcaacatggagaataatgcacaacttcagacatgtggcttcactcacagcccctgactcaaatccaaaaccatcttcagggggtccctgcaggctgctttccagccatctcccagcccaccatcatctcaaaggctcaatttccttccttgcagtgaggggtgccttcaaccatgtctgccttatccaggatccaagctccaacacatataaggcacctgagagggaaagcaacttgagcctcactccaccctaagtcctgctgttctaatcttcctttctcattccttctccccaaatggttaatatggaaaaatctatttttttttttttgagacagagtctcactctgtcacccaggctggagtgcagtggcacaatcttggctcactgcaacctccgcctcctgggttcaagcgatcctcctgcctcagcccctctagtagctgggactacaggtgcatgccaccatgcccagctaatttttgtatttttagtagagacggggttttgccatgttggccaggctggtctcgagctcctgacctcaggtgatccacccgccttggtctcccaaagtgctgggattacaggcatgagccaccgcgcccggcgaaaaatctgttttcttagcgatactctacctttgcctatgaacataatggtctaatgtcaatacattctggattgttcagactcatttgcaagtcagaaaagggtctggttggtctagaactgaactaagcctagtccagtgtgtgtttgcaatcctcttcagcaagaaatgaaaaagaaagctgctagaatggaagcagtacgagtggggatgcagaggaggggtcagtgatgagaaatgcggaggattttgaacagaggcagaggctattgaacagattggataccagcagggggaagagtgaagggtgctgctgaggatcccaggtgaactgcagtgctcgtgagccaagatagaggacaggagaagcagcaggtgagcagagatacaaggtccattttgcacatgttgagtttgaggtgattgtgggatattcagtatagacctacagtgagcagttagatgtaaccattgatgactgatggacgttccaggattttgtgatatggtcgtgatgcaaggaagggatcacatctcatggtgcccagctttccggaatcttcctgctttcactttcccacttctttctggggtgtacccagatttgtcttgtcttacctcaggggtttcctcctttcctctgataccttggcatgcttgctaatgttcatgctccccatgtctcacctccctaaagaggcttgtcgaggtatttgcccaagcaaatctaatgggctccttcttttacatagcaacattccctgcaactgggctaatggtgggctcaaggggtattgtcatttagaatctcaggactttctagctgaaacaccagcctgcagtattgaaaacatgagatcaattctgaagtctgtttatttgttgtaatgcatataaaattggtcttttgaatgaatcaggctcataaagctatattgccagttcagggaatgaaccccataataatcagacacagaaagctttatttccggttcagagaatggatctgtttttcagtactgtttaatgtacatttctagttccatgttttctatttgtcaatcccaccaagttgataatggctcccacaagcccatctctgaatcttccccccgtccctgaactcattgtcctcctagaatctagagatttctgatgactcttctaatacatagagccatcctggggcttgagctctctggccaggatccctcctgcctcagctactctgctgaataccagtcactgggcaaatgcttgtctttgtttaccctgatcctcctgttcagtggccgcctcagcggtccattatgtagggcagacaagctgctgtctcggcagtgaacccattgggcctcccaacactgtgactaattgtattccctgttctctgctaccagatgcagtaaattacatttcctcccagcttcccgacctgccaatcctctgttcacgaacagcagaaccatcacctgggcaggacgggaccagcagagcggctggtaagtcctggggacctttggacgctaggatggtccaaggggcttgcatttcactgagctttattaatgagatgagtgccctgctatccttacatagggggagctcaccttcagcccagcctcagatgcagccttcacagtggccacacaaggcaggcaccggccccagatgggtaactgaggaccaaatgggaaggagttctgaggaaatcatacggcatttcacctccgacttcgggggagtctttctttggtgtttgtggtccttatatctgtgtttattctcaaagttaatctgtattctgcctccagggattttcattttcctcattggaaatatacaaattgagagagccatccatgatggaagctggatgggaaatattttcaaagcctgtggtatctttacagaatcctttgggaattgtgctatttgtatattatgaatacatatattcctaagtcttcccatttctggaattatttcttagccactgtggtatatttgggaggaaaagaagcaatttaaagcacacatgttacttgctaatgtgtctcacaattggaaattttacaaataatatatttatgagtgttgagtgtagggagaaccatgctttgctctgcttaatgcagacatgcctcagaaatcagaactggaaggatgcaagcaataaatctgtacacgaacccttatgatctacacagaaatgtgctgagggctgggggttaaatggaaaaatgaattgcccaaggttgcatggttagttacaacataggtgacttcaaatatgagtatcagattctgctttgcatattctaggtaagtgtatgtttaaaataaatcacataatggcagattttttaaagtaaaacaatcatggatgtttaagccagaggatatcttttatataggccaacctgaatatttcatgaagcaaagaatccctacttattttaatacaaaagtaaaataaaaggcaagtaagaattaacatagttgtcacgtccactggctaatttaaatatctgttgggcatctctgtaaacatcttagcagattacttttatgtacagactcacagagtcctagagatggttgggactgtaagtggtatctggtcaatccagagccagttccacatcttcctggacagtgacaggatggataaacaggaacctgcaacctgcagttatgcttcaaaggactcactggcagtcactttaacattggactctttaagtactccagggtacacttctgaggtacacttctgaggtcaacttaggtaaaatgtgtttaagagtgacaccccttccctctggttattagagacatgggtgttgatggctcctgatagttgtgggtaaacaacttctcaggtcctctgcacaagttcctgcacttcaaaggacacaggatatgatccaacatatggatcagcttatgggagggtagggacaatgtatgagaaataattttaagagacagaaaaagaatttgagcagtgtgggtagtcaaagagtttaaagttcaagagtaacacatgaatgtgattgtagtgctgtgtaagcagcaatacacattattaccacaacccagctccctttatctttgaagatcctgcaaaacatgattttaaaagccaatgcattttcaaaagtataatgtgatcagaatctttttcaaagtaattttacatatgtttctgctgattagttaagagttaatttgcgtaaatgcatctactgtgggattacatataagcagagctatggaaggaattgtatttgttacgatgaactcctttgtccaggctgtttagggaatgggatgttcagattcatgatcaattatggttaatggtgactacacagagcatgtgtggcttaccaaccaagggtactcactagaattctcctagatacagtccatcttgctttaggaatgtccttttggaaatttatataacctcagggacattttgacaaatgtcacttgtcattactgagtagtataacaaatatcctggttgtttggcgtttggaaggtttgggactctgtataaatgggaatttatttagaatcattgcttttcagaattaggagacatctattccaatcctttatccaaacattgaatccttaacatagcagccctgtgaagaggtcctcaaaccctggtcacacacctctgtgattcatgtttaatcttcctccaagtttcccattccatctctggttggttctgactattgggaaattcttcctctgatggagccatcatttgtctgccttcatcatccacccacttatccttatcctgcaccctggagctactcagagcacatctaagttctaatttcccttcaagtgtagaaagtcactgttatttcctgtttttcccagatcctcactctaaatcccctttgtgctcacagtcccagtctctccagctggtattgagatgatgagattgcctttagacaccctccgccatccctgtccctcccctctgcacgctcttcacttggttgctagtcttcttgatgtatcatgctcagagctacccaatgccttcagagctaggctgctcacccccaaaatagagcacgacgctgcagaccacatggctgactttgctggcaatgtggcctttcagcttcagttttgaaaggcctcaaagtcatttcatgtgtgccactgctcagcctcactccgtttatccatagaattgttgtttctgagtcatttcagttgaaatgttcagtctgtttcccctagctatacatatactacttcacctgttcatacatagaaggacctacagaattcttttgttttttaatctcgaaagacaaaaataagcatgagctatgcacttttctgtcctttgtagatttgctatgactattaaatttcttcttgttagattgtctctcaagaatgttgcgggtttcatggaggcactgaggaaccacagcaggaagtgggggaagggaatgatgtcatgggatttgacagggctctgacattccctcccatttcaaacacgcgcagttcctccatcctcatgtttacatattgtgtttccacatcagatttcacttgaatctaggcctcaacaagttttgaatgtagaaaaccctcttctctattgttagggtctttgtagctcatgattatggtatcctcatagcctcactttgcttctcagtttagtaccccctcaaatctgaaaaagcaatcttttattattttttatcatctcattgctaaaaatgttgcatgttggaaccaaagtcagagccctgtggcacaccattagagatctcttggccctcaataaccctaaattgacatctttggggtatgatcatgcaaccactaacaagttaattgtcttaacacccaaggcacatgtttctgtgtagtccacaggaatataagggattttgtgataatccaaatactctggatcttttcaaatgcaatttgcctattctttccagagaccttgaacagaaaagaaaatgagattaatctgcatagtttctgcttgattaacccatgctggctcttagtcatctctggtctttgaagattaactttagaatttagctagccatgatgtcaagctccttcgatgtagtttagaatcccctcattctcatttttgaaaatcagacctttgagtgtcagcttccagcacctttcctgatgttcaagattcttgagacaaattcaacaagggaactgggaccctgatcccaaagcactgagagcctttatatccctgcagtgctatgttattttccaatcttctctgctcatctgggcttcacttccctttctgccactttctttctggcactttacaggctgaaaactctccttcttgaccaaaaatagaagcaaaatcagacacaagaaattggcttgcctttattatccatcaacatcacacccttgctgacttatttttgttactactgaggtgtcttggaaaaacaattgattcacagaaatttttgatcactgttttttttggggggagttacaattttttattgatacataataattgtacatatttatggggtacatgtggtattttgatacattcacacaatgtataatgatcaaaaaagggtaatgaggatatccatcatctcaaacatttatcatttctttgtgttgggaacattcaaaaatcttctagctattttgaagtagacaataaattattgttggctttagtcaccctactctgtattgaacattagaacttattccttctatctaactatatttttgaagttggagattgtgctttcggatgagagggagaacccattctgaattaatttcctcatttttattgtcattggcatcacaatagccatttttacatttccagcccaaagataatatgtgaacacatatttatatgtataaccatttgctcgaagggataagactacccatatgtgtgttcattcaataagtcaaccatgtgcattgcttgtctatcacatgccaggtgcaatgccaactcctggatgtttctgttactgagatgaccctgaccccccatggatgacacttatgatctgcttctctcctactgtactttacgcatcactgactcgtgaaccacgcagggtgttcacagcaccataaaatatcaaatctggataactttcattgtacaaatgagaaaatgaagccccaaaatggggtgtgatctggataggaattcagatcctatctttctccctcctcccatctccctgactaatgacagcggaacatgtggtgcttatattttagatgtgggctctcagcctgttcctcctcccgtaatcacagtgagtgaaagaaagtgagctgggaaaagcctgaatcaatgattgaactttccatcctcctggaatagtcttgttttgtatgctcttggactgatgctcaaatgtattcatgtccattgctcttcccgccttgcttgtgtcggttactcttgttccctcttctctaggctccctacagcccttgcagttgctttcactctgccaaaggtgaaggcaacaggcaacacaggcatgtgtagagccagggggataagtctgaatcagaaccaaacattctctgctcctcagacccatctctctgggccctgcagagcaatcgcttctctgctcaaaactaccaccttggtttttaggtgggcaccttccccagaggcctcacactccgctccacacctgggtgttttcagaacctagagactggaattctcaacctcaacttaatgtctctactccttcagggcgtttccctattgatgaaagaattattagggagcaagaaccaagaaaaccaaatgcggaggcccaaaatcaaagtatccatgcagtcattcatctgtatccctttgaataagctagcaacattcgttcttactctctttaataaaaagagcatattaaaataaaataaaataaaataattcttaaaaacagcatattactcagctgtctcgctggcttcttggaaggagtagcaaatatgctttatatactccaatctcattgtcatcagtatatagggtttggaaatcaataattaaatacataatttaataaaaacatacttccagatttcagccagcctatcagtgaaacttccattgaattgtcttctatttcttttccttcttccccaggtccttcatccaggaaaatttccagagctttccttcaaatacttttctgtatgtccatgtatgtttcaagatttctttcagggctccccagaaagccctcacccctcaacagcactccctcctcattttttaaataagatgaacaaaggcagcaagccctttgaccctcatcattatacaaattgtagtgtacctctgacatggagaagctggagagaagacagggcaggttagagagtatgctctgtgctttgtggttagagacaaagggatgaaaagtgtgagaggccattggtataaacttttggcagcaacaggaagtagaagagtttttaaaatcttgtgcatcaaaaataagacattgcactgaaaacgtaagtcttatgttcctattggttcatatgcactctagttcatgcttttgtatattattggctgagaactgaagcaaaatataaatgcttactcataaagatgacatttaaacattcacacctcttgcatggctttctaaaaggcctagataacattctcatatatgtatccatgaaaacgaaatattgcctttgggttaagtcagagcttctcaaagtgttcgcctttgttctctttactggaggaaagagtgaatgcagaaaggaatgtagaatcacactcttaagtgtgatttgtggttcctctgaagccttatgttttatctaggaaaaaaatacatatgcattttgtgacataacatatctaagtttattttattataaaattatattaaaattcttaaaatattctatgctcatattctaggaatattggaagaatagtgtacaacatgtaaatataaataggtaaccctagtaaaaccatgtcacatgtggttcagtcccagagccatatcacatttaaagaactacagcttaaaattgcacaccaaaaaaccattaagaaggtgttctgttctttaactatttctcctgaaggatattaaaagggaccttggccgggtgcggtagctcacgcctgtaatctcagcactttgggaggctgaggagggtggatcgcttgaggtcaggagtttgagactagcctggtaaacatggtgaaaccccatctctactgaaaatacaaaaattagccaggcttggtagcatatgcctgtaaccccagctacttgggaggctgaggcaggagaatcgcttgaacccgggaggcagaggttgcagtgagacaaagtcgcaccgctgcacttcggcctgggtgacagagtaagactctgtctcaaaataataataataataaaaaataaataaaagggacctaatttatatctccactaagtaataattctcatattcacttttctttcctccacatatcacctgctctaaagcatcatttaccaccacaaaatactccttctctatgcatatttcatacagtttttactctctttcccactaaactccttctttctcatttgtgtattatgtggatatacttaacctttccagcaaagaacttttcatcatcatctctcctttcttccaggctctgattctagaacaggcaaagattaaaatgacagaaaattggaccaacaatgatcagcattctcattggtgggaagagggagagggatatctgtaaacatccccatgttaataatttgtatttttatcctatcacatatggatataaaaatagaaatattttgttccatattctgtattgatcgcaggccagtgtgtggatttgttcacagataactgaatgtttgcagaataataagatattgtacctacaaactaacaattattactttccttatttataactgtgtcccatgagtgtgttaatagtgataagatatattctaatcccaaactgctttttaaaataagtgttatatttcaagaacaggcttttggagtccatgcaaattttaaatgcctattctattcttctgatggcacattttgtgagaaatcaggaactaactgagataaatgtttatttggatacacagtcattgtgtgtgtccatgcacctctatgacaaatgctggttggcctcccattgtgtcacttgaagaaacttgagatctttatgctgaacaagtgaaactttcaaaatggatctgatgaaaaccaaacatgggattttgtttcataatctttttagttaagtgttaaccaggaacagagtgtatcttattatgcaagcagatggaacaatatcatcactgttattttttcaaacaagttcaaacattaattactgtgtgtaccatttcattggtgtcatattatacaaagtatttgttactagattacaacaaccatattagactcttgaattattagcctttgtttgagagatgtgtatattgggtacctgctatacaaatggctctaaggtaggtgctgacagggagggggcatcatggataggtgttgggcaagaaactaaccctcaaaagatcctaaaaatctatgaagctgatgaaacattcccacagataattatacaactgagtggtaattgttaagagccttcagagaagtttagaaaaagtattgagaaaattttaagagagggatgacttagagatggaaggatcaaagaaagcttatggaagaggaggcagttgaccttggcgttaatcaatgggccatatttggatatgtagaaactcaaaacaaagacatttcaggagaagggaatcttaacaaaagcagaagatatttacgtctgggatggtgttatttggttgtgctaaatggaaaaggagcactagaacatatggttgaaaagatagtttggatcttcttaacacagggaacttattcagaaagaggtagggactcaagacaatgacaagcagatgggctagatctctagaagtttggaggagcaacagaaggctatctaggcagagggacagcaggcacacagatgagcagccgtgggaggaagttgagtgtcctgggaatagtgagaagtcgttatggccacaatgtgtaaagaatgagagagcccacaagacaaggctagaaaggaagtttgcagacacatcctgaagggaactatatgccatgctggggagtttggtgtttattttctaaagacacaaggaaccaacagagggtttatgactcaagtaactgtgggcaggatggagcacaggctggcaggggtcggcaaaatttttgtataaatggccagattttaactattttagactttgtggaccatatagtctttgtcacacattaattgttttctttctcttttctctttccttcccccatcttttcctccctctctttcttcttctccttcctcttcttttttcttccttctccttccccttctcttcttcttcttcttcctcttcttttttttttttttttttttttttaaagaaacaaccctttacaagtgtaaaaccactcttagctcctctggccatacagaaacaggctcaggctgtctttggccctctggccacagtttgcagtcttctagactagagcaagaagacagaagtgttaggtaaaataaaaagcaaggctgttgtgcagagagcagaggagggcctggactaaggccttggtgacagaaatggtggtgaggagatggatgagatatatctgaagtagaatgatttactgtcagtgagtgtttggctgtaagaaagtaggaagaaaagaacaagtcaggtgtgattctcaggcctgtggcttgagagactaggtagcagtgctgctgttatttggcatggagactgtggaatagttttgatagaagaagctggagtcagtttggaagctgctgagtttgatgggttcgtggcacatccagataaagggcacctggagcctggtggctctatgggcctgatgcacagtttcttcccatccaggaagactgtgaagaaaccagtttggaagtatgaggtgtcacaagagtctataggacaggaaagagctgtccttagcaaccccagactggcagcaagagttgggatgaattagaaaggatacaagactgagagacaggggcaaggggagggggagaccaggtaggaagctcttccaacaatctagggaagaggaagtgaatgtcttacattgaccagtagcaatggaacaaaaagaagacaacagatgggaaaggtattaatggaacaaaaagaagacaacagatgggaaaggtattgtgggcagcaggacttggcactctgtgcatggaagatgaaagaggccttctgcgatcattgtcttcaaattccagtgtcctatgtgatgttacttctgtcttgttcttttcttagttcttattttaggtacctagtttagtgactgaagtactcacagggcacataatatgaatgctcccatgctttttcaattgttgaaaatattctgttgtatagtacagtggaggatagccatgacccacctatgaaaacctttgtggaaatgtagagaaaacgaaaacacttgatgaaagaggttttttcatttatttaaaattttggacctggaacacattttaaccaagggtttgtaaattgtctgtcagcctgggaagccctcagtcaaggtagtttgcatgttgccagcctccatgaaattcttcacactaagatctaaagtctcttgtgcccttattttagcagatcttccttaaatgtgtgagtgccattgagatatagcaaccgtgcatctgtcttccaagtgcattaaactgctgtgttacaatacagatataaccatctttattcacagtgcgcacctcactctaacactcaagatgcttggcagttagaatagaaagggcacaaaacctttttttttgtctgtttggcaattaaccattcactggctttttttgttgtaacatgcacttcctttctcttgttttcattcaagctgtgtacgccatggaaattaatgtggagaaagacaaacaaacaggagagaccaagattctctctacatctaccattggcccagagggggtccatcagaaaggagtcaaagtctatgatgatggtaccaaagtagtgtatgaggtgcgctcaggaggcaccgtagtagaaaatggagtgcacaaattaagcacaaaggatgtagaagagcttattcagaaggctggacaatcaagcttaggaggagggcacgtgtctgaaaggactgtgattgcagatgggagcctcagccatcccaaggaacacatgctctgcaaagaagctaagttagaaatggtacataagtctaggaaagaccattcttccgggaacccagggcagcaggcccaagcccccagcgctgcagggccggaggcaaacttggatcagcccgtcaccatgatttttatgggctaccaaaatatcgaggatgaagaggagacgaaaaaggtgctaggctatgatgaaaccatcaaggctgaattggtcctcattgatgaagatgatgagaagtcattgagggagaagacagtgacggacgtgtccactattgacgggaacgcggctgagcttgtgtccgggaggccggtctcagacaccacagagccctcatccccagaagggaaggaagagagcctagctacagagccagccccaggtacccaaaagaaaaagcgctgtcaatgctgtgttgtcatgtgaccacttctttcttctcctttcttctgggcagcctgtactctccaccactcacgtagacctcactgtaccactaactgcaatactgtgaactggaagcaaacacctgccttgccttgcagttgaattgctttgatctctctcattttttttccttttcctcacctgagagacaacgtgcatgtgtgtgcttcattctctccaagaacttgcttttcctctaaacctttccttgtgtcttcaagagtgaatcacttccttcctgctcgattggaatggactcttcgtatcagccagtgatatggtagccttaactcacttgactggaattgaacccattggcactgggggtttcattttgtagtgtgttcctgtaacgtagtcacacactgccatgtctctggtttctcacttgcctcctttgctgtggatctttgtttttatatcttgtgtggcaaaatgctgttggctctagccggttgctagtgtagccaaaagtggaccttacttagtctgtccgatctagggtgatgctttttgctgccttacataagcttccagattacagtattgtgcattcatggctttctttctgttaaaactgaaatgaagtcaatgtagaagaacccagagcttgtcacagctgaaatgtagggactgattccataacctgcccatcagcggttgtctctctttctatggtttaaccgatgaaccctttatataagaagcaccattttaaaatttctaaggacatgaaacaaacattgtttgaagcatcagtagcaattgatctccaaacttaggcaaattcacaagccttgtttctattctcttaaaaaaatgtaaatttttatattgtttcttttttctggatattttctggtcatgttaatctattttcaatgaggagatcatcttgagaagtatctttgcagtgaccatatttctaaaacagtctgtccaacctacaatggttgccatgatgctcccacttcatcatggatggtgctgtaatgcattaactgttcatctcctccccagttgattacaaagccttgcatccatactcttttctttctggccccatgagaaagagaatgttttaggtaacttcaacttgtaggtttatctgcccttcaaaaaaaaaaactttaaaaaacttttaaaaattaagaaagacctatcttctcaatgttaagcacttaatttcataacaaatattaagtggcacatagctgagcttcttagggcattgttttgtttttagcttctggagattccagaagagcaaagaatattttttatctagaacacaatgaacagtttttgaaataccttctcagcactcccccaaagcaaaaagccacatatgtagtaaaaccaaagggaaacaatttaataaaataacaatagtatagtaatgaaataaagatataacatgattactggttttaataagagttatcttaactttaagttatttgcccatttatagcattgttatgaattattcataaaattatgtcccacagtatatagttttgaaaaaacatatgatatactacatccagtctaacttctgtggaaagtagatcagaaaaaataagatagtcttgagagaattttattatagaagctgtctaatttgacctattttgcttgctcagtgctaaatctattgcttttttttaatctcctggcttgaaattatatttacttcaataggaaaggtaaaaacatcagtttttacttttcaaagttaattttctgaaataattgcattttaatgagcacaaaatgggtcattttatttttattatactcatcttgtttacacctatacataaacagaaaacgttaaagaagagaaaaataaaggagctaagttctgctgttgaagattatttcatccaaggcttggttttgaataactgagggaaatatctctaaatctcaagttcatcaaagcagctgcaatggaataaaattgctattttatcgagaaacctggtttggatgcttataaattccactactctcagcttcattttcctgagtacgtggtcactgaagcatcatttagacattacataaactggcatgcagataaacctatttacatagagggagaaaacagtttcaatgtcttggacaatctgttattttaatgatttacttaagaaagaaacaatctgaaagcttaccatagcttatcttttctactcacttggagattcaagctattcaatgtgagttttaaaaagttaagcacagttagtgagtgaaatggtagaatgtagaacctttaagcttgctggttgataaacagaatcaatcttccaggacagataattccctgaagggacctatccttgcataagtgaactagttactcatacagaaaatgatctgcacatcttactacaacactacacacaagaactaaaagattaatgattatctgtattctcttcactaattactattatgggggaataatgattagcaaattatatgaattcgagttctctctatacttttattagtaaagcttatcatttaatggactgaagtaagatgtgttacctttattcgagctatttgtagccacactaaatgaaggtgtgtttgaatatggcgcatatatttgcatatgtcccatcattttcttgtcataatggggaattcaggcttagccagtacttctatgggatgagacctataatcccacctatagcagcaagtaactacccttcatgatgatagtgtacatggagctgtgattatgaacatgctgcctttcctgctgccattggcattctctctgtaaattttattatgtgtggtatcacactctccaaaaatgcagggtatttggttacataaccaaactaattaaagaatcagtaatgaaattgcaaaaccatgatcttttttgagctaatgattagttgggctttcctttaaaataatataatcaggccgagtgcagcggctcacacctgtaatctcggcactttggaagtccgcggcgggtggttcacctgaggtcgggagttcaagaccagcctgaccaacatggagaaacccccatctctactaaaaaaaaaatacaaaattagccaggcgtgatggcgcatgcctgtaatcccagctactcgggagactgaggcaggagaatcgcttgaacctgggaggcaggggttgcaatgagccgagatgtgcactccagcctgggcaacaaagagcgaaactccatctcaaaaaaaaaaaaaaaaaaaaaaaaatcatataatcagttcccttttaaatagaaagaggaggaaaaaaaaaaggaaaagggggggtatctcatttgtatacaaatagattttcaatggcatttaataaaagattctttaatggttaaaatgataaagattaattctacatatcttgaaaaatcttaatgacttctgtattcttgacttcttaaaaatattttctttcttttagtgtgcaataagacaaactaaggggaattttttcagcttgtatctcttttacccatattattttccttgcataagcaaaaaaataataattgcctctaaaactgatttgacagtgttcagtgacatcatttaatattggtgatggggtggaagagaaggtagggaatgcccttatggccaaacctaaaacacagtttccttgagccttctgagcaatcttagaattattcagaagctttcaggaaactcaaattctattaatttgatttggttcctttccaaaatgttaatagacatgtatttgcttaaaacgtctacctattccatttaatttcctgctgataaatgtattttatctacaagcaagtagaatattttgttttggttaaagtcaagtttttataaaaggaggggaagtataagagagagtttcctagagatacaatatcatctctggagcaaaatgttgaggccaagtgtaaaaacagactatttctctttacttcctgcagaatttcatttcaagggaccacagcacacccttgaaaattaccatttatttaatgccagttgaaccaatgggtagcaaaagaggagggagggaacatggtcatagagacaaaatctaactactataccaggtcttcctttgtaagaaatattagccctgccaatataaaacgcagatggacatagacagaataagcatcgaggactttttcttatttacttgaaatctagaagctcagtcatctctgctcatccctggacccactggagagttttactcactaacaggtcctttcctggaagaaataacctcatctcctgccatattagtttacaataaaaatcattccaaagtgagccatttcacattgcatttttgccacatgcacatttgctattgaaaccacagattctcagcataagtaagacataggtgtttcagaaacttcataaatacacgatctttcaggtgctcctcaatttcttaatcaaggtatattgaactccagtgattaggatagaacctgaaaacatcctttgttctattggatagtacaacacagcaagagcacacagttatttgtataataaaacaacttaattaatgaggaagatgggatgtttgattcctgctaccaccagttcacttcacaaaggccttcttctggtattaccaggaaaactttcctgcattttctagggaaaaagaaaagtcgtttattaggagcacaatgcagatatgtatctgtgttttcatagcttcagcaaacttcttagtaaaattcccatttcaacaaaaaccaaaatactgattgtttgaatgtagaaaggtatagaataaagactacaaaggggaattttaccagggctccttagaccagcttccccagcataatttttatataactcaagtaagcctctgcttcccctctcctttccagtataatataagaaggtcggaactgtcgcacaaaagaacttgatttcaatatgaaaatataatatgtaattttggggactgcagactttctgcatcaaagatctggacagccttaacttttataaaaataatttttcaatgttctcttttactaaccaggaaaacaagatgttttctgaaattaatgactttttctattttgggtctgttttctaagtttttacaggttgaggtataaagggtcgtcttctcctcatattgcctcttcataatcacctggggctattttttgcaagtcactgcatttttacaaaaaataaaaataaaaagtacatctcacaaatcataaaattctccctagacttcagacagtccttctggagtgaaagaatagaaatacagaaagaaaagaattacagggtggctttctttttattttcctatggttaatgtactgtatggtatatatgtttacagaatgtatctgccttgtgatgttaacaaaatgaatgacaaaaaatagtactgatgtgccatttgacagtttgccttagcatcactgtttatgttcttcttttctgtcctttttggtaaaaaaaaacgcaggttgtattccaaagctgtattaacacaacattctcttccccactcctacccagccttcttcagagctgtgaatttcattacaggagcattgaggcagaaccttgcaggtgtggcccaaaggggctaaagtgggcataggttgggatttacttctgcccgtctaccaaccaaacacgtatctgtgttctcatataagcctgcaaaattttacaccctgcctttcagggagacaggccacatggagcgcatgacctcttgtagtcgtctcctcacagtccttcccactgtgagagaaggaaacttgcagacccccaactggatctgggagcatatttttaagcacagttggcattgcttgaaaaagcaagagagatggactcaaattctatgattgagccatgactgaggaatgtgcccattcgttatagtcgaagatgagtaggatgatatgggtgagaataggagtggctgtagaaatggaatattttacagttatgtatttttttaaggaatagtatttttataatgaaatctatatacattatggagcttgagttggaaaacacccttgactgagctatttcttcattccattaaaggtaactttctggggagtcctatagcactaggccaagccttgggggcatgaacaaagggcctgtcacttggccttgcactgccattacatgagatccagtgtttccaaataggccttggttggaagattgagctttctatacctgccattaggtagattagatagatggcttgatagctctctgggctatacttttaataatatataataatctttgggaaggagatagctattttaaatgcaagcaaagcccagaaactatcaaagtccaaatctttcacatatttaaggagtaattgccacatttgaggttaagggaccacttactatggtgcatttgagaaatatatatgaaacggtgagtcagagccctctgaccatcttcagtctacacataagcagataaaccaccaatataaatcttataggggccagacgaggtggcttatgcctgtaatcccagcactttggggggccaaggcaggaggatagtgtgagcccagaagttcaagaccaggctaggcaacatgttgagaccatgttgtttagtctctactaaaaaatataaaaattagccagcatggtggcacacacctgtagtcccagctacttgggagactgaggcaggaggatcacttgagcccaggaggtggaggctgcagggggctgagatctcaccactccattccagcctgggcaacagagcaagactctgtctcaaaaaaaaaaacaaaaaaacaattatcagttggccttctacataacacagggctacactgtatttttagagttaagtagatacaggaaaagattgtctttatccataaaggagattctgaatttttagagttcctgaatattttcccccaagtttctgtcaaattcctgaagtcccttccctatcacactcagtttcctgaagctcttcccctacacctgctcctctgtctggctaacagagttgtcatgtctcagaaactactcaccactcttgtgagactctcttcccaagcatcatccttcctcaggatgaggcctttttctactacccaagagatcaagaccctttttctaacaagacaaggttatatctactccattttcaagagaaataacccctctggttcccatgcaaatcgcttaaattccttcatcaccagaatctctccaacaggcccaactccagcccagctgtgaacactgctgtcatggagacaactccaaaatgaaagaactatgcaattgcctgaaggtgctaatggagagccagtttactctaatctcttattactaaggaacctctcggtttcgagattaagtgggcagggagacatccagtcacttagttttgcaatgacaggtcttgatatacacagaggccaccaggcaatgcctgatccaaactattctgtatgtagctccaactccaattctgtgatatcctattctggcaggtgggaagagttctattctttgcagggttctggaacattctttcctgctctcaagctcctgacttaggagagtcaaaatcatacaggggttccagaaaatgttgtgtctgatgcagcttctcagtgaatgtaggttgttggtgaaattttcagctttagcatctcactcggggtgagtgatgtctctgtaaatactttcatttgtggttggttggtgggggtgggggtgggagcctgtcgtgcttactctgaattagcttactgggctagctgctgtactttgtaacctgaagtgtactttgactgttctgtttccttcagatgaaaaacaaaataaaaaccgacttcagaaaagacactaccagcgacagctgatgctgtacttgtagcttctctctgttcctctgtacagtattaatagacaataaactgccttttcactgcatcta

SEQ ID NO: 1482 - DNA, 392215 bp, Homo sapiens
ccagaggctgagcccgggcgagcccgccgtgcgcacagctctgcccgccgcccctggagcggatccccagccgtccctgggcgttctcccgggttctagcaaagccccccggggtgcccatcagtttccttgggtgactacagcgtgtgttttttctttcctctttcccctgcctgtgtgcccttctccaggatggcagaggcggaattgcacaaggaaaggctgcaagccatagcagtaagtccactttcattttattttcttgctctattgtctggggtggaagggggcccccgagggtttcggggcaagcggcatgccagcacagtagccgcaggtcatatgttccaggggctaaaactctgtcagggctcagctaggctgccttttcttttctatgtctatagatggagacccccaagggcgcgctttggactgaggatttgaatgtggaagattggcttaaaaaaagatgcttgctgctgggctttggggaaggactaaacagaggcttggggtggggggacgactccaggaatattatgaccgaatgctcaggcatacgttggcttcatagcctggagaaccaagagaagggtgacctgaacggtggctgccatcctctctgcggaagctgtcctcctgttaagtggaaaaccaggagtcagcgactcagccagccacgcggtagaacctcctcccagaaaccgggaatgttagttttcccttctctgtttgatattgacaagggcactggcacaagccaccaccctggaggtctggggacttcatacaactgggtcctggttataatattccatgagagcctccttcttatggtgtggagtatctgaaaacctattttcagcctacaaaggagtagtcagttttggcaaagttcgtaggcactttcagaaaagtgtacccatgtgcatcttgggtttaaaaaagaactctctgagactgcctagatttgagcaatcttaacacagtgttgccaatgatccacagatgtggtatttttactggagccaccacagctggattatatatttccttcgaggatgagggaatgattactgctgccgtatgaaatagtaacaattaaaaaagaaggtccgttaacatattggcataaaagaatctccagacattcttccacctaaatacatttgtgtttttcagttcggaagttctctggaaacacatataaatttgttggagaaatagtgtgtaatgttttggaaccaaagtatattaaagcgttttccaaaacctttttggacagattcttcattgggaaaatgcacacagacccttccttttttagaagcatttgacatggtctccaaggctctgagaccctctttctcaaacgcctcaaatctgaaatgtcttggagacttcaccactgaagtgagagagatgtttgctggcaatattgaaatgccatggtttgcctattaggtaatctttgaacgtggtgctctgaactcagaaaggttgtttttttcttctttctctttccccctgtgcatgtgtattttgatggtttgtgaagttatttgtggtttctaaagttggtggcaaggcagcatggccagtgtgtcatgaacttgataagaatggtgatattgagttaatggtgccatgtagctggtgggtgttttgtgtgaactggataataggctgctttaactgttgatgcagtggctgttcccattggctgctgctgaaggcttccaacagttgtcacattttctgcctttgcacaaccagctttactggatgcctgaggaacagctgaactccatgaaaggacttgctttccaaacatggagccagtagctgctaacactggggtacccttttccaagtgcggttgagtaatcccagcagaggccaagtcgattttccaagaaagatctaggcaaatctttgggaattctcttgagcatataagaatacacacaaatactcacttgtgcctcttcagttattgaagaattgagtttgtcctgtgtatctggggagctgttgattattctcatgaatgtgcacctaatacagtctgccctccctattcatgggttccatatccacgccttcagtcaatcttggattgaaactattggaaaaaataatagatagctgagtctgtactgaacatgtacagactttttcttgtcaccattccctaaataatacagtataatcaactgtttacgtcgcatttacagtgtattaggtattataaataatctgaaaatgattaatgtatgtgggaggatgtgagtaggttatatgcaaataccatgctattttatagggacttgagcatcctttgattttggtatccaagggggtcctgaaaccaattctctgaggatactgagggatgactgtatgatgttgtcaggacagatttgctaacagcgtgtgtttgtttgtgtgtgtgtgtgtgtgtgtgtgtgtgtgtgtatgtgtgtgtgagagagagagccaattaagagacagagggagttgggtggggggacttatggccacatcggtaaatggttttatgctatgctttggtctagtgcctactcttctgaattctgcaaaccctgactctctcatcactttcctggagttctcaggggaccctgaggagatcacaagcctgcccccagaacctagcactcctgaagtctctctggagatgtgagggaagaagacaataggtcctcacatcttcacttacttgggcttctctctcagaggcagagaatcgactgggattccagtctgcagggccttgggcagtctttagtctgggtctcagctccttcatctgtagaatgggttcatgagttctacctcctgggctggttgtaaggtttagttaggatggaggtgaagcacctggcaggtagctgtcattggatggtgttgagcagagcccttagcttttgtctgtattgctgtcttgtcctgtggggggtcagaagcaacatctctgaagtggaatgtgtattaatgacttttttttttttttagacagagtctcactctgtcacccaggctggagtgctgccatgacagctcgctgcatcctgaaaccatcctcccacctcagcctccccagtagctgggattacaggcatgtgccaccatgcccagctaatttttaaattttttgtagagatggggtttcgccatgttgcccaggctggtctggaactcctgacctcatgtgatcctcccacctctgcctcccaaagcactgagtttagagacatgagccactatacttggtctgaacagctcttttttaatcccttccttcaactgactgaaagtcagggccctgcccagcatcactttctctaactgctttagacagaggcagagatatgacttgaggattcattcatccatttgttcagtaggtatttacagattgcctcctctgggaaggtattggcaacactgaaaagttggtgtccccaggtttcagctgcctgaggctgaaacctttatttcaccttttgcacataatttcttgaaggacagatgtcctgatacctaagatgcttgtcacatgaacatctgtggaatatccgcccccaccaacaaaactgaattaaatacttagaaactacagtgctttaatggaatcttccatttggatccaggaactaatcaatgagaaaagatgactcttatcctaatttctgccaaaagaagagcaagtccatctttgacaatgatctctacactcacatgctcctttcttctgtagggatactccccaaactttacatttagaacatggtaaaaagcctctgaaacagcatgagtgagaatggtaatcccagggactaataacaacaattgccatttattgaatattgttcattcagaaaggcacggtgtgaaatactttttgtttttcacctaacgttatttatagtctaatggaagaaatagaaaagcacataagcagttactatccaggagtactatgaaaatgagcatccaggaggaacatgtaaaccaatctcagagttgtgaaacaattccccaaaaagaagacattagagtaagtcctgaaaattgggtaaaataaaatataaaataacatcataaccttcccaattaccaggaggcatttgtttattcgttatttgattattatttattcaggacatttagtgtgagaaagggaaaggcaaaagcatgaagaagttaagtcagtagctaaagacacaaactcagagtgaacactgaaatgcttttcagcatgtattatctcattgaatcctaataagaagcttatgaggtaggcactacagtattactcatattttataggtgaggaggttctagaactggtctaacattaaactgatagtatcaaagccaggatttgaatgctgcccgcagcaggccattggagcctttgctttgactgctgccctgagctgccacccaagatggcggcagcgtctcgcacttttcccatgagcacactgtgcaggtggtctcagcagcctgagtgtgagccacagactgattccattgcaatgggaaagcttgagacaagccaggaggcctacctccttttgagagtctttcaagcctggattcagtgcatagaaatacccaacataaaatttaatggaacgagtaacattcccatggggaagaagctgttgtgtctcagtggaaactaaccttgtgggagggtgctgttatgtctgcacattggagaggaagatagttttctttgggcatgagtgaaaataagtaaatgttatataaattgtcttgggtgaaactcctaagagccacgtggacaaggctcaggctacaccagggaccagcatgagtatgtttatatatgtgcggaaataggaaatgctaatctaacctatgctgttctttagggaattttgtcatttaattagaacccactctgtgaagtaataaaaatgatctttgcatttgtgcagtactttataatttatgaaaaccttgtatatgctaccttcttcctgaggtgtgtagagcaaatcttatacgctttacaggtgagtattcagagctatccaagcttacacagatagaggtggaagagttgtagtaaatcccagcctctcctgactcccaattcttgtattagtccgttttcaccgtgctgataaagacatacccgagactgggtaatttataaggaaaaagaggtttaatggacttatagttccacgtggctggggaggcctcacaatcatggcagaaggtgaaaggcacatctcacatggcaacagactggaaatgagagcttgtgcagggaaactcccctttataaaaccatcagatctcgtgagactgattcactatcacaagaacagcatgggaaagacatgtccccgtgattcaattacctcctaccatgtccctcccacaacacgtgggaattcaagatgagatttgggtggggacacagcaaaaccgtatcacttgtgttagtggtacatccagccttggaagggtgctttgatacgggctgaaactgcaactaagatcctgctggactaaaatcttctggctgggaggagaggagtgagcttggatgtgtctctatggaatatgcccttgttaggatttcactttcggcctctttcattcttgaaattctcaccaaggggtcagctagtgagtttatggctttcatctgattctattctcagtcctgcatagacctgggtatacgctgttggcctaggctggctgtgccgtgggcttacagagaagtgctcattggcttttcgttggattcgcctctccatgccttttcttgcctgggagcattacagccttgagtaccaggcttggagtgtggggccagtggccaaggaggccaccaccctgcttttggtccaggccttttaggccgacctgcacagcatgggcaaaaagtccttgcaatgatttacatactatccagtccagcttcccaaggatccctcagaggggttagagactcaaacccaagccctgtagaaacaggcactgtgattcatgtggggaccatccccatccatgttccttgtggacttgtgttattggtatgcagctgtcagagaactggagaatttaagatcctggtcattcatctgttatcttatatctcagagatgcagatgacaccctgcttctaaaattccatgttaaggcctaaaaaatcatttgcgtggtatattggtgctgaggaagggttcaacttggctgagtctgtgaagctgcccactggataggtgacactttgggcccatgcagggtcattgctgtgtctgggagtgccaaggcaggccttacccagcatgcataagggtcacacacctccctgctacttatttgtacctctgagtatttcagtcttcagcttattgggacaaagagcagctactctgacaaactttaaaatgctctgagaaatagagcagttatcatggaaaaaaaaagtcatcatagaaaaagctaagtgaggggggttgtgggttatagtttgtcaatatttaaaggaaaaccagggcccagtagaattgtttctatatttctttgggggctactcaatgctttggggtcactgctggcccctttgaactctccacatttcaccactgatcccatttgggaatgttgatgaacttgcttggcagtaagagttggtcattctgtggcatgaaattgactgagacagcagatggacattgatgcacagagacggtggtcccaagggctgtcattgtggtggggtagttaccagcatggattttggtgtcaggaagacctggcgcaagtcctggcctttccgttggtatctgtatgatgtcactgtaccttggtttcctcacctgtaagatggggctaatgatcatacccacttcagtgtcttgttgtgatggttcttttagaggtttcttgggaaatgctcagagacagcatgcattaagcactcacaaactttcctatttataataagcaaaccaacaaatcataacttatgcatctttaaacagaaagtgaacacaaagagtgaaaggagaattttgttagccacagcatttttgtcaaactaggaaattagataaatactaggaaatcagataaatgttgtaactcctgagttttcaatgcatgaagatagtattaataataaaaaatggattatttgtagtaagcaggagtagtaaactcaacaggtcagggggccagcatgcaatgtaaatgagggacacagattgagtcgaaagtattggtccctagagagcagatgccacctctcagttaagatgcagttaatttatgccttgtgagaacgtgggtcttatgttgttacatcaactcattttcaagagaagccagaaatctgatttttaacatgtgagatctcccacttaaaaaagaacagtattaactagtttaaaaactttaaaaagattggcagtcacaacacaattccttttgatcaagaggccgacattttgtgacctttagatatagacagagctttgaactttacaggatgctttccttatgcattgatttatttggatttcataaggatactgtgaagtaagcctatcagcacccctgagatatttcataatgttgtaatatcgggttgcattttcaccagagctttgtgagtttggtgtccagatgtttggatcattggataaatggtgcttatttgcgatatcttttgacattaaatgagcccttgcaaatcactgacattattgaaactcagaatactcacatctagataggtaattgctctctaactcaaccaaaacaaatctaaaccacatcaagtcagcaccttaatttgggaaattcctcttattagaaaagaatctttaagaacctatactcaaggtatgcaaatctgaaatgcaaacctgatatgaagcccaagcctaactcatgtcagtcaggatgtttgagttgatcctgatttattattagcctcaagtaatggacattgtagggagattctgctgggctcaggactcatagtagcagcaactgccatttgaccgatgtttttgtcatatatggtatagaacagtaattctcaaacgttagtgcattaggatcacctggagggttccttaaaacacagattgcaagagcacactcccagagtgtctaattctgtaggtctagggtgatgtggcctgagaatttgtatttctaagaagttcccagctgcaactgctattctggggaacacactttgaaaacgactggtgaagtgtaggagatcaatagtaaaggaagattatgacctgggtcctgatgtgcatcacatgcccattgtgatatgcccaggagtttgtgtggtgtgtatattctgaagaggtgaaatagaataaaaggccaaatttagtcttgattaatgagagccttaaacatagcccagtttggaagtcatgcaagccgggtgcggtggcgcactcccatagtcccagctacttgggaggctgaggtgggaagatcgcttaagcccaggagttcaaggctgcagtgagctatgatcactgccactgcactccagactgggcaagagtgacaccctgtgtaactgtgtccttctcacattacactggctaatcaagaagaggtctttgcttatctcgggaacttgctttaatctatttaaataaagtgagatatctgttggttacttgacaacaccggtttggaaggtttgcccaggattggctgggcaggttgagagagtttgcctgggattgactgactgaaactatgggctacaaaattcccttggggaggccttagaggacacctcagtgagataagaagtcatgcagtagagaagatatccagcaacaccatgacagccccattgagagaggcttgccatacatatgatggtgtatagatgaagacatcaaatagcagatcagcccatcaagcctggtggccccttctccagcctgcaggtgctaattcgcgatgtgattgcttctcacgtgggcaactccaataggatgccaggagaagcagcaactgatgttcatttacttaatgatggttaatattttatgaagccagtctgtgtatatgcaagtatgacttgttattggcatatcaaggacaagtttattcttccaaggatgtcatgcaggcttccctcacttgtctttgtaccatgcattttttgagctaacccttcatttttggaaggattctgcctcaccggatctcttgtatatcttaaaacacaaagcacagaggctgcactgtacaggatgaggcctaagagaacgtggagactgtaggggatgggccacacagcatggcggagtttgtagaggaaaggttgctcataagtgctctgggtttgggagaagaccacacagctgagatctatttctgacaggaaatgccggcaggagcagagggtggtgtggggcagtgcgtgttggagctacagtgcccttggttaattattatctcagtatttctcattagtctcttgttgaattaaaatgctcaaaaggagattattaaatacacacagaaagggagacagactgacagacacagagacaagactacaccctatttacataatgcttgaacatatattaaaaatactttggattactctttgaccctagtatcactgtttctataggatcatataagtttagctagaagaaaagaatagagaatctgtacctttcttttgcataagatcgaaggggaaagaaaagccatgtgaggcccaagataaaagccccagctgtagatgaaaaagctgtgggccagacgtcggaacacatcttcctgtccatcatttcccttgtggaagcctatttcattaccctgcaggcttttaggctctagacagctttgcaataccaaatatcttgaaggcatttgtaaaacctactcttacttttttcctggaaaaaaaaaattatactggtttacttactattctaggtgggtgggatttttcccccctctgctaaattataaccagtcatctaagtattcactttatttttaaattcagggctgaaacttaaaaccttgagggttaccaaaaaatgttattcttaagagaaaaacatgcttgaaaacttaacccctttggtggcaggcaggggattttctttgtctgtgtttgagtgctaatgtcgacaactttgaggccaataaataccaaatggggctctaggatttgggcaactgtgatagtgtgtgtgtcctgcatgtcacatgagaaagagagaggccgggatttaagaaaggtgcctcttggctgggtggcatgaactcagtcagctggctttccccaggcacctgattggccttaaacactgagtttttgtggtgtgacttgacatacatcttgggctgatatcacgtgctgtttctactggggtgggaagtgctttgaaaatgtccttgctccagtggaactgtgagacatatctaaaaagcttaaggctaatatgagtgatgctaaaaggaagtcctgcttatccaggtaagcaaaagcatactctaggatagcagtgctcctgtaacctgcatggcctatttttcttttccaggtggtatgcaggcagtcttgttcatgaacattgatgtctgagcatgtgtgttcaaaattcagtgttgttaatcaaataaaactcaccacaaaacccgaaggatatttaacaatagatgagataggtttggcggagatgggtcagaagacagaggaggtcctggaggcagcagtagaatgtactttccaatcttactggtgactagagataagacactagtagcctgtttactccccatccttatttacactggagtgagaatgatatatgtcagatcagtattggatgcgatgagggagaatgaagagaaaatattgactctgaaaaatacagacaagaggaggcaaagttgaaagtaatgtaaactgcttaatcacctgcctttctctctttccaccgtcatctctttctacttgacatgttcctgcttttgcctctggatggttctatctctcatcccctctcagcctgggtccacagagaaaagcaggaagcagcctggcatggcagtggagggagccttttccagccttcctccagcagaagtgcgccctctcccctatagggagatagggcaccccaggcttcagaaagcaagggaaagatggtacttcatcatgtagcttttcttaaggggttggagggaagggctcccagttccggagagggtccatgtgccagccaccctgctgaatgccttatgttaggggggtgagatctcagatgtgcacaggtaccaggttgacttggctgagcttttgggactgtggtagccaagagagggcagactcctgaggggacagagagtgctcaactccaactgatgggcactgtgtgggaatttgagcccagggtctcctgcttttccaagagaacctggaaatccaattttgaaggaagtctgttgatgtttaaatgctcacaacagtttaaatactgtatgggccaaaccaaacataacacagattttaacacagtgtaggctggatttgttccctgtctcaatgaccctccccctctacccccagcctgggccaccagttttccacgtctgcatgtcacaacctattttatttaattacaaaaccaatagtatgtgggaatgggggctggggggttggtacagtataaagctatgtgagttgtagatacacttatgtatgttgggcaccttggtgggatccataccctataagaaaaccatagtcttgggtcagagtcagggctgctacttaaatcagttccttatccagcatgctggatgaactcatcagttctctgtaagaagtaaaaactacaagcactctttaaaaaaaatgaaaatgaatgaagagaaaaatagacttattaaattctttaatttggaagactgggtctcgctatgttgctcaggttggtcctgaactcttgggctcaagcgatccttccacctcagcttcctaagtagctgggattataggcatgtgccattgctcccagcactaaaattgactttcttgatgtacagctctctcaatttgaacacatgcgtagatttgtgcaatcactggtatactcaggcaacagaacagttccatcacccccaaaagtctcccaggaaggctgattttaaaactctaactggaatctaagtcattctgcttggggctaccttataccctgactttgaagaccctaaaaatcagttgagggtgggagggttgaccagaacatgaaacttgggttcccagccattggtggggaactgtttcataatgagcaccctaccatacctatataacaagtttttgcttcttcctaatacataccttctgctccagcctgggtcgtcttttcactatcccctactagggttgttccatttagcaactaaatgtataggatgcccagtgattccatggggacatatttatattaaaatattatttgttgttgatctgaaattcacatttaacaggacattccatattttatctggcaagcccatcctcttcacattcatgccacattctcatgtaagttcaaaacctactttctctgtgtttcaccaaagggtgaaaatactctttgaaaatactctttgattttattacacttaatcttagccaaaggccaagaagcgattgtatgctttgattttaaatagtagcatgtttatagggagatagggcaagtgttggaaggataagagtgctttctatacacataaatggattttcaagaaatgttttgtgaccaactggttttatcctttccagagaacaagaaatgatctaatatgtgctcaaggaaggaggacaactggatttcagaaattggttcatgttacagcccctcctctaccctttttctctggcctgacctttgaataatataagtctgaaaagactaaacaaagagattgctcaaactggatgagtttaaaaataacattggaatgctagccttcagcaagccatatatcttatactgcactgagcaggacagtgccctgtggtgggtagaagatgagtcacacagtgatcacaaccagatccttcccagcctggatactttggtggagagtggtgtgatggctgatttatttgtcttgtttgtttgttgtttcatttttccattttactagtgtgatttcagaatcacaaggaggcaaggaggaaaattgattttagatagcagcttcagaatgaaaaatgagtggaaattccacttttcggtctagaccagggaccagcaaacaatagcccgtgggccaaattcagcctgcagcctcttttcataaggcctatgagcagtgcctggtttttatatttttacaaatttgaaaaaattcaaaaaaggatcttttatgactcatgagatttgtatgaaattcaaatgtcagcatccataaataaacttttaccagagcataaccatgcccattcatgtatgtgttgtctatggctaagtttgtgctataatggcagaggtgaataattaaaacagagactctatggcctgtaaagccaaaaatatttactatctgaccatttggagaaaaactttgccaacccctgctttctacatggcgtatttcaatggctgtatttgcgatgaaggctccaggagccttttatctaaagaaatcactattgcctcattgcttacagtccagaacaataaagcatctcagacatccttttcactgttttctgggcttaccatgatgagaggttttgtttaccgaagctggcatgtgagttttgccgctgtggaattttctcattatatcctttgctatctaagccaactgcatgttgttgttgttgttgttgttgttttttgaaaaccagaaaatctgatctcttagggttaacagtttggcccatctgaaataagtccatacaattaaaaacatttctttctattgacagggactgagggttgagggaaagcactgcagattttccaggtgtatttttttttttttttgctccctggattttgcctgaaccctcacttttctctttcagggaactttaagcacacttagtgaaagactaaaggtcagagagcacaccagccacattccctgagtccaagcagggagccagagaggagtggtttctggccagccttccctgttcagttacctcatggaacccttgggaccagggccttgatttacaaatagagtggccactaggtaaaagttgcccatggccagtggtagcaggatcgaccctagtgtctctgaatcattaagtacttcctttctgccctcttccatttcttactcaaaaacaccagctacaattttgagtctggtctgcctggaaatttccaaagggactttggtgccttaataaatattttcaaattgctcaaggttttggaagatagcagagccataattgtgaaatcgggttaaagaatgattgctgcagtacttgcgtcggccctgtggccatgctgaagtggacagggttgtggacactcacaattgctcactgcagatggacagcctttgcttttctggtcatacatatgcttgatcctgaaattctctagatgggctacttctgagcagctgcttggagaatgggaagccaaccctatagtgtaaggtttcttaactgaagtaccattaacactttgggatagataattttctgctgtctgtggggccgatcttttgcattataggatgttagtggcatccttggtctctatccattaaatgctagtagcacaccccactcttcattgtgacaatcaagaaggtctccagacattgccaaatatcctttggggaaaaaaataacccctttgaaaatcactgatgtagtataacataaaggttacctgaccaaatgtacttcccattcttttaccattagggatttatccctttaagtcttcactctcatcattagggattaatttctttaaatgtcaaagtcttttttattttctagaatccctcacgacaatattgatttaactaacctgcacgttgtgcacgtgtaccctaaaacttaaagtataataaaaaataaaattaaaaaaatggtaaatccttaagcttgggatggcagatggttttcagctcctatgtgaactctaactgatagaaagtgtccatctatagtgccgccgtgggaagatctttgaagctgcattttaggtgttggagaaaggacattaagacagattagagctgtcttccatgggcaagagatgagggagttggcatacacgtgtaaggaaccttcttacctaacatttctgcggagattcactatagtcaggccttaggctggtgctgtagttcagccttactgctgagccctgtgccagggcactgttcacacaaggtccctgtagccttgtgtatttgttagggcaattttccagcaggttttgaggaaagggcaccttttctagatcacagagtgccatatgggcgagcagaggtgctgtactctgttgatgggaatagaagtcagggaacaaaaagagaggggcaaagaatataacttcctgtctgtctctcctgcctgactgtaaacttcttgaggccaatgactatgtcatattcaccattatctactctccgcctgtcacaacacattttgcatagtgtcaaagcaagtttagtgacttttagcagagttcttgttctgtatcttggactccttagcagtcttgtggaacctatgggtcgcttttcagaatagtgcttaaatgcacaaaataaaatatttaggattaaaaatataaccaatgaaatttatatatagtcagcaaaatattagaaaactgtgatagataatgtgctttgattgattgatgtacagtcagcaaaatattagaaaactgtgatagataacatgggatttgattgatgtacagtcagcaaaatattagaaaagttaaagataacatgcttttttattaagtaaaatctagtggcagttctaatacttactctaattgcaaattattggtgaatgtaagtgatattttgagctgtctccaacaactgtaatgttatataaaaagtctgtgattcctactcctaataaagtcatggtatattagtccaatctcacactgctataaataacttcccctgagactgggtaatttgtaaagggaagaggtttaattgattcacagttctgcatgtctggggaggcctcaggaaacttacaatcatggtggaaggggaagcaggcacatcttacgtggcaacaggtgagagagatcatgtgtgtaggagtaactgtcaaacacttataaaaccatcagatttcatgggaacacactcactatcatgagaacagcatgggagaaactgcccccatgatccaatcacctcccaccaggttctgcccctgacacatggggattatgaggattacaattcaagatgagatgtgggtggggacacagagccaaaccatatcatataggtactaatgatctacctggggcttgtgcttacattcataactgaaggcggtgctaaatgttagctagggggtggtaaaaataacctttagctgggtaccctaaattctgtcttatccccaaacgccctgaattctcacttctttcttttgtaactgggcccctgctctgatggtttcctcctttcctttgcctgatgctacctcttttaccttcttggggttcttccccagcaaatttttctaggttctttcttctgcattcactttccatctctctcagctgggttgtgtcctttggccgctatctaagttctcactccgcttagcatgggaagggaagcttctaggcccagcttggggttaccctgagcttcagaggagagagggaggttggcacatcacagatactcactgaatgctttttgaatggaaacagttgctttgccaacttcaccttttttatcaggggctcttcttggattcttggactgtgtttgagatcagttcactcttgatatctcccctccgcatggaaagcatccacaaatttccagctagagcatgaacttgcaatttggtttgcctagatcctggaagtctacagagttagaatctttcctggttctgaactcagaagcagcagtgagcagtgggactgctgggacctttaccagcaatcacccaccacatgcaccagcttcaagcagctctgcagaagccgtccgtcaccctccccgttgcacaccttggctgtgaaccgccagggcaggggcatgtgtgggaagcaggcggcctgcagattcattattgctacaagtgaatttcataataaacaaacaaaaatgagccatctctagtttagttccctttgagcatataggccatcaggtcccaaaatgttcagagttgggttagtatctgtggctttcaccaggtaaacacatcagtgttcttcctaatttggactgttgtggcttccctagttcttttttcccctagattgttataaaggttctgtattagttttccagggctgttataataaagtgccacaaattgggtggcttaaacaacaacaattttatcatctcatagttctggaggctagaagtctgaaatcaagatgtccagctagattggtttcttctgagggttgtgaggaaggatctgttccaggcctctctcctggacttggggatggccagcttctccctatgtctcttcacatcatcttctttctacatatgtctgccggtgtgtccaaatttccccttttcataaggacaccaatcatgttggaatagggcctaccctaatgacataagttgatgacttctgaaaggaccctgactcagaaatatcctgaggtactgggggttaggacttcaatatatctttctggggacagggtccttgcatgctgtcagatgatacctgcatctcgcagtgatggtcaagcgtaccctactctgcttctggctatggcagtagaaattgtgtcccaggggaatggctaaggggcctgtaaacaatgggtgccatatgccattaatggctcaaacctctgccttgtctacacactcatgtatcccataaccctctgtctcctgtcaaagccttttatcaggaaaggcatagaaccacatttcacgctaaggcatgagtgttaaacataccctcacctagccagttaaaaacattgggcaaagctgtaaactacatcacaggagttcaaaatgtcaacagagctgcccccagtcctgtctgtgtttttgcttaggacccagtgttgtgtcactactccccattgataataaacaaaacatgcctcatatgttcacagttatttagagtttacagaattctctccttctatcaatttgtttgtgcctgaaggagcaggaaaggtattattttctgcattttatttcagagaaaacagaagctcagctgagtaatttgttcaagatcatccaggctgtggccggagcccacatcatccatgtctctatgtcagctgtctttccactgctccaagccacctgccctgctgccctccgtttcccctccaggtcactgttgtgcggaccatgcaacccgagtctcaaagactcacggatccccttgctgtgctctaggacccagtcctagcacctcctaacctccccaagagggcaaaaagcagcctaggtctggtgagggtggccaaggccagaggattctgttagtatgcagatcaaaggaggagcatgggcaaagtgacaaggtttgtgatggagcagaacagtgtcaggaagtgatgtgaagctcagcgtggctcgtggatgttgagaagtgaggttgatgggcagggggtgctggaccacagaagaccaggtgttccaagtggggcaaagatgtggtctgtgagaggctgagagccactgaagacctgtggtttatcagagactgctgtggtggcagagtggaggcaggatgaggcagggagctgctccaggttcctgactgccggtccctgccagtgctggtacattcctcaaggcttctcagtggctttccattatttccatagaggggtcacctttagttttggggagtttatttttgagatggggtctcactctgttgcccaggctggagtgcagtggcacgaccattactcactgcagtcttgaccacctgcgctcaagtgatcctctcacttcatcctctcatgtagctgagactgtaggcatgcaacacgatgcctggttaatttttttgtattttttgtagagatggggtttcaccatgttcccaggcttgtctcgaactcctgggctcaaacagtccacctgcctcagattcccaaagtgttgggattacaggcatgaaccaccgcgtcggccaccattaggtttttaactgtttaaggcattctttttatactgaaacccagaagaagcatcctccccagcttcagtggaaagccttagagctgatggaaaaccagtttcgagttggaatgtggaggctatttctggcctttgtgacatcctgttcaactttcagaggagcctgggaagaaaggggtgactcagactataagcttatttttagggaaagctaagaattcagtcagagccactcggattccctattgcctgccatacagaatgtgctgttggtggagagattgatgggcagaaatcctatgtttatcacctgattgttacccagcacctcccatgtgccagtataaggtttactgatttgaaaagaggatggagatcaacacaaacacacttttaaatcagaggagcatatttcaaggcatttatatttaagaactaattttagggccaaagaactaatattgtaagagcttctgtgattaggtacttaatatatactactgttatggtaagtgtttagcaaatactaccgcatttaatggaaacaataatactctgttagaggaattcttatcactgttttaacagaagaggaactgttaacttgaggaggtttaacgttagcccaagaccgggtagctgagtccagattcaaactcagatctgtctggctccaaacccatgcaaatgacccctccgggtttggcaattaaacgactcacatgttgccaccctttgttcctatgtatcactaattgatcatggaattatttcttgctcagctcagatttgacctcaggatcctttcaacacaatgctacaggtagccactgctcccaactgagcaatggtagtacttgaagtagcgtctacctgtcatcttagctttatctttctctgtatttactcaaaatagaatctttaaatctacaggggtttgttgttgtttatttctacagatgtatttgtaaccttttattgattaaacaattgtaagaaatggagtattcaatacaatttccttttatagtcactggaaactctgcgtgctttaatagaggatcctaactgccttggagggaagaatgacgtcttaggactcaaagccttgatacaggcaactggcttatgtgtcagtgtggtagtgatgagtgggagatggggaatcagcctgaagaactcaagctgtatagcagtaaaactttcaattagcccagtctggttaattacaactggatggtgagttggggttgggggatgtggtgggaaggctaaagaagcaagataacagggtagatttgggggttgcatacatacacaccttcagttgccgtgaaacatttcagctcagcagacagacctgttgtcctaaaagtatagcaccatgtggggctgtgggtccctccagggagaaaggagttccttaaaagcaaactcagacaagagaatggggaagatacccccagggatagtggtgaagggagaacctagaacccagccttgcaggaggatgaggtagaaattggtccaggaggaagtctatggacaatatctaaaactggagcatcaagaaatagtaatagaaatatgttgcttagaaaggtggattccagatgattgagctgaaatggagttggacagtcacaatgtatggaaggtagtgcaggtgcatcaccaacacagattcattcgataaaattaaaatgtttttgttttactttcaaaaaaataaatagcaaaaaagcaagctcaggccagtggtggctggtggcctgtcagcatggagcatggaccttagccacaggccagggctttaaagccaggactccaggacctgggatgggtcattctgaaagctgattatcagaatgctcaggccagagctgggccagctgcccaggtgttgatatgtgtgtgtgtgtgtgtgtgtttgtgtgtgtgtgtgaagggctgagaactgcatctactaacatactccttgtgtgatgttagggttagtgaattgacctacagtggtacttggcctgcaggaaggggataaaaatgggcatcatggtaagaagttgggccagcaagcagctctagtctcacaaagccttttcctggactaatgagagggaccatggggaggggtgatccccccaaaatcaaccagatcaagttcctgatgaatgggcaatttatgactgaccagctggacacaaaatgccattgaacaacccaaatgaacaacacttctcagtcaaaatgctgctttggagagtctgtgtatgcaaatatacctcatatattcttctcactgtgggatggagcaagaaggccctgagcgtgtttctctaaaaatgcatagcaataatcctagtcttaattttagcctcttctgggcatctgaaatggggttgctacagttaaaataatgctgtataactaacatgatattgggtattgaggtcagagcagggctggcttcatcagcacgtgatttctgtagtcacataggttccccactttgttaaatgctccatagccatattgaaattcttaataacttttggaccaggagccctgcattttcattttgccctgggccctacaaattatgtagccagcagtgggttgtcataccccagagtcccagacaccagccagacatttgctgtgttgaaattatataggggaaaaatataatttagagcataaataaacccccatactttcagcaatttaacagtctaatgcaggtattccttgccagtggacagctttcctccatgtggtttctactatttctgactctgctatctcccagggcctcagaatcctttgcctccagcctgtcaaatgagagaggatgaagaggcacactcacttcttaactgcctttgtctggaagtgacccacatcattcttctcatagtctggagaactagtcatatgaccacacctaggtgcaaagaaagctagaaaacatggtacctggctgggtggttactttccagggctgcctccatcctatgggaggaagagcgtaaatttagatggatcattagccttctctgccacatagattgttcatgaaggaatgctgatgcaaaagcaggtatctcagtgcagactactgtgatggatcaggaaaggtaggaatccgggtctttttaacacagatgccagtctcttagcctcatcagttcattattattaagatgcttgctagttccagaataggaagaaactagaatcagaatagtctgtgtttgtttgcttgcttgcttatttatttatttccaagaacaggtttttggggaaaaaaaaagaaacactaacacattaaaatgtacacattaactgtaagatgcattgctatttcagtaacattataatgcgagaggaaacacaatagcatatcttagaattgacgaaatctagtaattgtcactgtgaattattggtttagtaatttttcacaaatccttttgctagcttcataaagtcctttaatagtgctcataggggatagccatgtgttggcacttggatctggtaggttctgcctgaccattttaatcaaaatgctgttaaccagggtaggcaccgcctgttgaatagcacaccttcttggtgaatttgtctcatggagcctcatttctggatgtgtcttaggcaaactaggagccctcaagatcatctagacccacgctggaaagaggtctaccttggagatgcatttatattcccccctgagatgctggtgattttgcaagtagtaataatcagagacctggaaaacttcaagagttctgtaggaaatatgtcctggtcagttctcatcagctcaacaaactgatgtggctcttgagggaaccagctgcaggaggcaggaaagcaagttagcatcaacacaagtgggccagcaccatagtcccaattctcctctttcatctgcttctcctccaccctagtagacaccttgggaagacaaggtagagacagtggcttgaaattcctagtgtcttcctttgatgggtatgtgctcctgcagagttaagggagtagatgaggttaactgtcatctaaacaaaggcagtggctgtaaatatattccttggagcttgggagccccatggctatgttccaggccagagagtccaaagaaaatcaaagactgccacctaacagcttttttggccatcctgaaagtccccaccttctcccaggtagctccagagaaagacaactcccagccaggctctgacagctgaatcgaatggcccagtggtggcacattccccagagggcttcaggttcaggatgcagccaagtttcctgctttatcctgagttaagcagagatcatcacctgcctggatgttgttttgtctgtgtcacctcatcactggagaaaacagattaccatctcctgcagtttttttcacaaaacagagcatggcatggaggaaataagatagtcagcatggcatcttggtgggtcaaaaataatatcatctgtatactttgattacattttaaattcagtttgcacacaattggggttcatttaattaactctaagctgtaatctcagtctgggtttgaatggatctgaattttaatagctttttcctccaaaatattatttctatggcaaataagcagcccttccttataatgctgaaatcatagaagttagttgttttcccctcattttttgacaatcattctttttgcggtagtaacgaaatcaagcagttttcatttggctttttggtagttgaagttaatttgtcaatttcctgctagtcttctattacgtacacatttttctggttagctgacaaatcagaatgctaatgatggtggggaaaagaagactggcaaattttacttctgtgggttttaccaaaatcataattggttgatttttcctttagaccttccaggataaaggattttttatttttaataatattttcttcattctaaataagaaagtgaaatgtacaaaacagtggaaagaataaaataacttaaatgtgcctgtcatggggccttacactcaatcagtatgttaacatttttaaagaaaaataaatgcccataatctcatcaccaaacacatgtagggaatttttttggcaaagattttatatatttgtagttatgctctctataaattttgcatcaagcttttttcatttcacattttcataaataatttctcatgccgttataaactcttcataaacataattttaattggctacgtaattgttttttaggagtacatttggctgcaagtgcctgaaaacctgggaagaaacagcttaagggtttttgtttgtttttttcatggaagaagacattgagacaaggggataaggggtcattgagaccatcagagaacctcctcctgcagctctgtttttcttagtgatggtggctgcaagccaagcacagggctctcccagagaaaacagggaatcactcccatctgcagactaagccatgtgatcaccctagctcaaaaatatctgggaaggtgggctgataactttccagcctttgtagtggaggaatatgggtttcttaaaataaaatgacctgaattagaattactgtgtcaaagagcagttgatttttttccccgaaattccagtctgattgcttatttggtgaaaagcaggatttaaaaacctgtgctccatttactaccatctcatttggcactggaaacacaaatgtacaactagttataaaagtaggatcaagtccaaaacctgtggctatcagtttcggggaggcagctgtcaatgcaagataaggaaaaaattcctcaatatttagagctgccccagtttggaattaactacttcatgggatggtgagcaacctttcccaagatgcagcgactgaatagatacttggtatataggcagaagaggtaatttacgcatttggtaaagtagaccgggtgacctgtaccacctaggcatctccatgattttaaaattaggatacatttgctaaaatatttccccaagcacccaggatatcctttgcatggtggaaccttgttctgatgttgcttcagatcaaacatagtagcctgaaatgtggctgtagtagagtagttgcctgagatgggaagaattcacctcccaggctcctgactccagggccatggaaaagctctatcttgggtttgagaccagccattacctgggtcaggcccacataccagccccatccaaggttacatatctgatttcctcactgcctgttaacatgactttattatttttcctgatgccatggatttcttcttttgtatcaacaaaatgtgcatgttccttatgtaaaaggtggtataagttctatctttgacattacccaattataaaatgcagtaaacataaaaacaattttctttttgatttatttacaaaagtggtctttccaaaacagttttactagtttaactcattttatctgaactccagcttaaagctatgaagtcatgtgtgataaataaacatgcatctgagtttatgtaattcagccaagaaatattttttgaacattttctatgttatagatatatttgtggatgctgagaatgttcatggtaaatacaagacagtctctgccctcacggagcttgcattctggtgggagactagggaagaataatttatgaataaactattgaatatatactatgtttgtatagtttgtagtacagagacttggttgtgctggggagggggataccttcatagaatgttcaagaaaaaccttactaataagctagtgttggagctgtgataaaaaacaaagagtgagccatgtggatatctgggggaaacacacttctggtggaaggaacagcaagtgctggcctgagctgagatcatacttagtgtgttcaaaaagcaaaaggaaagcctagtgtggcaggtggggagtgggtgaaggagagtggtaggtgatgtgaccaaagaggtggtggctggggctggattatgaaggcatctatataccgtggtaaggatgttggcctttacttgacatgagatcagaatccagtggaagatttggagcacaagaattgcacaatctgacctattttttaaaaagattactctggctgatgtggtgagctgagttagtaaggaagtgggcaagcgtggaagcagggagactagttgggaggatattgtggtaattcagagggaaaagagatacatgtgggccaagctagcagcagaggagatggggaatcctggattgatgttgatagtatagttcaggggatttttctcatccagtagatctaagtggaatgtgagagagagaaaaaaaagtccagaatgtgccaaaggttttgaggtaagcaactagaaggatggagtttcactggaatgaaatggggatcaccatgggaaggcctgctgtgaagggaaaataggaattcaattctggacatgttaagttcaatttttggagatgttggtctgatacctaggtggaagtgttgagtggtcagtgtcttagcctgttagtgctgctgtaacaaaatgccatagactgggtggcttatatacaacagaaacttatttctcatagttttggaggcttggaagtccaagaccaaggcattagtaggtttggtgtctggcaagggcctgtttcctggttcatagatggaaccttctatatatatatgttcacatggtggaaggggcaaggcagctctctgggaccttttttttttttttgtctgaaagaattccaatattatgagcatgtaatataaacaaaggtagtgctttaatctattgggaaaaggatgaattatttaatcactagcaatgacatggagggagaaaatcaatatgaaccaatggagcctcttttataaaggcactaattcaccccctgatatggtttagctatgtcccgacccaaatctcatcttgaattgtagttcccataatccccacatattgtgggaaggactatgtgggagatgactgaatcatgggggtggttacccctgtgctgctgttctcattatagtgagtgagttctcacaagatctgatgattttataaggggctttttcctgttttgctgggcactcctccttcctgccaccatatgaagaaggacatgtttgcttgcccttctgccatgattgtgaggcctccgcagccatatggaactgtgattcaattaaatgtctttcctttataaattacccagtctcaggtacgtctttattagcagtgtgtgaacaaactaatacagtaaattggtactggtagagtgaggtgctactgtaaagatacctgaaaatgtggaagcaactttggaactggtgaacagggagaggctggaacagtttggagtgctcagaagaagtcaggaagatgtgggaaagtttggaacttcctagagacttgttgaatggctttgaccaaaatgctgatagtgatatggacaataaagtccaggctgacgtggtctcagagggagatgaggagcaaaggagactcttgttatgttttagcaaagagactggtggcattttgctcctgccctagagatttgtggaactttgaacttgagagagacgattttggggcatctggcagaagaactttctaagcagcaaagtgttaaagaggtgacttgggtgctgttaaatgcattcagttttatatattcacaaatatatggtttggaattataacttatctttaaaagggaagcagagcataaaagttcaaaaaatttaaagcctgatgttgcgatagaaaagaaaatctcattttctgaagagaaattcaagccagctgcagaaatttgcataagtaacaagaaagccaaatgttaatcaccaaaacaatggggaaaatatctccacggcatgtcagaggtcttcatggcagcccctccaatcacaggcccagagggcctatgaggaaaaggtgtttttttgggctgggcccagggccttgctgctttgtgcagtcttgagacttggtgccctgtgtcccagccatggctaaaagaggccaatgtagagttcaggccattgcttcagagggtgcaagccccaagccttggaggcttccacatggtgttgagcctgcaggtgcacagaagtcaagaattgaggtttgggaacctccccctggatttcagagtatgtatggaaatgcctggatgtgcaggtagaggtgtgctgcaggggtggggccctcatggagaacctctgctagggcagtgtggaaaggaaatgtgggattgtagcctccacacagtgtccccactagggcactgcctagtggagctgtgagaagaaggccattgctctccagactccagaatggtagatctactgacagctttcatcgtgcaactagaaatgccacagactttcaatgctagtccatgaaagcaactgggaggggagctttaccctgcaaagccaaaggagcagagctgcccaaggccatgggaacccacctcttgcatcagcgtgacctggatgtgagacatggagatcaaggagataattttggaactttaaggtttaatgactgtccactagattttggacttgcatggagcctgtagccccttggttttggccaatttctcccatttggaatgggtatatttacctaatgcctgtacccccattgtatctaggaaataactaacttgcttttgattttacaggttcataggtggaagggacttgccttgtctcagatgagactttggactgtggacttttgagttaatgctgaaatgagttaagactttgggggactattgggaaggcatgtttgtgctttgacatgtgaggacctgagatttgggagaggccaggagtggactgatatggtttggctgtgtccccacctaaatctcatcttgaattgtagttcccataatccctgtgtgggatcatgtgggagatgactgaatcacaggggtggttaccccatgttgctgttctcattatagtgagtgagttggttttataaggggcttgtcctctttttgctgggcacttcttcctgccgccatatgaagaaggacatgtttgcttccccttctgccaggattgtgaggcctccccagccatgtggaactgtgagtcaattaaacctctttcctttttaaattacccagtcagctatgtctttatcagcagtgggagaatgaactaatacacccccgaaggccctacctaatataatcacattgataattaggttttcaacatataaatttggctggtggtggtggggaggtcataaacattcagtccatagcatgcagataaatttaggagtctagaattcaaaagagacgtctgggctggctgtataaagatgggaatcatcaatgtttagatggtacttcaagctaggaggttggatgaaatcaccatgggagttaaggtaggtagagaagaggtctgagaatagagctctggactgttacaggagatggtgaggcactaggaaatgaaaataagaagggctggccagtgaattaggagaggactaagagaactagggacctagaatttaagaaagtatttctagaaaggggcagtgaccatccttatgaaaagctgctgatatgccacgaaatctgaggccagaggattgtccactggatttagtagcaaggaggttactggtgccctgaactggagctgtttagatggagaggtggaggtgaacactgggaggtctggatttaagtgagaatgagatgaggcagcaggagtgttgactccttcaaggagttttgctgtaaagaggaatagaaaatggagtagtagatgagggagattgtgggcttggaaggggatacttttagagatatgacagtatgtttgagggctgcagagaatgatctagagcctgagaaacattgatgagggaggagagagatgagacaactgctagaaggaagcacttgagttgggaaatgaggaaggcatcgagtgcacaaatagagaggctgttcttgtgcaggagtgatagcagagcccacagaatgagtgcaggtgtgcgggagcctgtggtggcttggtctgtggatgaaccttctgactgcttccgttttctcagtgaaatgggaagcaaggtcatcagctggcagggaggaagggggaagaggtgttggaaatttgaggagagaagagaaggtgtgaaataatcctctcagacagttcaggagtaattgatctaaggcaatgcagtcagatttctggatacctccaacggctcccctgtgattagggatcttgaatttaaataagagcagacagtagaaatcaggtcttgggtgtgtctccagtgttttcaactcaataggtgcaagtacaggtaggcaaagtattggatttaatctgagttgggcttttgccagctgagtatgacagagagagaggggtgcaagggaattgagggtgtggactgtgggtatgatgatggttattgatcatagaatctgaaagctggtcagagagggacatgaggtgggtgcggggcagtgaaggggtggtagaaagagtgctatgctttatttgacttaacaaactggactccttattataaattcaatcacatttctaatgcatggtggaaagttagtatgttaaaaaaaatagtacatttttatatgttaaatatcctatataatagtaataattatctgctgtgttgctgtttttattatattctttttctttatgtttttagagatggagtcttgctctgttgtccaggctggaatgcagtaccatgatcatagctcactgcagccttgaagtcctgggctcaagcaatcctcctgcctcagccaactaagtagctgtgactacaggtgtgtgccaccatgcctggctaattaaaaaaaattattttagagacggtggcttgctatgttgctgaagctggtctcaaactcctggcctcaagccatcctcctacctcagcctcccaaatagctgagattataggcatgagccactgtacccaggtatattgtattttcttaaagcaagtcatggtatacctgaaagaaaccaaatataaggcactgtagatgaatcccagtgctgttggcagaagggacagggaggccacatgtgaaccaggggtcactggccctgccccaaaggctggacttgaatatgcagctggtgccactggctaacagagccacagtctcggtcacaataatagaactgttgacccatgaggtttctggtcataggggcagaaactgccaacagggagagggcagctggccatctgaagccaggatctgtcccatccaggaaaggagaattggcaggagttggggacatcttgccatgggtgaatactcctctgagaagggagaagggaggaggcagcttacagacagaaccatgagggagggacaacatggagcccaaagccctgctcctgagttgctgggtctggatctcggggtcagggttgtttgtgagattggagaggcagcagaagtagcccagatgaaagggaagaacctgggttggtctctttgctgggcaaactctttgcaccacagtctgggctggctcaggcattggataggagtgagcctgagggtgggggtactgacccatccagcggcacaatttgggaaaggaaggggcagaagaagcaaggcgcggctgatgaggaacatctgctctcttcccacagtgcagatggaaggcctaaatgccagcacaccgtttatttcactttggcaaaatccatgtttatttcatccctcacctcattgtctagacttaacataaatcaggacagtgcaaatggaaaccacaggtccttctcttggccttgccagctttattcttccctagggcaggtgcgcatgttgcattagtgtcataaggtggcatgagactgtaccaggccattagtcctgattctgatccagcagcatcactgccttgctccgtgatcttcccatgtttgagtcacctcatccttgatatggaaggggcagtacctgttctctcagtagcataagataagaggtagggaagtgcttgggaaaatgcaataaaagacactgctggaagccttcagcagtaggttgggttacagaggtcttggccttgcaaaatgaagtgaggtcagcacagattaagcagaccaaatcaaatctttgatggttgagtgatttttaaaaatgattgcaggtctgcacaatttaacaagactgcccatagcagctgaaaacatttccagagcagatcagataaagccaagttagaaattggtcattgctgtaaatcaagtggcagactatcaatgacctagattaccccagttttcccacaggaagtgaaaggaaaaccactgtgtggctgctgaggcttgatttgtcaagagctgagagagctacacaacattaaaagattgcccatttctcagcttgccctaatgaattgggactcatttaattcagaagctgatgagatgtctaaatcacatctatagaataagtggtcagatttaaactccagttgccaacaatctgtaacggcctctggttgcgttgttcatctcttagttaataaatgcttggctttttgctgaagctgccgctttttaatgtctaacaccatgacgtcagcatttttcccattttctgccctccctttaaggaggtagggatgagaaatggtaagaagatagggcttgttatgggtcttgacttggaagacccagagcatgggtcttgaagtagaaccttgatggctcttttctgtctgtgctgcaggtttaggggcctgcatttagactggcccataactatgggagctgctcccagccatcctagacttctcaagaagcccataactcttaggaagaactaagagcctaactcgtgttgtcctggacttttcaagaagccgataactcctaggtagaaccaggaacccaactctactcgtctgtcctacgtagggtctacaaggcagtgtaacacaccacgccctgcaccctaactgatcatagtcagccgtggtgaccacaggatggttcatccttcttgctggttcccagcatccttcttgctggttcgcatgtgctcttttggcacttatcactcccacattctggactcctggccctgcagttgactttgaccctacctttggccctttgaatttgtgcaaataccactgctgagctgacttgactcattctccagctcccactaccgtttgcagtgaaggtttgtaatgcccttgatgagaatgaagctcccagtttcacattgggacacagtgggtaagcaaatgccacacaaaagaaggcacatagtgcacacttgtaccatcatctaacgtctgcatggttctattgcagggctatactttcttatcggtagatacatggaaatggaaatgcacctgcttttaaatatatacttaatgcacaagtgtcaatgatatagttttcacctgaagaaaatctagagccatcaaagtacagggcgagacatactatatgagcctgaacgattgtggcaggattctaagaatctggatgatgaatctgaagaactctgtaacaaacagatgcaaagatgccatatttagacctcagaggaagtgagcctcctgtcactgggagaatccattcattctcctgattcactcatatgcagaataagtgttgatggccttctgtgtgctagggattcaaggacagtgcagtggaaaagatgggctagtacggaggatttagaaggtggtgtgggacaataagtactctgatagagaagcatgtggtgctctcagaagtaacttgtccatgatcacaaaccagtaagtggcaatttaattttgaacacatgtatatctgacaccaagactcatctatcaaccattaagctatatcattgcataagcagttccctgtaactggattggaaggtttgagataatggtgagaatggtgagaaagaatgatggagagatggactgtcttgtatgccattttaggtagagtttggattttatcctgtgggtcatgggaatctctcaggaagtgatctagttggatatgcatttttgagagagtactccactgtagtatatgaagtaatttgaattgggagggatggggagtgggcagtaagaccactcagaggtggctatcttgatactgatccaagaatgaaatagggatagactgacatgagagagtggctgtggagatggtgaagaaggcatggatttgatagttatgtggttgaattgctggaacttggtactgattgagtaaagggtgagaggtatggagaaataaagttgatagccatgtttccagcatagacaaggggatggttgatgttgaacatggaaagagggacatattttggggaaaagtgatgagtttattttggacatgttgagatcataataccttcggaatatacatgtgagatgcctgataggaaataacatgtaggtatggaattcaggaaggagatctggttttggggacttcagtaaatctgcatcaaatagtaactttagccatggatgtgaatgaggctatccagggaaagaatgcaaaatataaggtcaacctggtgactcactgtgctgagggaagccagggaagcagaaggggagtcagggtagacagaaacaggggggtaggtgaagatgaaagaactttccaggaaggagggagtgatgcatggtgccaaatgccactgacaggcaatggtacacattctaaaaagtgtccattgaacataccaactagaaggtaactggtggccctcacaagaatggaaaagcaggttcagtgaggttgtggagtgtggagttcagctgagaggaagttggggattaaatgaagtctttgtctccctaagtggtgtggctgtgaaggaaagaagagaagtaagtcttagctagagagggcataggatttgcatggattgttttaagaagaggaagtctaaattcttaggtgaaggagttaggagaaaatagtgaaagaggtgaaatgcaggtgagtggaggataaatgatggtatggggtccctgagaggtcagggcatgatggaattcaaggtactggttattagcctttttatgtacaaacaaaaaagatattgatgttctatttatgctaagtatgggcttgtcctggggagaaagtatctttaactgaagctagagagttgacaaggaacatgtacaaagatccctggacagtgttgagagctcagataaggttggagaccacagatttgtagtgtcgttctcctacactccagggcaccttatgtaggtgtttgatcttgggaaatgagactgtgcttagctctcatttgggatttttgccagatacctggatgtagccaaaggacgaggaggcaagattgttgaggatataggaagacagtgcagtgattggaatggattgttcacatgatcttaggcgaaaagacataaaaatgaagacaggagggctatgatggactgggataagatagaggaagctggagattagaagatttgaaaagacccaagagcagaggtgtgaggacaagccagtgagagacagggaaagaggcgaggctgtggttggagtctgggccgctgcacctaaacagttccacatttagtgatgaggccagatttcagccctgagtgcagatcgttgaggagagtgaagatcaaggtcatcagagttgaggttttcaggaaactgtgggaatagggttgaatgagtcatgaacacaaacactgaagtcaccccggatgatggtgggatttcatatagctcctgtgagccaaggaatgaagtcatcagtggatgtacggaagtgaccagaagatcagctggggacagagttaaggagagagggaacaagggaacagatgagactttttccatgagggcagaggagtcatggtctggaaatgacatgaaggagaaagaaaagtgccaaacccacttcctgatcctaatgccatctggcttaagagcccatattcattgagtctgaaatgcaacggacaactaccagtttgtctggaggcggtacaaatactcttctaatatttttttaaaaactataggatgtagtctattttcaactttattcaaccagatttatttacccctaccgagttttctaaatcagtgaatcagtattttaaggaataaatcttaggcacataaaatgataggaataaaatatgtattataaagcttctttaatcaatacaagctattcttataagtctattggttaatgtctagattgccgtgcccacttaaaatgggaaaacattccagttggcactttgtggatgttgagttgctacttggacacagttactggccttttggtctgatcagaggccaattttgagctaggagtttcccatgcatatgcatgatgtcctactatctgtgatacatgctgggcatctgagcctgcctggtatgctaatgatcagaccagggaaatgcacatcactgtgagtcacaagggtagcacgtctaatctaaaaaattcaaacccctataattagagttcagatgtcttcatagctctattcctcagatttttttgatctgaaaaacaaaagcaaacaacaaacaattgtgtaaaaatagacagtctaggcttgtgtaaatttgcagtggaaatctgcctctctgatgagccatacagtgtctatgggttgaaaaacgaaattcagaaagcaaatagttggtcaccttagagcccagagggatgctcagaattccctaacctcacagcggtgactactgaaagtttcattctgttttatgacttgacttgcagcgaggaaggtagcacagctgtaaaccagctgtattttatttacgcttggaaacagggcccctttgttccaaatgttcctggccccctccctcaatttcatggatttaggttgttagtggaaaagtagttgttgaaatatcagttcactcttggaacctgccactcaccaggacttctggcaaccagtgagcctttttgtgatatgcagcaaggtaaagaagtcgttaagtggatctcccacatgttcctctgtgacttcattcatagaaatgcgctgataactgagttacattaagcgcagtcttcccagctgtctgaggacataagggatgtagcgcctcctagtggagggaatttcttagcatgtgttcaaccccgcacatatttttggaatgaggcaaggtatttaaaaatagtgtacgctaatgaatgtatttattatatctgggtagcagcgaaacagaaaaggtataaataagcctttcgaaaaatgtacttgctacacaatctctttttttttgacaagtcagcccttgaatacaaataatcttttaatggtgaaaaaaatgactgaatcatagcatcttataaacataggagctatgggtatcaataacatggaaactgaagctgtggttatttttgagtggaagaagagggattaaaattggcgtggggcacatggagaggcttctggaagtggctagcaatttctatttatttttaactgggtggtgattacaaaggtgtttgccttataaaaattcatttagctaaacattggttttatgatgcttctgtatctgtattgataagaaggtaaaaaacataaaaacttttcattaaacatactacctgctaaatttgctttttaaggaaaaacctcaaaaatgctaagccatgtatactttttatttttagagatggagtctcactgtgttgcccaggctgaactcaaactcctgggattaagggtttctcttgagtagttgggactacgggcgtgcctggcatggttttgacactttatttcactgtactttcgaaataagacttaggtaccagtgaacacctacattgacaggcctggtaatatcattaaaacttgagcttttatgttgtctgtggcacagactctcttctttctagttcttcagagaactccaaattcagtatttcacttggaacatccagttgccatagaaatgaccatgtaggttacaagttcatttttgtaaccagtcaaaaggagaaactaagaatgacacgaaggcatctttccattggaaaaaaatcctttgcagagtcccaatttgagaaaaaatacattttgctttagaagtgagaggcgaacagatgaattagtaatgctgaaatatttgactccttcccccacaggtgaaaactcctgcagagcatcttataagaaaaattattttagagcaatataggtgatggcaaattgacattgggttgtaatattctatccaacatagtttaattctgagttattcaatcataactaaatttattcaagacatagaatacatttaaaaattcatcttaaaggaaatttcacaaaggcttttacattcgtgtaatccagatgagaaatgaagatagggggcgagcaacaaagttgaaagacccaaattgattccggaaggacttgccaagtttctataatgcctcattagctgcttatgtggcagggagacctgggaagagcaataactcttttctaggttctcaggttagggaatgagattttgacgtggccaatatgatcttatatgtccatttatgtcttttaccttatcattttcttttaccttatcatggacagagtggccccccagaagcacaggatgcaagacaacacacatttcagtggctgctccttctgcatacatcattgagctctgccaagggtttgaacacacacacacgtaaataaaggcctaattatgtgtgtgtgtgtatgtgtgtgtgtgtgtgtgtgtgtgtgtgtattatatgtattaagctctttttcctttctccatagcactgcatatacaaagatcagccaccctgagttgaaataaactgtcatgatctgtttggcattgtgagatcaccactcatcataaaataagctttttaaaatgttaaaattgaagtgagagcatgagcacaaagaaacaaggaccagaaggtgtttataatcatgaaaaattgggaacaattcaataggaaaacaggaaaatggttaaatatgatatgttcggagtatggaatatgatgcagcagttacaagtagtaaaatagatcagtatgtactgacatgaagaaaatagacttacacataccttatgtaaaggaggtgaggaaaaggaacaatggtcttttctgtattattagaatttgaatatcaaaattggattcatatattacttatataattaaaaaattaagttagtcagacttagaactctttgaaatctaatttttgaaagttaatttatgccatctggaggcaaacatgccaatgtgattgaagtttcagtggtaacctgaatcctcagtctcgttgcacatttactctgaagacattctcaaaagagaattggagaggaaatccacccagtgtgtcccctcatgtatgtctgtctgggatgctccagtggtgagatgccgtcacctcagtccattgtgttagtttattgcaatgttctagggttcagtctcagccccattcctgccaactgttagcttaaggcccttgggcaaaggagataaaattgttcagggccaacagatctcagagtttcttggaaccttaaaaggagatgacccaaacatttcttattcaagatgccaccagctccagtcactcacagtgacttgccacaggggctggtgatgttagctgcttccttggcgtctgagttctggcttgtgagcagatcttatgcccaatacatcagaaactccatgtctccttcagttgtagtcgttgggagaatccatgggttgactggagcctaaggaaagcaccaaaaagtcactagaggcactggagtggatatgaccttttcctttgaacagcagtttgcacaacatataccggtggctttgtagatctggttttcattaccatttctgtcctggggcagccatggaagccacctggatatttcaattagtgcagcaagctggaattcatttactttagagtctactgcctgaagcttctcccagctgggcacccaactacgcccaggaacttctagatataacacagcatcctgatttcagtctaataagtagatctattttagtcttctcaatttccagtcattttgaaagtgctcccctgtccccataccaggcatgggttccattcccaacttctatcactgtcagtggaggtggcagccttgtgagctgccaggtgggaccaggtgcaacccacagcaaggccacttgatgtctcagtctgtagagtaggtgcttaataattgtctttgacgagttaatgggtgcagcacaccaacatggcgcatgtatacatatgtaacaaacctgcacattgtacacatgtaccctagaactgaaattataatgaaacaacaacaacaacaacaacaaaataataataataattgtctttgaatggctgactgaaagcacattcatattatctagtcaaatgaatgtccaccctccactatagagcctttgtaactgagctactggggtctacctcatttcagaatccctcagagtccatggtgtatccattcatgcattcattgagcaaatattatgtacctgttctgtgttagagaatatttgaagtggtgggaatatagtggtgagaaaggcatgtttctgccttcaagacatcaccatatgaaagatactctgggatggatggagggtgttaatagaaccccagcaaattgacaaggtggctccccctgtgtcctctggctagtaagggactggtggctccatgaaacagggagctgccctgtgctgcccaaggctccagccctgcttcctcctcatctcccccctggacgtgactctgcctcatggggagcccattctcttagggatctttgtaaactgatcttcttgtgtcaaaaacatcaaatgcctcagattccattgcttataataagcactttgggaccaaaggaattttttgtaatgaaaaaaacagtttttcataagttaatgtttttcctttgagacctggatgcccttctcttattcatccactgcccatgcagctaatcagatttgaagggtaaaataataccagacttatcattgcatgttacatgagaaatgtattagttaggagtctggggttctaaggcatagagacagcatgagctagctcaaggaaaaaggggagggaattgttataagggcacaggggtgccccacagaatcgaaaacagaaatgtgactaggcctaaggaaagcgtcaaaaagtcactagattttttttctctctttcatctctcttcccatcttccccatccatctatccatccatccatccatccatccatccatccatccatctatccatccatctctctttccttctctccttcccagctcctgcctctgtatttcttcctccttttttcttccaactttcatttcaggttcaaggggtatatgtgtgcatttcttatatgggtaaattgcatgtcacggggggttggtgtacagattactttgtcacccaggtaataagcatagtacctgaaggtactttttggacctcacccttttcccaccttctaccctcaagtaagccctggtgtctgttgttcccttctttttgtccatggtatactcagtgtttagctcccacttataaatgagaacatgttgtgttggtttttggttcctgtgttagttcacttaggacaacagcctccagctctatctatgttgctgcaaaggacatgatctcattattttttatggctgtgttgtattccacggtgtatatgtaccacattgatgtccaccattgatgggcatttgggttgattccatgtctttgctgttgtgaacagtgctgtgatgaacatatgtgtgcatgtgtctttatggtagaatgatgtatattcctttgggtagatacccagaaatgggattgctgggtcgaatggtagctctgttttaagttctttgagaaatctccaaactgcttgccatagtccgcctctgtatttcttcctccacctagcttcctctgctttctggtccatgaggtcaatcaaatagggttgccccatagtgtctaagttttcatgtcaccagcccagccacatcagagagactctcgtcagatcagctatggccagaggtcatattgttccatagtggttcctggatgcagattaacttccagcgaaaagggacacattttgagcaggacagacatggccaaagctatctaatatgcccaagtctacacacacagacacatgcccaaatccctctcatggctacacatccaaccagagatggtcaaatggaccctgccctgaacccacatgggaggatatggttctgacttgagctgcaggatcccagggcttgtgttgaggtgggaacagccctggacctgagccagaatactggggctccagtcatggcttcaccattaaacaactctagagtcttaaacaagttcttagcctgtctgagtctttattttctgtataaactgggagtcacagaggcagctttcaattatttaaaggaccactttatgggagggggataggtgtgttacctgtctagtgttggaaggtgaaaccacagtggagaccacagagtggcaatttgtggctggagatacagaagaaccttctcccaatcaggctgccccaccatgttcaacctgcctgccttgcagagagttggctctccctgttactgtgggaaatccaaggggtctcagaaaacatctacagaatggagatactggcccatttcctagcaggattatctgtgtttgtctgggggtgaggggagtaaatagaagtttgagtgctacatacaaatgtgtattttttgcattgtaatcttaacaaacagaaagaagtattttgctccagtttgtatattctttcaaagcctttgaaccacactttatttttttagacaggatctcactctggcgcccaggctggggtgcggtgttgtgatcatggctcactacagcctcaacctcccccagctcaggtgatcctcctgcctcagactcccaagtatctgggactacaggcacataccactatgcctggctgatttttgtatttttgtagagacagggtctcactgtgttgcccaggctggtctcaaactcctaggctcaagtgatcctcccatctctgcctcccaaagccctaggattacaggtgtgagccactgtgcccagctgaagcacactttttagtgtgtctgccacaagggtttccaaggccactagctggcagaaggataaggtggaaatgtaaatgacatgcccctctcttcatgaaaacaatgtcagttgttcctctcagtccccaccataacagtttctgaaattctttctcacctccttcacttatttatcctttctgctccctgctagactgctaggggtggggacaggagtgatgtctgatcaccactgcctctgtgaccataacctctgatactgtcatttcttctttccaaagtcttggctatcatttgaggagctgagacaataggatagttctgctttcacagagcatattagcaaataccctgtgtgaggccctaatgacatatttggccctttccatctttggggctgtaatattccctacagatggaccctttggttaagtctccttatgttgcttttagttttcatcaatctctggttggtttttagaactactaaatggagccattaggtcattcaaaaacaggcagatgtatgtatgtttgtgagccatgatagggatccagaaatatttacataattttcatctattaagagatttaacagctgtgtctgccatgtagttactttaaaatataaaatgcaaggtcagatctcttggggatactgttttgtttttcttttcttatgattgctgttaacgatgtcatgtttaagtaaggaaagaaggttttgatattcctctaagagttaccagcctgtggaggagttgtgctccaagaggatcgaaggcttagaattcaaatgtaaaagtgtttaccttcttaggccagtcatctgatcaacacgtaatgtagctgaattagtacacatttccaaagaatttacgaaacaagacaccttgcaaaactagcagtcaaataaaacagaactctaaaattgaatttaaagtacagttttgtctggctagccatatgtagaaagctgaaactggatcccctccttacaccttatacaaaaattaattcaagatggattaaagacttaaatgttagacctaaaaccataaaaaccctagaagaaaacctaggcaatatctcattcaggacataggcatgggcaaggacttcatgtctaaaacaccaaaagcaatggcaacaaaagccaaaattgacaaatgggatctaattaaactaaagagcttctgcacagcaaaagaaactactatcagagtgaacaggcagcttacagaatgggagaaaatttttgcagcctactcatctgacgaagggctaatatccagaatctacaaagaactcaaacaaatttacaagaaaataacaaacaacccaatcaacaagtgggcgaaggatatgaacagacacttctcaaaagaagacatttatgctgccaaaagacacatgaaaaaatgctcatcatcactggccatcagagaaatgcaaatcaaaaccacaatgagataccatctcacaccagttagaatggcagtcattaaaaagtcagggaacaacaggtgctggagaggatgtgaagaaataggaacacttttacactgttggtgggactgtaaattagttcaaccattgtggaagacagtgtggcgattcctcagggatctagaactagaaataccatttgacccagccatcccattactgggtatatacacaaaggtttataaatcatgctgctataaagacacatgcacacgtatgtttattgtgacactattcacaataggaaagacttggaaccaacccaaatgtccaacaatgatagactggattaagaaaatgtggcacatatgcacaatggaatactatgcagccataaaaaaggatgggttcatgtcctttgtagggacatggatgaagctggaagccatcattctcagcaaactatcgcaaggacaaaaaaccaaacaccacatgttctcactcataggtgggaattgaacaatgagaacacagggacacaggaaggggaacatcacacaccggggcctgttgtgggggtgggggtaggggggagggatagcattaggagatatacctaatgtaaatgatgagttactgggtgcagcacaccaacatggcacatgtatacatatgtaacaaacctgcacgttgtgcacatgtaccctaaaacttaaagtataataaaaataaataaataaataaataaaatacagttttgttttgtatcatgaatattgttgctacttgggaaaaacatgtttaatcaggcactaaaggggcagctgaagtgtttgatggtgattctcaaagggattcttggacccctcaagagttttagaagatagtgatgctagtattttattatgtataattatactgtaaaatacatttttgatacattataattacttctgtttatgacttaggtagtttttgccttgcaaaagggagatagggaaagaaagtttacttaaataattggaagcaaagggggaatgaggagaaagctaatgaagatgtgaatatttgtgaggaaaattgcctgtaagtgtgaatagggtgtgaatggagagtggatgtgtctggcagcacctcttcttattcttatcatcttactggggtgattgaagttgcaaacacatggcccttcacttcttttgtaaacggacataattgatccaacacagcatgattgctttctagtgcagcaattttcagaatactgccttctcaaagatatggttctcctgattgattatgaaatgagataaaaatataagtccttggtttaataagtgatgaacaagcccataaaatactaggtttttacttttgctagagtaatctactaagtgagttattaagggcctttctgaactcaagttagtgtgtcaccatagactctaattagtctgaggactctaattagttctgctaaaaagtctcactgctattcggtgacaaagctcctataatgtggcatgcatgtaggcagttgtagtttccaaaaaagaaagaagtaggtggagcataggatgctcaaagtagacaatgatcaaagacttttgagagtcatcagtctaggaaagttattctcaaccctggctgggtatcagaattgtctgtagtgcttctaagaattatgagttatggccagacgcggtggctcatgactgtaatcccagcactttgggaggccaaggcgggtggattacaaggagtttgagagcagcctccccaatatggtgaaaccccttccctactcaaaatacaaaaattagccaggcatggtggggtatgcctgtagtcccagctactcaggaggctgaggcagaaaaatcgcttgaacctgggaggcagaggttgcagtgagccgggatcgcaccactgcactccagcctgggcgacagagtgagactccgtctaaaaaaagaaaaaaaattatgagttgctggactgcatgatgatctactgaatgagaatccattctccccccagtaaacttttcctttatctcctttatctcattggcaggcactcattcacaggtccactcaagacagtcacggacaaaaggaaacaggattgtgaggatttagccccatggggctagagcactgctactgaaaaaaaaccaccctaactatatttgcagctttacggtgtgtaaaacttcagtttaaaaacaaaagggaaaaaaggtctctgccttcaaagattataagctattcattcaaaaagaccaaacattgtaagaaataactggataattaatccataaagggcaagagaagtagagccagcttttattgagtacctgcctacctgtgtgctgtgtgctgtgtgctgggtgagtactttatatatgtcacttcctttaatcctcattttaatcttcagaggtcagtagtgtcactggcattctacagattaaaatactgtagttgagggaatttaggggatttgaattgcatttcctctctagaatggggtgagacagaagtggtgtccttctttcaggcatctaggtttgtttctttggggtgtgtatgtgtgtatgtttccatgtgtgtggcagcttaccaggctatgtcccaattaataaggagatgtatcatcctcattccagtttttcaaatgtgacttgaccaaaatgcattctattcctattctttgagtttatatgccagaaatggagtgggcatgtgtgtcttctcaggactaatccatgcatgaagctctttgaatcagcacaatattgtacagcctagttgcgttctgttcatcaagcatcggtcgatgatttattgacaatgcaaacaagtggtctgttcatgtgagttcatgatgatttgtgagtgcttcctgcccatctgctctctcattttaagtgtgctctgtaatataaaaatgatagtcatacaataattctattggggtagatctgtaccactacccagagatatttgtttgacttttactattattttacaaaatgggaatttctttcacaaagaagatgagttcattgtactttggctttttgtaagagaaagtgaatgttgtgacactgacatgaataaatgaattcatgttttctgatcccgtggaaaggaaagaatagaataatatcagcacgtggatctcataatgaaaggggagtaaagtgagtcttcagaaacagacttaaaataagctcaattcattgtaattagaaaatggatcttgaaagggccttgccaaaaggcgatgatgtgatgttggggtgtagaagttttttgacagtggactcttttatcacagaatgtgaggtgaggcagaggaaatatgattcatgttatagtgctttagttattgattacataggagtttgctttctccagctcttgttcatagctgctaactggcatacagaggaaatattgtttacttatttaaataatttttaagatagtgaaaattctgtatgtttggttaaattatacttggttgtttgcataggctgtctctccctgagacgctcacctcacttctctatgggtcagcgaaacacataccctgtgtaatcacctcccctataaaaccccatggcaacctcttccaacaattcatcctttgcattccatccaagtatgtcttgttatatccatagcatttagtgcatttattatttcctctcctgctttcctctactagattttgagagccttaaggactagagagtgactgattcatccttgtttccccagcaccctggagcaaagagcccagcacatagtagttgcttgtggtgaatgtaattcagggtgtcttaggactatcctgctcattatgaatagaggataaaaacagatttctaagttctccatctgccataaaattctgggaagaaaaaatatgaagtattcctttctgcacacacagaagtcttccattttgcaattttctatctagtctgctgtcctttctctctcttctttatcagggctacacatcctctctcctggccagagcgtcatttgaggcgtgcttatgcagttctcattgtcttcaattaaggtttgggactgagattaccagcttggcttggtaaccctgttcacttattaaaaaatcagtcgatccttcatttttatgaaaagatgcaatgcaaaataaccttgatttagaatttaatgaggctgacatttaacctgagttcagttaggaagacaaacaaaaaacacagacaaagttgagagaaggaaaataattacctacttgaatagtgtgggcaattctccatccatatgccccaggagaatatgaggtgggagatgcatgaattacctgaaatttcttttagcctctgtttatgattttagtctttcaagatgcaggtatgtttttcaggccttgtggtccccaaacacaaggaaactttctttatctgatggtcaaaagaagtgacgacctagtccttagtaggagaaaaatgtgcctgcatggactctttgtgagacagtgttgttggatactttatgaacattttaagggattctcatgagtaattttgattatagacgatttttactttatgcattgactaggaaccaaatgcaactttcttagagagacacaaaattcattgtccaaatagaccatagggtcagcaggctttgtaaacatgttttgtatgtgcctaggggttgagagcaggggcgggagaggttctggtccgttcatcaaaccaggggctggtgttaatgtttgatcaacaaaacacatgtaggcctaggctctgatctaggtccaactgccaacatagccttttcatgcctgcctttcctacttcaggtagagagaggagaaaaaacctattgaggaaaaaagaaagaataatattagcccaagcagtggttctactcacttaaggagaatggagtatgtttatttaattttaactgaaaagtcctggccaatatttctaagcctggcttgggataacagaatgaatggccttgggggagagggaggagaaagaagatgactgattttagtgtctgctttatggtgtgtgctgtttaatcctcatgacaatcctaagtggaaggaagaactccccatgttaccagtgacgcagcggaagcccaggtgctactgaaggtcacgcagtcagcattgacgaagtctacactagaatccaggcctgacacaacccaaagtctgtattttttccctctgcagtctcttaaaattggcaaaaggtaaaccttcatgcgaccctagatttgattggaacagcagatttaggggtcatgcaacaggagaatgagtggattataagtttttgagtccccagatctttggggagaaaacccaattctgttgaagtaggagctgttcaattggaggtgagatttttagtagggatttctaatgcattcttttttcccattgatggttgttaatacttcccctacacacacacacacacacacacacacacacacacacacacaagcataaatagggcacacgtattctcccatgtaagggctgctgtcccttctccctcccacttatagcgatgtgtgcctctctgtagctgaaggttgccttgtattaggacactgactgatgagtactccccaccagggtccggagagtgtgcttcattcacctttcagcctctcacagttctggcacaggggagataaagatgttgatggtttgaggtgctttttggtaaataacataggcaaacacttgacacccctaggctaccacctgtcctgttgtgtggatacctattcagtgaagccagataacttttacaaatcacaatgaatacatcctcagcagagccagttgcctgagggaggttactgaatcttctgggagtcgtttgcaggcctttagacactgggctcctttctggaccatgcccaaactagtgacagatgcagtcagagtagcagaataaggaagtctaaagtcacccaagcctcttagttcttgataattgacatgtccagcatttcttgaccatcagtagaaaatactaaactttacagtacataaaataatcaattcattcctctgatggggcaactatttaagtcagtatggaactctatctttctgattgctgcattagtccctttttttttgtttattttgcttcttagtagaaaagaaaaatctaaaagattctcattttaagtgacttgagctatcagttaaattttaaaagccaattattttgaagcagtagagccttacgaattctaaagtcacacactggaagccaaactatctagagtataaatatttccttttgagggggatactgacagattcttctattttatcccaattccagttcctgacctccactcacagacagggaggcaaggggaaggctcactaattggcaaggctggacaagcataaaggattcagtgcataaagaatcaagcttctgatcctctcaagaggtcacacgcagagtgtctatgtgctggacagctttggctgtacacaccagaagtgttccaggcgtaaggtttttggcaagtctcgttgcctacgttcaagtcctctctgagtcgcttactagtgtgtaaacatagctgagatatataatgtttctaagcctcagtttcactgtctgtaaaatggcaatgacaataactgtacccacctcacaaggatgctgtgttgtgaggtgtgaacgagccatttgtgtcagaacatagcacagtgctgggctcacactaagcattccattcatgtcagctactagctctttggaacttttcaactttggtccctagggctacattaaccctctttcctgccagacaataatctgaggttggttgctgctttcagaagaaacagtgtttgaaagctaagaaaaatgtacctagaaatctaatttctaatttcattgtcatgccttaacagaacacccagatgccttaaaagacttttacaaaatgcaaatttctgatccagaaaacttctcagccatagtgccaaagaacattatcagacccaattccctatatcccaacaaaaccactccccagtcacagattatccgacacaatttcattggggttctcaaatggcaagagtttgtttaaaatgcaaatctctgagccccaccctcagagaggccagcggggcagtggaatatgcactgaacacttcgggcactaactcgtgtgccaatggttgcacttggacatatactactctaggcctttgggctcctttcgtccctgcagcaccttctgtcctcaagacaggggctctcttgttttcctcatgcgagagctgttgcccagctagtccatcccactgaggacaaactctgactcaccttttaagatgtagttctctggctaggcacagtggctcacacctgtaatcccagcactttgggaggccgaggcaggtggatcacgaggtcaggagtttgagaccagcctgaccaacatggtgaaaccctgtctctactaaaaatacaaaaattatctgggtgtggtggcacacacctgtaatctcagctactcaggaggctgaggcaggagaattgcttgaacctgggaggcggaagttgcagtaagccgggatcacgccactgcactccagcctgggcgacagagtgagcctctttctcaaaaacaaaaaagaaaaaataaaacatgaagttcccaaccatgtgctgtgtagtgagcaccatggtggccctgcagtgtacaaaggtgaattggccatggtgtgtgttggcatggagctcccagtccagctaagaatacccttcagggccaagctgactccaccctgtttcctgaggcccagtcagcggtcccagcttctggtctgtgggctcacctagtttaaagacccccttgagcctcaaaggatgttcgaagcatgattcagttggggagttattggtcaacatggtgggacaattcttcactgtgtgggactgccctaaacagtacagggtacttagcatgtctgccctcccaatgctgagtaccagtggtgctccacagtcactgtgacaatcaagaaaagtaatgattgccacatgtttctgaatacccctgacctctggggaataatactgccccaagttgagagcctctgtccggtttaggtctttctcctcagtccatacctctgctacctccttaagggaccagttccctccaaggggcatgctttcttagaaaagtcatttgatggccgggcacagtggctcacgcctataaacccaggacttcgggaggccaaggcgggcagatcacctgaggtcagaagttcgagaccagtctgaccaacatggtgaaaccccgtctctactaaaaaaataaaaattagcaggacatagtggcatgcacctgtaatctcagctacttggcaggctgaaacacaggaatcgcttgaacctgggaggtggatgttgcagtgagccaagatcacaccactgcattccagcctgggtgacagagcgagactccatttcaaacaaaacaaaacaaaacagaaaagaatgtcatttgacagtgtacaaagtttatatattttaacatacaaatgaagttgacatggtatcaaccaaagggaaagaagggccattttgtaacaggcagaaaccagttgggatttaagaagcattttaattacccttactttttttctataaaggaaaatacttttatttctttcactgatgtgccggtgagagtcttagcaggcttgcctttgtaggtaaatatgatggcacttcccaatcatcatgtattgggatgtgaagttgtgtggagtctgaggctgacccctggtagtgtgaggaccttgggggattgccttggaaaatacagggtccagcccaaggctctggctttcagggtcgggggttgagatgaatttgtcacagctccgcctgagctcaccacactgggaagtcaaacagaggcaacagcttctgtttgctaagtgttaccacatgctaggcactgtgttgagtatggtgaaggacctcttaaatcttcagaacaaccgacgtttcagcattttacagctgcaaaaactgagtcttagcaaacatggtcttagagccacgagaatggacctgggacttaaatcccaagtctagagcctggacttgaccacagcagcatccagcttctcacccatctttcgctcaattcatccctttaatcatttattttaggattcagtttgattcccccaatctcaaaactttcaaggatgaacaatacttctcacacaaacacaccttctaccgaatgccaggaggggtctgcacttagattcctcagctgtcacagtgccattgagtctgaggctgcctgactgcttggttgtggttttttgacacctggcatttgtgtttaacagccccagtggttgagaagcagaggggacccacactggcagaggtggagggaaagaggagagggtgtagggaaagaggagagggtgtagggaaagaggggagggtgtagggaaagaggagagggtttagggaaagaggagagggtgtaagggaagaggagagggtggagaggtagaggggagggtgggggaaagaggggagggtggagagatggagaggagggtggagggatagaggaaagggtggagggatagaggggaaggtggagggaaagaagagagggtgggggcggttccaagatggccgaataggaacagctccagtctacagctcccagcgtgagcaacacagaagatgggtgatttctgcatttccaactgaggtactgggttcatctcattggggcttgtcggacagtgggtgcaggacagggggtgcagcacattgagcattagccaaagcagggcgaggcatcgcctcacccaggaagcgcaaggggtcagggaattccctttcctagccaagggaatctgtgacagacagcacctggaaaatcgggtcactcccaccctaatactacgcttttccaatggtcttagcaaaaggcacaccaggagattatatcctgcgcctggctcagagggtaccacgcccatggagccttgctcattgctagcacagcagtctgagatcaaactgcaaggcagcagcaaggcttggtgaggggtgcctgccattgctgaggcttgagtaggtaaacaaagtggccgggaagctcgaactgggtggagcccaccgcagctcaaggaggcctgcctgcctcagtagactccatctctgggggcagggcatagctgaacaaaaggcagcagaaacctctgcagacttaaatgtccctgtctgacagctttgaagagagtagtggttctcccagcatggagtttgagatctgagaacggtcagtctgcctcctcaagtgggtccctgatccccgagtagcctaactgggaggcatcccccagtaggggcagactgacacctcacatggccggatacccctctgagatgaagcttccagaggaatgatcaggcagcaacatttgctgttcagcagtattcactgttctgcagcctcggctgctgatacccaggcaaacagggtctggaatggacctccagcaaactccaacagacctgcagctgagggtcctgactgttaaaaggaaaactaacaaacagaaaggacatcgacaccaaaaccacatctgtacgtcaccatcatcaaagaccagaggtagataaaaccacaaagatggggaaaaaacagagcagaaaacctgaaaattctaaaaatcagagtgcccctcctccaccaaaggaatgcagctccttgccagcaatggaacaaagctggacagagaatgactttgatgagttgagagaagaaggcttcagatgatcaaacttctccgagctaaaggaggaagttcaaacccatcgcaaagaagctaaaacccttgaaaaaagattagacaaatggctaactagaataaccagtgtagagaagtccttaaatgacctgatggagctgaaaaccatggcatgagaactacgtggcgaatgcccaagcctcagtagctgattcgatcaactggaagaaagggtatcagtgatggaagatcgaatgaatgaaatgaagtgagaagagaagtttagagaaaaaagagtaaaaagaaatgaacaaagcctccaaggaatgtgcgactatgtgaaaaaaacaaatctacatctgattggtgtacctgaaagtgacggggagaatggaaccaaattggaaaacactctgcaggatattatccaggagaacttccccaacatagcaatgcaggccaacattcaaattcaggaaatacagagaacgccacaaagatactcctcgagaagagcaactccaagacacataattgtcagattcaccaaagttgaaatgaaggaaaaaatgttaagggcagccagagaaaaggtcaggttacccacaaagggaagcccatcagactaacagtggatctctctgcagaaactctacaagccagaagagagtgggggccaatattcaacattcttaaagaaaagaattttcaatgcagaatttcatatccagccaaactaagcttcattagtgaaggagaaataaaatcctttacagagaagcaaatgatgagagattttgtcaccaccaggcctgccctaaaagagctcctgaaggaagcactaaacatggaaaggaagaaccagtaccagccactgcaaaaacatgccaaattgtaaagaccatcgaggctagaaagaaactgcatcaactaacgagcaaaataaccagctaacatcataatgacaggatcaaattcacacatcataatattaaccttaaatgtaaatgggctaaatgctccaagtaaaagacacagactggcaaattagataaagagtcaagacctatcagtgtgctgtattcaggagacccatctcatatgcagagacacacataggctcaaaataaagggatgggggaagatctaccaaggaaatggaaaacaaaaaaaggcaggggttgcaatcctagcctctgataaaacagactttaaaccaacaaaaatcaaaagagacaaagaaggccattacataatggtaaagggatcaattcaacaagaagagctaactatcctaaatatatatgcacccaatacaggagcacccagattcataaaacaagtccttagagacctacgaagagacttagactcccacacaataataatgggagactttaacaccccactatcaacattagacagataacgagacagaaagttagcaaggatatccaggacttgaactcagctctgcaccaagcggacctaatagacatctacagaactctccaccccaaatcaacagaatataattattctcagcaccacatcacacttatttcaaacttgaccacttggttggaagtaaagcactcctcagcaaatgtaaaagaatagaaattataacaaactgtctctcagaccacagtgcaatcaaactagaactcaagattaagaaactcactcaaaactgcacaactacatggaaactgaacaacctgctcctgaatgactactgggtacataatgaaatgaaggcagaagtaaagatgttctttgaaaccaatgagaacaaagacacaacataccagaatctccgggacatatttaaagcagtgtgtagagggaaatttatagcactaaatgcccacaagagaaagcaggaaagatctcaaattgacaccctaacatcacaattaaaagaactagagaagcaagagcaaacacattcaaaagctagcagaaggcaagaaataactaagatcagagcagaactgaaggaaatggagacataaaaaacccttcaaaaaatcaatgaatccaggagctggttttttgaaaagatcaacaaaattgatagaccactagcaagactaataaagaagaaaagagagaagaatcaaatagacgcaacaaaattgataaaggggatgtcaccaccaatcccacagaaatacaaactaccatcagagaatactataaacacctctacacaaataaactagaaaatctagaagaaatggataaattcctaggcacatacacccttgcaagacacatacacccttccaggaagaagttgaatccctgaatagaccaataacaggctctgaaattaaggcaataattaatagcctaccaaccaaaaaaagtccaggaccagacggattcacagccaaattctaccagtggtacaaggaggagctggtaccattccttctgaaacgattccaatgaataggaaaagagggaatccttcctaactcattttatgaggccagcatcatcctgataccaaagcttggcagagacacaacaaaaaaagagaattttagaccaatatccctgatgaacatcgatgcaaaaatcctcaataaaataccggcaaactgaatccagcagcatatcaaaaagcttatccaccatgatcaagtgggcttcatccctgggattcaaggctggttcaacatatgtaaatcaataaacgtaatccagcatataaacagaaccaaagacaaaaaccacatgattatctcaatagatgcagaaaaggcctttgacaaaattcaacagcccttcatgcgaaaaacactaaataaattagatattgatgggacgtatctcaaaataataagggctatttatgacaaacccacagccaatatcatactgaatgggcaaaaactggaagcattccctttgaaaactggcacaagacagggatgccctctctcaccactcctattcaacatagtgttggaagttctggccagggcagtcaggcaggagaaagaaataaagggtattcaattaggaaaagaggaagtcaaattgtccctgtttgcagatgacatgattgtacatttagaaaaccccaaatctccttaagctgataagcaacttcagcaaagtctcaggatacaaaatcagtgtgcaaaattcacaagcattcttatacaccaataacagagagccaaatcatgagtgaactcccattcacaattgcttcaaagagaataaaatacctaagaatccaacttacaagggatgtgaaggacctcttcaaggagagctacaaaccactgctcaacgaaatagaagaggacacaaacaaatggaagaatattccatgctcatggataggaaaaatcaatatcgtgaaaatggtcatactacccaaagtaatttatagattcaatgccatccccatcaagctaccaatgactttcttcatagaattggaaaaaactattttaaagttcatatggaaccaaaaaagagcccgcattgccaagtcaatcttaagccaaaagaacaaaggtggaggcatcacgctacctgacttcaaactatactacaaggctatagtaaccaaaacagcaatggtactggtaccaaaacagagatatagaccaatggaacagaacagagccctcagaaataataccacacatatgcaaccatctgatctttgacaaacctgacaaaaacaagaaatggggaaaggattccctatttaataaatgatgctgggaaaactggctagccatatgtagaaagctgaaactggatcccttccttacaccttatacaaaaattaattcaagatggattaaagacgtaaatggtagacctaaaaccataaaaaaccctagaagaaaacctaggcagtaccattcagcacataggcatgggcaaggacttcatgtctaaaacaccaaaagcaatggcaacagaagccaaaattgacaaatgggatctaattaaactcaagagcttctgcacagcaaaagaaactaccatcagagtgaacaggcaacctacagaatgggagaacatttttgcaatctgctcatctgacaaagggctaatatccagaatctacaaagaactcaaataaatttacaagaaaaaaacaaacaacccaatcaacacgtgggcaaaggatatgaacagacacttctcaaaagaagacatttatgcagccaaaagacacatgaaaaaatgctcatcatcactggccatcagagaaatgcagatcaaaaccacaatgagataccatctcataccagttagaatggcgatcattaaaaagtcaggagacaacaggtgctggagaggatgtggagaaataggaacacttttacactgttggtgggatgtaaactagttcaaccattgtggaagacagtgtggcgatagctcagggatctagaactagaaataccatttgacccagccatcccattactgggtatatacccaaaggattataaattatgctgctacaaagacacatgcacaggtatgtttgttgtgacactattcacaatagcaaagacttggaaccaacccaaagtccatcaatgatagactggattaagaaaatgtggcagatatacaccatggaatactatgctgccataaaaaaggatgagttcatgtcctttttagggacatggatgaagctggaaaccatcattctcagcaaactatcgcagggacaaaaaaccaaacaccgcatgttctcactcataggtgggaattgaacaatgagaacacttggacacaggaaggggaacatcatacactggggcctgttgtggggtgggggtaggggggagggatagcattaggagatatacctaatgtaaatgatgagttaatgggtgcagcacaccaacatggcacatgtatacctatgtagcaaacctgcacgttgtgcacatgtaccctagaacttaaagtataataaaaaaaaaaaagaaaaagggtggagagatggaggggagggtggggggatggagaggagggtggagggaaagaagagagggtagggggaaagagggtagggtgggggggtggagggaaagaggagagggttgggggagagaggggagggtggggggatggaagggagggtggagggaagaggagaggatggaggggtagaggggagggtgaagggaaagaggggagggtgggggatggaggagagggtggagagaaaggagagggtgggggggtggaagggagggtggagggaaaggggagggtggaaagatagaggttagggtggagggaaagaggggagggtggggggatggaggggagggtagagagatagaggagaagttggaaggatagaggggagggtggaagggtagaggggagggtggaaggaaagaggggagggtgagggggatggaggggaagttggagggatagaggggaggtgggaaaaaaagaggcctggagctggtgttaggaggccagggtctaaaccccacttgaaaacctacctggtggatgacatgcacagactctctgggcctcagtttcccattcacatataagatggggaggcctttatccacttccctaagagggttgttgtgacaattcagagcagtgttagagtccaaagtcgggtgaatgcccctggggagtgtacaggaccatcctttatagtgtgagtagaaagtcttagcatttttattttttactcaacaagaaattaggctttacaaatatttgatgtatggatggaccatgacatccacaatcagctgcgtgttctgggcatgtcctcaaagaaagaagggactttgcaaacgggaaggggttgggagctctatcctcattcattcccttgcagcctttgtgatgtttgattgcaatttgccacttctggtgaggcgggtacgcagaatacattatccagcttaaactcaacaaaccctgtttcaacaaactgaagaagtggcttaaaaagttttcatgaattaaaagctaattaaaatctataatgaacaatatccacataaaccaaaaaatggcagagttaacacttcactgggaagaagtttttgttgtcgtcgttgttgaatcagccccagtaagatgtgaaaaaaaaaacagactaatgatatctgacaagaagtcggcccaagaagttcaaaattatcaaggtcaggtgcagtggctcatgcttgtaatcccagctctttgggaggccaaggtgggaggatcacttgaggccaggaatttgcaaccagcctgggcaatatagtgagattccatctctactaaaaatcaaacagttcggtggctcacgcctgtaatcccagcactttgggaggccaatgagggcggatcacctgaggtcgggagttcgagaccagaccgaccaacgtggagaaaccccatctctactaaaaatacaaaatttgccgggcgtggtggcgcatgcttgtaatcccagctactcaggaggctgaggcaggagactcgcttgaacccgggaggtggaggttgcggtgagccgagatcgcgccattgcactccagcctgggcaacaggaatgaaactcggtctcaaaaaaaaaaaaaaaaaaaatcgaacaattagctggatgcttgtagtctcagctactcaggaggctaaagaggatcacctgagcccaggactttggtgctgcagtgagctatgatggcactaccgcactctaacctgggccacagagtgagcccctgtctcaaaaaaaaaaaaaaaaaaaaaaagaagaagactttttgaattaaagaaagatttacatctcctctcattaatagcactattgatttttatttgatttaacacattatttcattgttattacaaattatgtgttttaaatgcctattttgatgtataattctataatgtacacttagttcagtagtacatgtgtattacttgtatttatcatgtgtgaatatatatatatacacacatggtatgtgctcaaaatattttacagattagagtatgtgaaaaaaatttgaagaccactctgcataataaatgtgcaggggctggcccatgagacatgttcagtaaatgcttgtttccatcctctttctccctggaaataaagtcgatagtgtgtgtgtggaccttgcttattaaaggaaagtggctgatttgatttctggaacaaggtgcatctcaaactagctggcagcactacctcggcctggccccatcccagctgttcacaccgagttccagacatttgtaggagcccggacgaggccagctggctgcctatcagtggccttcttctgtcagcactacacagttgtcacggctcacatccaaccgccagacagccaagaaggagacgccaagatttaaatctgcagttcctgacctccgcaaccacacccgattctttggttggtcctagacaaaaacaacggttttgcagatttgggttctctttctcaaactgccttttgatgatttatttgtgagatatgattgctcctcttgcaaatcagagctggttgcagtagctaactaacatttattgagcgagtagtatacccaggcttcagctaagtgctttctggaattatttaattttcacagcaaccatgtagagtaagttctgccactggcaccactttacagataagcgaatggagacttagaaaggttaagtaattttactagaggaacataaactaacagtgaaagtgagaaatctcagagtctcattggtctgacagctatgtaaggaactgaggggatgtaccattgcaaatcgtcaaaatggaaataccccaaatgcaatgcaggactctggatgcgattctggaacaaagaaagaacacttgtgggggaaaaaaaatagtgcaacccagagtctttatttaacagtattgtatcaatgttaatttcttagttttgacaaatgcatcctggttatgtaagatgttaggattatgggaagctgggtaatgaatagatggagagtttctgcactatgtctgtactgtttttgtaaatgtacaatgattccaaaataaaaggtgtatttaagaaacagaaatgccaagtgtatatgtgtgagtacacacgtgctctcacatgtgcatgtgtacagttgtgcatatgtaagtctttgtgcatatgtaagtgccccttgctgcacaccccctgctgttctgtgtgtgctgctccactcaagcccctgggacttacatggatgtcagcgagaaggaagcctacacaactcacatgtgacatgcccgccatgctctcgtcatacctcacctgtgctgtagaacccctgggtcacaggtggcagtcttgttcccccataacaaatgccagaaaatgatgtgtgtgtgtgtgtgtgtgtgtgtgtgcatgtgcacacacgcatgcacgcacacacgctctggtaggggggtttcaggaagtcattcgtgaagatgcagtgtagcatccagaataaaataaccaatttacaccttaaacactcttctccagtaaggccactacagctgcctctgcttactaagtgcatttgaagagtcctctgctttatccgtactctatcctcctgaaaagaggcactgacctgaaagggaagcccaggagcttctaggcccagacttttgctttgtttctcaccatgtgctgtgtcaaaactgagagaatattttgatcaccttttagctaagagctatctcctgggcagcagcttaaggctagagtaaggacatttcacagtttaagagagagcagtcactccgccaaatggctctgaggtggccacaaagtgcttgacttgcaaaaaattgctccattaactagattcagggattttcaggatttatgggctaggctgtgctaatattactgtggtgcttctcagtataattgctagaggcctccagtgagcagaggaattgtgtgttcagtctgtcctgggtgacccttactgcgtagtcctagggagacaaagaaaacccactcaatccaggaggctacagaaatgatgtttgtggagatctcagtgggtatctaatctgtaacctcagggggagaactctagctggtctcagtctttgctggaaacagaacttactggatgtgtgtgtttactcactcattcatttatttgtttatttatttactgtgacagggtcttgctatgttatccaggctattcttgaactcctgagctcaagtgatcctcccacctcatcttccaaagtagctgagattacaggtgcatgctaccacacccagccatcattcatttacttattgagtgtctaccatgcaccagatgcccaggttaagcataaaggatatagagcaggacaatcaaaaagtctcagattcagaaggaggagatggataaaaaccagcaagatctaaagtagataatttgattatgataagcacaaataagcagagaatacattgatgtgatacagagggccatgtggggggcagtgtgattcctttagattgggtgaatcagggtgatggcttttcagttgacattggaagaatgaggaggaaggaggaagaagtggcagccgggtaggacagcaggtcttctctgtcccccgagttcttctgatgtcctgcacagaaacctgaggggtagagtagcaaaggagaaatccaagctcaggctgggaaagaagctcatggcaccaaggttagggcttgtgataacagggacctgcttcaagagaaagggaggtgggtggcagattggtctcatggctgccacccacataattctaaaggtctcccaatgggagaacagccaccctggtaagtgtccagcatcatacaaggagtctctgcccattgtgactcttgcttgagcccccacacttagccctcaccaagctgtgtgatttaggattcaggtgttagaacggagaaggcaccaggcctactgcaccatatcaatgaagcctttgctttggggaaaacagagctgggtacaaataccagtgccacccattcttccctccatgctctggacattcaacccatctgagccttaatcccttcatctgcaaagtaaggaccatgcagtcttcctggtagtgttgtaaggctcagatagaataaccagacagttccaggtgcatatggcactcagtgagaatccacttgctttatcctccctcactcccttccttcctccaggaataaagagtacactagttgaagaatatttctttgccttccttctttagcagctccaatcccagcctaacagcacaatgagcatcagatgtgcttttttgatgtttgaaatttatagtctctgttgaatgttggccaggacagcacttcgtcatttgaacaatttccattttccacaagctctctgtgattgatgacctaaccaggcacatggcattccgttccaccagcaatgtggccagtggggagatggctatgtcagtaacacctgtttgtggtagaccaacaatggcgccctaaaagatatatccgcatcaaatccctgggacctatgtgtgtgaccttatttggaagaggggtttttttttgcagatgcaattaggaatcttgagatgcagagaacatcctgtgctatccaggtgggccttaaatgcaatgacaactgtcttcataagagacgtatagggagatctgacagatagaaggggagaaggcaatgcgatcaccactaggtagaggttagagggatgcacccctaagtcagggaatgccagcagctgccagaagcttaaagaggcaaaggatgaattgtcccctagagcctccaaagggagtgtggcactgcttatgccttggctttggacttctggcctccagaactgtgagagaataaatatctgttgttttcgatgggcgtgatggctcacgcctgtaatcccagcaccttgggaggccaaggtgggcagatcacaatgtcaggagatcgagaccatcctggcgaacacagtgaaaccccgtctctactaaaaatacaaaaaagtagctggccgtggtggcgggcgcctgtagtcccagccactcgggaggctgaggcaggagaatggcgtgaacccaggaggcagagcttgcagtgagccgagatcgcaccactgccctccagcctgggcaagagtgcaagactccatctcaaaaaaaaaaaaaaatctattgttttaagccaaccagttcgtggttatttgtgtagcagccctagaaatgaagacagcctgcgagcaccttgccccacctggctgtaggtgacttttggtgccaccatttttgactcttgtggataaagagcagactatattctttttataagtaagtccaccttttacagaaaaattaatagccaggatcatggttttagaactcatagaatacactcctctcatcctctcattctttcccccacccattggcttataaacttgttcctatgaaataagtcagctgagttgagtttgtaaatgcatcttgaataaatgtgttgggtggggtcacaaacatgcagacacctgctggtgagtgttactgacctgcactctgaaaggcccctatattgatgatacttcttaatctcctatggctcttcttcagccctgggagcaggggagtgcagacttttgttcaacccctttcacagatgtgcacactgaagtcccagtgtgtccagtgacttgctcaaggtcatcagcactgtctggtggagctgggactcgaacccagtcctcctgctctcagctgtgggaaatggagacagcagttgccctggaagatgtttcctgtgctgcgtgtttgtggttgtctcaggatttgtgagacttactgttttcttgtgtcccctgtccctgtgacttatctttgtgcccactcagccatcaccacttccaacacacacccacacctgtggagagaatgcagcctcctagagctcatgtcatggcaggactgagggaagtagtcagttcttggtgctctctaatagggctctgaattgcagcctgggccgtgcccattcatttatgtattgtctatagctgcttctgtgttacaagaattgacagagactgggtgtggtcgctcacacctgtaatcccagcactttgggaggctaagacagaaggatcgcttgagcccaggagtttgagatgaacctgggcaacatgatgataccccatctctacaaaaaaaaaaaaaaaattagttgggtgttgtgatggaggctgagatgggatgactgcctgagcccatggggtcgaggctgcaatgagctatgattgtgccactgtctcaaaaaaaaaaaaaaatgttgacagaacaagttgattcaattatagacttgagtagttgtaacggagactataaagcctaaaatatttatagtgttaactttgataggacaagtttgccagctcctgcactagaggataaagattaacaggattgactccacatagaggagaggagaggaaggggcaaggatggaagcaaggagggagaagggttagagagaaagaaagagggaggggggtcactcagagacttcacaaagtatgttatttcctaaaaactgtaatgcccagtatctagtgattacctgtggcactgtcagccttctgcctgggaacaggaatcttgcaaagatcaaatgcagggcccagagccccaggactctgcattggcattcgtcagtaagttttgaaggaggcagacatctcaaaaccatcctaagcataaggcacccagctggtgatttgaagatagccatcttccccattactagttggcctcactttaaaaaatgttgtttcttggatagcatttttctttcacaagttggtttgctttcacatgtcaaaaaacaaaaccagggctgggcgcggtagctcacacctgtaatcccagcactttgggaggcgaaggtgggtggatcatctggggtcaggggtttgacaccagcctggccaacatggtgaaactccgtctctactaaaaaaaagaaaatacaaaaattagccaggcatggtggcgtgcacctgtaatcccagctactcaggaggctgaggcaggagaatcacttgaacccgggaggcgaaggttgcagtgaaccaagattgtgccattgcactccagcctgggcaacaagtgtgaaactctgtctcaaaaaacaaaaaacaaaaagcaaaaacaaataaacggaaagagagagagaggagagagagagagaaacacataccatttgccatatttgtggtttctcattcttgcgctatttttttaaacctttcattacattaggcctttatcagatattagcactggttcttcagttttccccctgatcaggaacttccctgaaataaatgctggtaagatcgtggaaagttcccaggagaaggatagaacaggtgtaccccagggaggctgagccagtacagagagacctatgggtttcacgggccctcagtagaactgatttcctctccttgtctcaggttgtcatcagccactgagcaagaccgaataagggatctcgtgaggctttggagatggatgcaggatctgttgcctgcgattcaaagctggtggaggacttgcttaggtcatgttaattagtttttctcagctctcaccaggtgtcattcatggaggttgcataaaagaaactcatacccagggatgagctttttcttaaatattacctttctgaattttgaaatttagtgtagcattgagacatttaaacacatttttgaagcacaaaacttatttatcctagttcaaagccagatttggtttgacctgtcttggtggtgttttctgtggttctgagatccaacccccaacttcgtcccttttgacctagtttatcacccatgtccttgggttgaaaatagtagtgtaatcctaagagaaggggcctgaaaggaagggaagagaaatcagatgtcagctggtgaggatgagaaatactgcaacaagggagcagcattgacccttgagagctacatgctaggtagagtcaagctctacttgccctaagtcaaaaatatcattgacttgtggctaaagcccagactttgaagagcaaagaaagcaaggatttaactgcaaaaatagaaaagtggctgacccaatgctgaggcttttaacaaaatttaccaaatagtttatttcagactgagaaagaaagagctcaaacaagcttaagcagcagcaaatgctatcagcctggaccatgagattgcatgtgccctgcagtgatcttccaccttgactgacattaaaactacctggtagtggccgggcgtggtggctcacacctgtaatcccagcactttaggaggccgaggcgggcggatcacgaggtcaggagatcaagaccatcctggctaacacggtgaaaccccatctctactgaaaatacaaaaaattagccaggcatggtggcgggcacctgtagtcccagctgcttgggaggatgaggcaggagaatggcatgaacccgggaggcagagcttgcagtgagccgagatagcgccactgcactccagcctgggcaacagagggagactccgtctcaacaacaacaacaacaacaacaacaacaacaacaaaaaaaaaaaaacactacctggtagtgtttacagccttgagtgcccagaccaataagatcaaaatctctgaaggtgaggcctgggcttggtgctttttgatgatcctcaggtgatcttaatggtcttccagggttgagcactgtggggaaaattgaggccaagatgtggaggcatctaactggctcgtgcatgttaagaactggatgagatgggaagccagacattagaaataatggggtcagggcaccacttacatggtattaatagccagaggtcttgaatcttcctccagactacagtgaagagagatacacatgttatctacctggtgatagataccaaagggaagcaaagtaccacactgaagcaaagtaccatggaaggactgctccccacttttgatgcatgataaagaccaacctgcctgcatgaagatgatggtgcacttctcctgaacttcaccatcatgatcacagtcaaagccagtgatgatggagtataatcacaccagtaaatgaagttcccctgctgtcttctgactcacttctaagtggcctggaccctggtggttaagaaaagtaaacccccaaagcagtcagtcattgtcggtttgctaacttgagcatcctgaaattaaaggactaagtactttaactgggtcacctctattagtgggtaaaaagctgtgtggtctttgttcacttccttaaaatgctgctatacgtgatggcaagcaacagaactagccacgagaaagcaacatggaaaccactgaagtcaagacttaatcctacctggttccccatcaataggtaaaacaaagtggttctgagcacaaactctgaagccagatgatcagcttttaaaaaaaaaataattaaagaatatttatttatttatattttattttagattcaggtggtacatgtgcagatttgttacatgagtatattgtgtgatgctgaggtttaggcatctaataatcctgtcacccaagccatgaacatagtacctgataggtagtttttcaacccttgatcccatcccttcctccctccttttggaatgcccagtgtctgttgttcccacctttgtgtctgtgtgtacccaatgtttagctcccacttacaagtccatgttgctgcaaagaacatgatttcattcttttttatggctgtgtagtattccatggtgtatatgtaccacattttctttatccaatacactgttgatgggcacccggttgatttcatgtctttgttcctgtgaatagtgctgtgatgaacatacgagtacatgcccttttgatagtatgacttatcctttgggtatatatcagtaataggattgcagagtccagtggcaattctgttttcagttctttgagaaatctccaaactactttccacagggcctgaactaatttgcactcccaaaaacagagtataaatgttcccttttctctgcaacctcaccgacatctgttgttttttgacgttttaatagtagccattctgactggagtgagttggtatctcattgtggttttggtttgcatctctctgatgaatagtggtgtagagcattttttcatatgtttgttggctgcttgtatgtcttttgaaaagtgtctgttcatgtcccttgctcactttttaatggggttgttttttacttgtcaatttgtttcagttcctataggttctggatattagtcttttgtcagatgcatggtttgcagatattttctcccattctgtaggttgtctgtttactctgttggtagtttccttttgctgtgcaaaagccctttggtttaattaggtcccagttgccagacggacagctttgaattctggtcttaacacttcataactgggggatctaggggcaagttacctaacctctctcagcctcagtgtcctcatctgtaatggagggataatagaagcttccccccagggttatagtgagggttgatgaggtagttcatttaaagcactcagaactgcgcgtggcacctgtaaacactcccacccccagtaccttttcacaagtactattaggatgatgctgttagcagcaattatcagcacctctcatctcaagttatattgctagtgacaaaacctttggcatttcagtgtatagctttccaatcttttccataactgtattttttcttataaaagtgagattatactgagcatactctttgctttttaaactgactatattgagaatatctttctatttcatgtaatctacagcttcatttgcaatgactgcataatggtgcagatatatcatagattatttaaccaaacacctgtggtttaatacttaagtctctctcttttttaaaagcaatgctgcagtaaatatcattaagtaaaagcactgctcattggcataatttcccctttagaataaattcctagaagtgaaatgtgttgttcaaatcgcatataaacttgaaagtgtttgctattctatatgactgccaaattatcctctagaaagattctaccaccaccagcagggaataaaaagtcagtttcccctcactatacttgacactgggtattacagtttttaaactgtaatcttttgtatttgttcttgacctaaagctgagctctgctgtttggggcttggcttctctgaacttggtgctgattcttgctttaactggagcttcctactggagcatcctaggtgggctctcactggctcaaacaaccctatgaggctcttcttagtcttctaggactagagcagggctcagccaagcacatggtgctggcaggacacttggagctgtccctataccagcagcaatcttttgtcttgcttatttaattaccttatcctaaagtacgtctttactagaaatttgctgtcctcagtgagaagcagtacctttcccttgttccctgctgaaccaccagggtcactaccagcagatcagagccacttccctgtccctgggggcatcgtcttagactttggtcaccaccaaagaggagacataagaagaagggcaggaagaggtagcattgagcaagagctctggatttgccatcatcagctgaggattctgaattaggaaacatatctatttaggtttaaactacaaaatatgcaagggttcctattccgagcctctcagaaacatccctctggccacaggcaactgtcactggtgatggttattctctcagaagatgctgaggatcagggtgtctaaggagtagctttgctttaatctgagcttggtatattacattttccatgttagcctacctaatagggtgggttcacatagaaatactagaaaacacagaaggatataaagagcaaagatgaaagcattccaaatcctaccatctagatacaacctatgttgatatttagcatgtatgcagaggatagatgctatcctgtagcatgatcatttatatgcatgtgcgtacacatgcatttactttttataaaaatgatataatactgaacatgctattctgtagtcagtttttaaaagaatgtatctttttttttttttttttttttttttttagatggagtcttgctctatcatcaggctggagtgcagtggcacaatctcggctcactgcaacttctgcctcccaggttcaagtgattcccctacctcagcctcctgagtagctgggactacaggtgtgtgccaccacgcctggctaattttttgcattttagtagggacagggtttcacaggttggtaaggatggtcttcatctccagaccttgtgatctgcccgcctcggccccccaaagtactgggattacaggcgtgagccaccatgcctggtgcccccccctttttttggggtgggggaaacagggtctcactgtgtccccaggctggagtgcagtggcacaatctcagctcactgcaacctccgcttcccaggcttaagcaatccttccatttcagcctcctgagtagttgggattacaggcatgtgctaccatgactggctaatttttgcattttttgtagagatggggtttcaccatgttgcccaggctggtctcgaactcctgagctcaagcaatctgcccgtcttggcctcccaaagtactgggattacaggcatgagccactgctcccagccttaaaagaatttatctttaatggctgtgttttatttatacattttcagtcattcattatcaataaatactgattcaggcccagtatgtgttaggcatgattctaggcaagagagagaaaccatgaatgagagacatggtctctgcccttggggagggtgtaatgaagttcgtcagttttgtgctttgtggtttctttctatgcgttatgtttttaaagtcctcttccatcctaaagtcagacaatcactatattttctcatgttttcactttttacattgcctgagtccatctagaaattgttttggtggatgaaaaattttctacttttaaaccattggaggacagcaatgaccacaaaaggattaaatcctctttccttatagacaagtgggcacaacttggctatgcagtaattctaacatcagcagtgcaaagaagggaagtacagtgttgattcttcatgggagactgatggaattataatagacttctgttcttaaggtagaaaattatcatttttttaacctgaaaagatagagtaatagtctatgataaggacaaattaccccaatatgtttttaaaacattgcaattattaacaaagtggtagtttctttcatttaaaacccccttgggccctaaagatatagctaacaagaggaaaaactgtcaaaactcttattaggtggttgagtttattttctgctcacaattgtatcatttaaaaccctgagaaactgttttttggagagcaatttgtccctattagagttttatgtgttcaaatccttgacttagcagttctgctggtagaaatccaccctatgtatggaatcacaaaagtacgtctaagatgaacatagaggaagattcattgcagtcccgtctataattgcaaacaaagcactgagaaccacctaaattatctattagcagcagactgctaaagtaagttaagctacatctgtgaatcgccatgccgtagttgcaaagaatgtggtgggattccatgtgctgaatgaaatagtaaaatctctaagatacatcacgaagtgaagaaagtaagctgaagggcaggtcttttgtgttaagaataaaagaccccaacttatgttggtgtatccattttttcctgtaggatgcataaaggactaataggaattgttgcctgaaggaacaaagctggtagggatgaggtgaagagaaagtcaaatgttcattttattcctgtgtggatggtgtgaatttttctaccctgcatgtttattacttttatttatgttttgtaatgcttactccatttatctaggcagggagattatagacaattggtgtttccttctttatacttttctatattaaaaaatgaatatagatcagaaatgttcaccagatactggcatctaagaaacaaacaaaaacatgatttgtcaaagtcagaaaaggagtgtatgtctctgtttggaattatgctaatttcttggagtttgcgttcctttgttgtcatcagaatgctgcacattgtgttctctttctatttttgtgcacactatcttgttttgtatttccaaccacgacagctatgttcagttgtgccccatcccctcccctgttctgtggcctgcggtgctgagaactgcgagcagccaatgggactgctgcttactgtgaggtccatgcagtgtccacccccgcttcctgccctgagactgcctccaggcctggcacgtcttcctaagacaggcctatcaacccagtggatccttctgccccttcctcctcctgtcctccaactttagggagccatattctgatatccagagatcctggatttagagcatctcctccattcttggtaaattgagaaccttcccaactgctgcctcatctgcagtagttcctttcagatgaaaagttaaaatgggagagaaatattttgcatttgctcttttcattagactattcgatttctatgtaaatgtcttctacagggattgaaagaaatgaatatattggttcaccagacattgctgaaggttccaacacagccttgacctatttttgtttgaaattgagaaatgctcacaaatgtaagaggcctccttttttggagattggagggatttgacatcaagatgttttgcattttcaacagctcatttgccctggatggcttttggcagataaatgtggaggtggcagtgtaataggtttcatgtgtccagagtggaattcacccagagccaaacaaaagctagtagctctgaacatgtctcttttcatggtaaagtactctggagtgagactgtttaagtttcaacccctgtttggccacttcttagctcaagggcacttcccttacagtagctaagtttaggttgtttcatccataaaatggaagattttaaagtatctacctcaaagtgtgatgaggattaagtgaaaaactgcggggcaattcttactataatgcctgacatagcaaggcatcaataaactcagttgccattattattcttaccattatggtttataccactaccatcattgggattattaggttcaaccactacacaactgaattgttgttgcatgagtaaattgcagttgtttagacaaaatcctaagccaaaaacttcgtgctaggtagaaaggaagcaccttcatttattaagtccctgcactctaccaggtgatgtgttagttccatctttgctgtatctcatttcaatcctgcagtagcattttgcaggtagttctatttcagtatttcagacggagttccaattgtttgatgcttactagccatgtgaccctgtctctttatcttcctgtgcctcagttttctcctctgtaaaatggggataatgatagtacctaactcattaggttgttgtgaagattaaacatgttaaatcacacaaaacagtgcctggcacacagtgaccactatgtaaatgtttgctagcattactttataactcaggaagggcacatgtgacagtctggaacgtgtgaagtcgttgttctccttagcactgtggaatgttagtgatgctggaggaaacttagagctaagctggcccaacctactcatttcacaggctggggatccaaggcccagaaacaataagggacttgtctaagtcactcagggagttcgtggcagagcccctacctgatacgagatctcctgactctgctcacgagacttcatggtgggaataaggcaacacacggagagggatgagatggagatcacattcttcgggagagtttgattctgttattcctgccatttgggactttttcagagtcctctaccattctgcctacctgtacagaaagtgctggatttttccaccacaaggggcttatcaatgtggtgtcataaagcgggtcttactttctcatcagagcccatatcagaccacttcccttcttggtctttagaggaaaccaaagtgaagcactcctagcaaagaatttgatgttatgaccatcaaagcaaaagtatagctctatggttaaataattacttaaagggtcacaccgtgggcagaccttaaaaaacagacttaagatataacccatatgggctataaagtatctataaaggaccctaaatggaaactctgctgtgttgtgcatttgacttggcactaataggccagatatattaactgttgggtgaaattaatgataatattgcatctaaattctatgggatgtttcttaaggttttgggtgttaaattaccccttctaaaatccagtattgaggctcgaactaatcaatgtcttctttttcttttaaaaattctcttgaccatattgtttctattacaaatgaaacatgaaggtagaaagtagaataataagttacaagaagtggagaagggagtgtgtgtagtggaggatgagagaggttggttaatgggtacaattatacagttaggtagaaggaataagatctaaggttggatagcacagtaaggtgactttagttaacaacaatatattttagattttaacatagctggaagagaggactaaaaatgttcccaacacaaagaaatgataaatacacgagatggtggatgtcctgaacaccctggttattatacatcctatgcatgtaacaaaatattacaggtacccaacaaatgtgtacaaatatcatatgtcaataaaacaattaaaagtaaataactacagaaaacaatacaaagctggcagttccttcttttacagatagatggcaagctcaagtccaaataatcagttgaagaaaagagaagttatgtagatggaaatgctggtccaaactaagggatgaggaataaatagagttgtggaattatccacttcacctggtgatgttgcgggttaaatgggtacatggctaggcagaacaatgtagaaaacctaccttacttgttcttctgaccaagccttttaaggctgtcatttaaaatggctctgagttctgtttcttagttttgtaggatcagaaaatcacatgccaacttagctttcagctacttatctacaaacccaagtgtctatttatttttcagtggatggacactgcaggggtcttagcaagtaccatctctccatttagctaactacataggaagcctgaatagaaatcaggattatgattggtgatcttgaagacagagccaggagagtgagttttaatatctgatggtgttgagatgagataactgatctcgaacagggatgtgtctgctgagcaaactcagcattacttgttagctggacaggcgattggacaaagctgagtgagcacctcttcaattttttttatgcttgattactcaggttttcagtttttagacagactatttttcttttttttcccctcagatgtataaatagcattgaatctgcagtagtgttagaaaggtaattataacccaaccatgtctgagatgacattgtgatttcttaatagaaaaagcttgttgggtccccacttgcaagttgatttttcataatttaattctcaaaatgtcaccttatttcttggtgtaacccagataaaacctaggtatcctggcaatccagtttcagcatgaagttatattcaaaggaacacaggctagttggccaaagtaatttcagtatccttactggaatcttctggagaacatcagaggggattcattttataagccacagtaaaatatctcaagattctcttttcctgatttcctggccttaatatctcagccttttcattttaaactcttgaactttaaactgtctctgacccctttcagtgctttacttcttcatctcttctttccttttctcgatcatttttccccctaaatagcatccccacccattccctttccaagtgcaactatataaaacagtctgtttctcgcagtttttcagtactttacctctttctctgattcttcatttcaaaagcctaggaatcctctggcaaaaagtcacttaaaaggtttggggcaaggaaacaagattccctttagctcacatggaaggaagtcaaagctgaattatcttcatctagcaatagaaagaataaagattgcaacgtttacaatttaatatattttctttaccctcctcttgtctaaattctgtgatctcatgatggcaagagggccttgagtaggtcttctggtcccttcccactgctgtgccctggggcgcgaggtatcagcgcaagctagaatgggggttcagtggaggaaaggaaacaccctatttctgcttctgactaccttccctgcttagcctctttccctgtctccctgtttctcacacactcagttgggacacccaccttgtccacagccacagcctggcatctcctagtgctccagttgcagcacagtcagcaggagagaagagggagtctcaaggagcaaaaaggtggaaataggctttcctaacaacaggtgcttgccatgtctgtcttctcatcatatttattgaacagaatgtgcttcattctctacgggtgctctttaacaatagtttacgtgttatgttacgaacatgttatgattataacatgttctatcatgttataatccttccagaaaatacttgccaggaaaatatataatttatagaaagtgaatgaaagtggcttgttagccttcccagatagtggaggaatctggaagtctttctaatggattgagatcacgtcattccagatgtctcttgaggcacactgccccgaatggttgctactgtcagctcattatgcttttccctggaatttccacttcccccgcctttctccccagaataagctttccatgattctttcccagaattagccttttcaactctttcctcatatgcatagcaacagtaatttatttcatgtgggttaatgtctttagcattaggacacttctggttttatggactgatggccaatgtgtttttaataatgtattttgcttctattgaagtcatgagtacaaattcgtaattcatttgaatgagggatatggacaaacaggaacacaagtggaagagagaaaaaagaggatagtacactcagagatactcagtaagcataaattacatgtattcatcatacaatattctaggctttagagatgtgtcagccaagatccttgtcctcaaggagcccatagtttgttagagagagaagatgtgtaaatagttaagtgtataaagtgctacagtgcttgaggtctaatgtagaaaaatccacagcctgtggggagggaagagaaaggagggagtgatgcaatctatttggagggaacagaaaaatcttctgtatttgtcagtactctttgagttgtaagtggtagaaacatcactcaaactagcttaagaaaatgggagatttattagtgtatataatttaggaagcctggggatggttctggcttcatgcatgactagatctgggactcaaacaatgtagtaggacccttttttctctttcaactctgcctccctctgcatgttgactttattttcttcaatgtagatgcatttcttttatgtgacttggaaaaattgctactcagaagtacatcatctcagcttaatcctagtggtatgttttttcacttctctcctggtatccgtgtgtctgtccctagaaatgtctctaactggtgtttctcagttcacttagctatcccttggatcaatagctattgcaaagaaacgaggtagcatgattggcctaacctggctcacaaacaagtcctagtggcaggaatgagctaaccatgactggcatttccaccagagccatttacagtgagggtagatgtgtttccccaaaggaaagaagactaggcagatcaaaattgacagatgttcattaaagcttcatggatatttaaactgtgccatcatagatgaattgttttttgtcaaatgaagcagcagtgcacatcgattattgttagaggaagcaataagaacaaaactaagaggacatgaaccagccgggaagatcaggagactgcaagtagtctttgaggttggatcatggtagggggccatggcttgagatgaagctgtgaaatagacaggagcctcactggctatgctagggaacctgctctttgcactgtaggcaatggggagacatccttggttttaggcaagggtcggaggtggtcagatttccattttagaatatcactctggcagcagtgtggagattgagttggagaagccaagaatggatgcagggagactaataaggaaaccactacagtaatccagctggagataagttctgtaatgtgctaaagatgctaatatggaatagtctccatgtccaggtaggagatgaaggaaggagggttaaggcaatactcaaggttatagtggggaagcaaaagatgtggaaactggccagcagaatcaacatgacttggtctttcaagaaagtaagtgtctaggatgacttagatttctgacttaagtagtgtcatttgctgagatgaaacatagaagaaggaacaggtgtgaaggtagagggtgggggattgcttgagatggtgactgcatgtgtttgagtttgggggagtgactatgaatagttggcagttcagtatagggatctgcagctcaaaggagaggtagagttgtagagtggatgagaatgaaggcccgaagagttactggttttgtcctggttaagggaaggagaaatctggaaaccagtgggctatcccggtgaggagcacagctcagacctcagccatcaaacaagtatcagaaactgcaagtgagttccttaatggtgtcctatgcaaacttgttgtcgtttgactcatatctaattctgagcgtaggctggttgcctcttgtccacctagaagtgactttaagaccatcactatgggctgggttcggaggctaacacctataattccagcactttgggagactgaggtgggtggatcacctgaggtcaggaatttgagaccagcctggccaacatggcaaaaccccatctctagtaaaaatacaaatattagccaagcgtggtgacacacacctgtaatcccagctactcgggaggctgacacagggaaattgcttgaactcaggaagcagaggttgcagtgagctgagactgtgacaacagactgagactctgtctcaaaaaaaaaaaaaattcactgtgaaagggagctcagctagtcaaagaatcctgaaatagctgtggatgcacagtgggtccttgtcatggggccaggcccagggtcatcagttagaatgcagttgtaaacatgctaatgctgctgcctggttgtatgtgctaacaactgcttagttccaaattctaacccaataaggagtttcctcaggggaaatgtatgactacagcacaaatgggctcagccttactgctttcccactgttaccccttcctgcaccagcgctcttctggtccgtgtgactaaaagccaaaacaccactttgcctaaccccccagatcctattagttttgagtctcatcaattctgtttcttccatttgtccttctctttccattctgattggtacagctctaagctaggaggcttgttagttcatccatccttactgcacaaccaggtgaatggaacatcctcctaaggcacttaaatgatatttgaatccacaggtcagcaaactaggacccgtgggccaaatctggcccactacctgtgtttgcaaataaagttttattagaacacagccacactcattcatttaaatattgtccaggactgtttttgaactacaatggtagcattcagtagttgcgacagagactgtatgtcccacaaaatctaaaatatttacttttgttttataggaaaagtgtatcagcccctattaatccaccttatgtatgaatgccagattaatgttcctaaaatgccatttcaccatatcattctgtagcttagaaccctgcaatgacattgcattgtccatgcaataaaatctaaacttcatggccctccatggtatagtcctagccaatctgttgagtcattgatctctgttcctaaaggcaagccctacaaccagttagattttcctcctcattgtccctggaatatgcagtgcatttctacccttgttcacctagttccttttgcttggaatgtattgcccatttgtatctacctaaatcctactcattccttttttttttttttttttttgagacagagtctcactctgtcgcccaggctggagtgcagtggtgtgatcttggctcatggcaacctctacccactgggttcaagtgattctcctgccttagcctcccaagtatctgggattacaggcatgtaccaccacacctggccaatttttatatttttagtatagatggggtttcgccatgttggctaggctagtctcaaactcgtgacctcgggtgatccacccacctcagcctcccaaagtgctgggattacaggtatgagccactgtgtgcccggccctaaatcctacccattcttaaaggactaacatgaactctacatccttcatgaccatgtcagttacagtgatcaccaatgagcctgctgcttgagcatgtaaaggtccactgcccatactgcctggtaagttttcttctgctcagagaatggttcaccaatatgatgatgggcaactctggagtgaggactttctgatggaacaaagtcacagctgtgggaaagcctgggaatggtttggaaatgacaagacatgtaatgagaacacatgacactcaattaatatttgtggaaatcttgagtcatcagcctctcatatctatgacatacatcttggttctgtatttaaatgtaggacaactacatatcttgatagccagtgggaatgactgacaaagtccagtaagtctactcttgagagattctagaatgtagagatagcagctggaccaggaagccctagctttatcatgtgccatctctgagatggtggatgtgggctgttcccactgtgcctcacttttcccatccactgtcatatattttatggtcttgcacacactctgggattaagtaacatcaattatgcaccattgattggagttctttggtaaatggtactacattcctaaaatattcatgtgtcttactttgtcagggagattatatccgtgacttagatatcatattctagtggcttaagattatgagctaatattttgtaaggtctgggcattgcacagaaaaccttggttgtaatacacattattattacattgatttgaatagcaatggtacaatcatagccccggaaacatagcgactacataaaataaaagcttccgttaacactgagcacagcagccaggcttccgcattgttgttgtccctaggatttggctgttgtattgtcaaatgccattatgtcttatctaataagtttctccctgcatatgtgagtaaacgaaaatgctccagtatagtaaatgtctcagcaaaccactcctgtacgctttggaaacagaacattaacaaggaaactatcatgagagcagacctttctgttctcatgaatcacattcatatgatgtttattgtccacattggagaagtatagagaagaaaaatatgaagggtacactctaatggaaaggttatagtggaaatgcaaggaaaatatatccctttacaaccagcttctaggcattacctagaagtaaaattatgacaataagactaacagcaaataacattgagcacttactctgtgccaggtattgttctaggccttttacgttacatcatcttatttaatccactccacaactaagtggtttggatgcagttattatctccactttatgtacgagaagaccaagacccagggaggtagaagaacttgtcagaagtcagacaggtagtgagtggtagggctgggagttggacccggacagacagattccagatttcatatttatcgtaacctcagctgccccacccacatgaaatgctaccccaaggctagtggcagcaaatataacccatttcatttgcattgtttggtatgtccaactgggtgatttgtcctacaaaatttgaaacaacgtctgcttatttatgtctgtgattttgatcaaataaatctcacccagaatttcccactgtcttattctatggtatttgcagtttgtaagaacctctgtcttttggattgagacgtttttattctttgtgtccaaattaacactgcacagaacatggttctctgtgtgtgtgtgtgtgtgtgtgtgtgtgtgtgtgtgtgtgtctgtgtgtgtgtgtagaaaccgtcttttcttttggattaaattcttgcagcctggctgagtgaggagaatttctcccactcttcgagcctacagcagacatgttaggagaatgctgctgcttgcaacacacccagagacggtggggcaggtgacactgcgtgtgtgcccggtgtctctggaagtgtctatacagatgtgtgctgctgctgctgctgctttctgccttaaaatttctggagccaacacccacccactcttacagcctctgtctctttattttcaaggaaaaaagaaagaggcagactgaaatagaaggcaagcgacaacagcttgacgagcagatacttctgctgcagcattccaaggtaagcagctgatcccaggaacctattccattattagacatgcagatcacactccggagagctgggcagtgcctgccctgccgtgaaggcgctgccgccaaccaaaccagcctttttcattcaatcaggaaaccatctcttggcttttcttgtgaatttctcaaattcagggcattattacagcattccaatttctgcaagcataagattacagtgtgcatgtggacagggtggagggtttgtgcgtgtgaagtgtggtggctatatatagaaattggatgagaatacttcacagggtgggtgaggcagcatttcaggattgtttctcccatgcataggtgctgggtgtgtttgctcagagaccccaaaagatatatttcacggaacgttctttttattcacttaaaaatattagtatttcctttcttgatatggagaaaagggagattaaacgatgtgatctgataaaagaacaacactgtgtatttcagattattcatttattttatttgtactttaacaattttgaaagtgttctgtgagagcaagcagttggtcaaagatggctttgaaatgatttgactcagacgggtctccatggtaccatctaaaaagagagagagagagagacagcacacaagagctgtttattttttctttaaaacatgatgcacttaagcatcgtaattgattacagctcaggagaaagctctgtcactgtcacaaggaccccactggttgcagaatgttgcttttcacatgttcagagaataatgtgaccacattccaatggccagccgggagttgttgcttgcctttgactgctcctgggctttttggcaggaaaaccttctcctgcttacctcatgttgctgtgacattgcctgcacagagctgcattgctcagaggactgggtgggaaggtggtgctgactttcggggtgatgctcggtatgaattatctagatttttttcaacaagataaacctttatggctacttttcctgtccttttctagaaaacaggattgtgctaaatgaatacccaaaatgagaaccatcagcaagcgagttactgattgaaaatagcagcatgacctatatctgcttagcatgtttatcagtttttgccatttaccttaaccagagaaatgtgcttaaaaggaagaaaagcagcatgatactaaggatattgcctgtttctctctgttcatcatataaattcattgacagatctttctttgtaggagcttgctctgtatccccggtgctgttgctctttccccacaacattcctgagggaggatggagggctaaaattagtatcctcttctcacagagagggggccttaaaaacacctaatagaactgagtgaattgttcaaggtcaatctgcacagagctaggtctctggctcagagtacagtccattcagtacggtgcttgtaagagaccaacatgtactaaaacctcagtgaatttctggttaaaggtgaacttttaaataagaggaccgaatgaaaaaagagaggctgctttgggctagacagcctcactttaagctcaacgtagttctttgcttttgtattccctgaatccagtcagggaataaacatatgtcaaaacatcaagggattttttttctttggtctcccttctcatgatcctgggtgccaaataagataccaagggctcatttattgctgatgtccagtgcagtattagtatattctgttcatattacatctattcatttttttatttgtttgtttgtttgagatggagtctcgctctgtcgctcaggctggagttcagtggcatgatttcagctcactgcaagctccgcctcccaggttcacgccattctcctgcctcagcctcctgagtagctgggactacaaatgcccgccaccacgcccagctaatttttttttttttttggtatttttagtagagatggggtttcaccatgttagccaggatagtctcgatctcctgacattgtgatccacccgccttggcctcccaaagtgctgggattgcatattcatttttcgtctatgcatccattcatccatctttccatccatccatccatccatccaatcaacagaaacaacagtagaaattaacttggtcttgtatgcggaagcagtgaggtttttctcaaggacttggaaacaagggaatcagctagttctttatggctatcttggtaaaattctcacacagttgatgagattggctatctgaaggaacacccaacactcgcaccatggcaaccttgctattgcagggcaggaggtgggtgaggtggggaggactggaggtgatggtaacttactaagtggaggtgagtgcattgtatgtctctgggaaaggcttgtgtggacagaatgagggtgagttatttgccttgaatactgaaaaaggaaagctcagaggttccaaaggtggcagtggttgtctagtactatctgcagagagacccccagctttgggaggtcctgaatttctgtatgctggtgaggtggggtcagtggtaaggtgaggagggtcctcaggccacagtgaggcccaagtgaaacttccctcaggaccttgcctctctttgttctgaattcatcctccctataattattcagttattttgatatgaggaaagggttgcctgattgaaggatatgatcactttaggcactaggaaggaatatgtttcactttaaatcaataaactggtgactgaacttgaatagcatgggactttttccctgtaatcatccagtttgcagcctagtggcctcgcccctggatggaagtacattcgtggaggttatattttcttctctgtgagcctctccaaggagtcagccagttttctcctggtagcctgttagccaccgtcagtaacagtcaccatttttttgagtgcctaacacgtgcctggtactttaaacacataccctcaataatgaccacaagacagttattactctgtcttacagctatgggaacaaactcatgaggtcaagtgatttgcccaagaccatagagactataaatgagggagcctgagagaaactcctgggctgtctgctttcaaagaccgagctctttccaggccaccgttctctttgaaagaaatgtttcctttggaataattcatttagtgagatgccagttaccatcattgctgtctctcttactctaaatatattgtgatggactccagaaaatttagatcatgtggagacatgtcacagtgattattgaagttccttgaagtagagaatattaggaaatatgtcagtaatcaatatttgtttcactaatttgcaaaatcctagatattctctaagaaaaaaatattctccttgcattagagttagttgtcatgtttataagatataattttcatattctttatataattctcatattctatgtcttaagataaaattctcacatgtggcaattatcagatagcctgtggacacttattctcatgcaatgagatgaattatttagacagattcacctgtctgtggtcaaagcaaataaatagaatgcaagatagtagttttggcattcatatatatttttagaagacttacttattgcaatatttaggaacatatagtgagcaactctacaaaatggaatatcatcactttgtatatggacttcgagcaaattccacaatacagtaaaagactaaagtataaaatggtaaaatactaactgctacatcccagtgattaggaaacctcaagatactttgaactccaggccaaattaaactcagatgtatttttaaagcatccttagctatacgtagtgtggtgtaataatttctaagcattacaagtagaactagtaagcaatttttatagctatattatttttgatgattacaaaaggaaagaatgtataatcattgcaaaaactaaattaaaaagtacagcaaaatataaagaaaaaacatatgtactctatacttaccattcagatagaacccatgcagaggtaaatccttctatacttttttccccgatatatttctgtagattaagatatgtaaccatcattcacagggctcaccaacctgtgggtaaaatgaaattatattaacattagcattggaataacattaacctttacctcttttttatgtgggttctttttaatacccatacaaaaacttataatttttataaaatcccatggagcattcttttactttaggataactgactttgatgtcttccttgaaaagaatgtctccatctcaaactcttagctattatgtttcttatacttcaatagcattaattcatctagaatttatttacagacgaggtatgcagtaggaatataactttactttttactgatgctgagctgcttgtctcaatgtgatttattgattaattcatcctttccttcactgatttaaatgtcttctttatcacctacatatttctgacttacatttgagtctaccatttatggattatttttattccattaatctgcccattcctgtgccagtattgttctcatttaatccctatagctttttaatatattgtaatatttcataagacaagaactatcattattcttttgaaaaattgtcttggctttttatttcataggaacaattatttatttttattgtttttataatgagacttgtgatgatatggatttttttaaaataaatcagctactatatcatactagagcagaaggaatttaatatttccttctgtcccttggttgaattgccagagatttgtctattttattggtctgttcaaagtcccagcacagagtaggcactgagtacctactgcaacatgaattccttggagactgtcatatttacaaaggtttgcctgacagagttggccctgtcagaatcaaattgctaataccacgtcttcaatacataaactgcctttgaattacttattcatgagcggggaaccctcactagagttttcttctaatccaagctataaaaattgtcattatatttggaagaccacagccttttcttccaagaaagctgaatgaaaaaagatgaaaggctgaattgtgaccctgtgaaatatttgttgtcaacccactaaggtcatttgctgaagagcctgaaggtatcagaagacttgctacaaagatattacagtgtctttcccggttttgaacatttagcactaattttagactttttcttgttactgggatgtgtgaaagacttatttcaaattttaaaatattgaacagataggcacagtacacagtgtaaagtaaccttagatctcctcccttgtttccatacccagagcttgaatggaagttaaaacctgatttcttctatcagaagtcttgggtcggcttctccctgggtggactgaagcatataacaaaatctcaaaaccaaaccaagatcttatttattgagagtcaagaaagaggaaggaaagagtgggaaggataggggaagagaaagagggacaggacacagataaatgactgaaaacacaaacacagctattgcctcatgctgagtttaacccactttctgttagaaaactgaatttaggccaggcgcagtggctcatgcctgtaatcccaacactttgggaggccaaggcgggcagataacctgaggtcaggagttcgagaccagcctagccaacatggcaaaaccctgtctctactaaaaatacaaaaattagctgggctacttgggaggctgaggcaggagaatcacttgaacctgggaggtggaggtcgcagtgagccaagatcacaccactacactccagcctgagtgacacagtgagactccatctcaaattaaaaaataaaataaaataaaataaaataaaataaaataaaataaaataaaataaaattgaatttagccatattccaaccatcatccactagaatagccaatatcagcttcagccagattacaaatgaatgaaagatccagagtaaaaagtaaaatcatgaaagtacacaaaggaatcacaggtgaatatttttatagtgagggtaaggaagtcttatctatgtatgacatcaaagccagaatgtgcaagtaaaaaagattgccagttatgactttataaaaataacaaacatctgaccaggaaacaacaggagacttattacaagttctcattcacctcctacttccccaatctgccccacccagcctctccagacatgcctcactcttcaccggggtcacctcaaaaagtggtatctaggctgggcacagtggttcatgcctgtgatcccagtacttgggaggctgaggtgggaggatcatttgaacctaggaattcgagaccagcctgggcaacatagattccatctctacaaaaataaaataaaaaataaaggaaagtaagaaaagtgacttcattgcagttaccttagctgtagatgaaaaagattgggttagatgatctctgtgatctttttttagctttagtgatccaagattttatatttgctaaagtacagtgtatgtgcatgattttccaagaattcctcacatgtcagcctccgtggatgaataaaagatacagtcctgactgtgagaactcaggggcaagtgggggagagagagcatcaatatggaacccaccattagaggagctgaaaaatagttttccatgttatgaagtggatcagtggcacctgatgattttgtaaatcctatttgagcaaaaaagaaaaaaggattcttgggtgatcttacacagaggcaagatagtagagtgtacctcttggcttcaaatcccagatctacagctcactcggtgtgataccatggataagtcagttaatgttagcacctacctcatgggatgcttgtgaaagttaagtggatttacatgtaaagcacataaagcagtaagagttctataagaattatcattattgtcaccatcatcacccagtactatggctgcaaataccatttatgtatatatgactgccaaattgagaatcccagtcttccatgttcaactgcttttctgacatgtccgcttagatggatgtcactttcatttagaagcctctgaaacttaacatgcccaaaatgaaagattttattttctgcttttctatcatttgttctactcttccctgtctccagttgatgataccactattcaccctttcactcaaaccaaatatctatgcattgccctaatccttccctttttctcagcccacatctaatctgttacaagtcacactgattctacctccagaatgtaccaccatgccttttgattcttctgtctctcttctgtttcaagctaatattctctgtcacttgaaccatgcaataaactcccatcacttgtactttgtaatcctgccccttgcaatgtgttcttcctattgggcttagaagacacagcaaactccttaacaaggctacagaatcctacctaatctggcccctgccttcttctccatcttcagtttgttctgccctcccaccccaacctcacttattatggtccagccactcgggcatttgttccggtccacaaacacaccaaactctgtcctaccaccaggctggtacatttgccagtccctccacctggaacacccctccggatctcagatctcagcttgaatgttcaagtcatcagagagacctttcccactttaaatgtcctcccctggtccctctttgtcacattgtcctgtctacctcttcctaggcagcatcatagtctgagattatcttgcatccttgtttattgggatgaaggcttgagtgagagtagggacttgcctgtcttcctgagctgtgacttcagggactggcagagttcttggcacctaggaaagggataagagagccactgctcctgagttggggacacagaaggagaggatggggagttcttttagattatggtgtttgaccagccattgagaaagcttgtgtattcttcaagcatttggatagtcataggtcctcatgctgtgctactcaaatcgtggtcctcagtctggcattgccagtgacagcatcacctgggaggtcgttaaaattcaaattcccaggccttatgcgagacttagagaatctgcatctccatgggtgggtcctggaatctgtgtcttaggaagttctcctggtggtccttatgcatactgaagtttgggaaactcagttcttgctttttgttttccaaagctggccaggccagtagagccagaaacagatttactttgggagttccttctgtcctcctttcagaagcccctgtcaagtttccctttgtccagctgccagctccccacctgctccttccttgtattgacttgccatgatgacattcgtttgacaaatgtgaagtttgacagtccttagcaccttgggaggagtttgagaccagcctggccaacatggtgaaaccttatctctactaaagctatgatactatgttagctatgatacttttttttgatgtatgttatttagacaataaaggccacaaacagagaaaagttttttttaattttaatttttttatttctattgagctctgcttccgctaaattctgaaacactgaggcagccaatacaagctagcacagtataggggaccctgtgctttggatggtgcactcagtatacaccattccatttggagacatgttggagacaacataagggggatctggagtcagttaaggaagccttttgaattggtgatttcccctgaaagcatgactttggagccaagtagaaaatcaactatgctttttcggcttcttaaaaatgtctaaacacctttgtgaaacaggattctctgagaccaggcccactgccttttccagttttttttctttctttcttttttttgagacagagtcatgctctgttgcccaggttggagtgcagtggcgtgatcttcggctcactgcaacatctgcttcctgggttcaagcaattctcctgcctcagcctcctgagtagctgggattacaggtgctcgccaccacacccagctaatttttgtatttttagtagaaatggtgtttcaccattttggccaggctggtctcgaactcttgacctcaggtgatccacctgccttggcctcccaaagtgctgggattacaggcatgagccaccacacccagccccactactgcctttgtctgttggagcctctcttcctggctcctcctgttgggatgttcttaatgatgtcatgcctatatcaagaaaagagatggaagtagagggacatgcacctctgggtgaccagagtcaccaggctgctctggccagagctacctgctgatggtggcagctaagttggtgagaagtgaggggctagacccttcatgtgatggcaggaggcactgtgtgaagaacagcagagagaacattccaagagcagccatttacgttgcaagaagttgtggctgcagaacatccctgctggtgtggagacagccaggactgtccatggctgcttttccagaagggtccacaccaacgccaaggcttccaggatgtctatcccccagaatcctaaggtttttactatctgtggtttggacatctttagcacaggaagcaccctgaaagtgtggtccctacccctcccaaataattagagagaaggaaagttgagaatttcccagttcatccatttactcattcattatagggaattgggctacaattccattgactgaatgaataaatggatgaattgggaaattctaggtgacacagtgaatgtgaaggtggataaaggacagtcctagccttccaggaaccagcaggctacagggggaacagatgtaaaaagaaagaatttgaggatagtatgaaagggccatagagtgtgtctcagagccagtagaggtggaaggcttctctggtggtattttacttgttctttcttaggtaaataaagcagaggccaagggaacaggatggacaacaacaatagtaaacatttctatagtactaagtatgtgtgtggcccttttagcctataaactcctttaatcctcataacaaccctctgagctgggcactgctattttctccattttacagatgagaaaactgaggctcagtgaggcgaaggagcctgtccaagctcactcagctggtaaatggcagactggttccagagctcaggctgttagccactgttcagcatggcctcttgcagtctctaccctcttcctgagagtaaatttcagagccaagttatagttcaagaaaagcaaagcaataatcattcttctacttcagaattgctaccaatgaacaatttattttgtgcctacaacagattaagtatctgaataaaaatataaaaacatgaattgattaaaaaatggcctctcataatgtgcaaaacagggtctgtcggggaaattttgagaggtttttgtggagaacaatggttctgaatgttttgtagaaagagcaaccgatttgccccaccctttcccactttccaatggaaaagaatctctgataaagctttgataagcaaccaacgtaagcaaattgtactgccctcttttacacatgattttatactatcatacgatgccctataatgtaaaaactgtacattttaatacctaccctggtggtagatgcacactatttatacagagcacattcaacaggcagcatgtcaccagtgatgcatagctgtttacgcatattgaggtgtgggggtggatcctgtctataatcactgtaagagtatagttaggaataattctatgtgaacaaactcaagtctttaagcctaattattaaaaaattacaggtcaagtaccataaatttgcctatgtgctgcaagagtaatcaaagagatctctacaaacaatgatttgtaatgaaaaggcaagaataacatcaataaaaaccatggtcacctgaacccacactgatgatgtattgtcaacacagagtctctcctggaagtgcaggaattccaggttgattgaacttgctcctgggcatggagcagggtgtctacagcaccagatgacccctggacttctcaatagaatggtgaatcaggaccattagtgaagtctaacttactaatactaagtgttggtaatttttttttgagacggagtttcgctcttgttgcgcaggctggagtgcagtggcatgatctcagcccactgcaacctctgccccccaggttctagtgattcttctgtctcagcctcccaagtagctgggattacaggcgcatgccatcacacctggttaattttgtatttttagttgacatggggtttctctatgttggtcaggctagtcgcgaactcctgacctcaggtgatacgcctgccttggcctcccaaagtgttgggattacaggcgcgagccaccgtgcccagcccagtgttggttatttttaaagactcatcagttcataataaaatgcccttaatgccgcatacaaatgagagtctatggaattgtgcatccttcgctcataagagcttcagggagtgctccaagcctccattccctggctctcagtctttagaagagttctttcctttcacctcgctcaccctgcctgatgagatcaaacgaaattctggacagaggtgatgccagtgagccagggagccaaagagccaggtctttattctgtgttaggtggcttaatagtcattgctcctgctgttcctttcgttgcttactatttctgggaagaattgttcatgtgccctgcatcctcactgtggtcccctctggtgaccactgacctgcccatgggcatggtcactggtccttagccatgatgtacagggtcagtagctgctgccgtctgccatctagggaccatataagtggaacctgaatcaaaattatcctctcacatctacctctccttgctcttccttttagggaatttcaacatgcttttttctggaactgttttcatttcccttctcaaagcagtaattgctgcctccgaaccattgacctgaaacaaaagctttttattccactgtactgtatcgtagtacacttgcaaacatgggatgtatggtttttttttttttttttgacagggtctcgttctatcacccaggctggagtgcagtggcacggtcacagctcgctgcagccttgacctacctggctcaagcgatcctcccacctcagccttcccaagtagctgggactacaggcgtgcaccaccacacccagctaattgtttaattttttgtagagacaaggtctcactatgttgcccaagctggtctacaactcctggaatcaagcaatcctcctgcctcagcctcccaaagtgttgggattacagacatcagccacggtgcccatctaggggcatatgatttttataacatttggagattattactgaagatgattgggagtcattaaagaagggagtcattgaagaagagtcttgacaatctttttaaaacactttaatatggaccagatattaggtggtcttaggaagttttttaattaaattacagttgcatagaaaaatgttcttaatttttagagactcatactgacatattgttgggtaaaatatggttgttatttagtttaaaatcatttgatgagaaacatatgggaaaatatggcaaaatgttcataattgttaaatctagatgaggttacatggtcattcattatacagttctatttttaaatttttttaataatagaaaatgatatagagataaatctccttgggtgttgatctagagggaagtagggagccatgttagtgaggaggtgaaggcagcgattcaggcagcgctggtgaggggtggagctaaaacagcaccactgcagagggagaggacagtgtggactgaaaagtatcatcttgtctgttgtcttccctcacttccacagtccaaagtgcttcgggagaaatggctgctgcagggcatacccgctggaactgccgaagaggaggaagccaggaggcggcagtctgaagaggatgagttcagagtcaagcaacttgaagataacattcagaggtaggtggcttccagcccagggaacccatgctacagtttttcagtgcagtaaccactgctctcctctaggtggcctttctcaatactgttaccttctcctgtacttgagaattttcttcctaaacaaagcacattgatgttgtttaaacttttccagatgacccagagttatgacacagagtactaataattttttatttttatttttaacttttattttaagtttaggggtacaaatacaggtttgttacataggtaaacttgtatcgtggggatttgttgaacagattatttcaccacccaggtattaagcctagtacccgttagttatttttcctgattctctccctcctccctcccttcaccctccaaaaggccccagtgtgtgttgttcccttctacgtgtccgtgtgttccatcattagttctcacttataaatgagaacatgcagtatttggttttctgttcctgtgttagtttggtaaggataatggcctccacctctatccatgtccctacaaaggacatgatctcatccttttttgtggctgcaaagagtactaattattgcactgggctgtaatacagcacagtgatggcttcatgggcccacaaggtgttgtgagcagcttgccccttcactaggtgctccctttgagttcttatattagctttcatctttttcctccttcgggtcaggttgttagctgttattgctgctgtagtgagtctgttttcaaatttgctgtatttggtcaattcgaaatgtgaaaactgtagtcaacagtcttgggattgaaatgaagagtgtggaagtgctgagtgagagcacctctgtaggttatgtgcccgtgctctaaaaattaactttgtattgtctgctttcactgctcagagagtggtttctttatggttctcaaccaggatctgatcacttcaatctgggagataagcgacctgtctgtgggcaataactggccaggctcacacaagagcaataatgtaggtttttacttgggagctatagccactccaggtcccaggacacctagccagagagatatgagatagggatggaaggtggtaagcatagatgccttagaaccaaatctgtccctccaacccatcccaccaaattctacctgaaatctcaccacctggagcttcatctctgtcttctgagcttatgagctctttttttttttttttttttttttttttagatggagtctcgctctgtcactaggctggagtacagtggcacaatcttggctcactgcaacctccgcctcccgggttcaagcgattctcctgcctcagcctcccgagtagctgggactacaggcgtgcaccaaccacgcccagctaatttttgtatttttagtagagatggggtttcaccatgttggccaggatagtcttgatctcttgaccttgtgatccacccgccttggcctcccaaagtgctggaattacagacatgaaccaccgcacctggcatgagctcttttaaaataaagggtaatagctaagctgctaccagccatttataaccaacagcaaattaagactctgagggcacctgtaatagtgtcactaaagggaaaagcaagccaagtaaatcccaaaggcatacgtcagcctatgtccctactttgcttaggtcctcacatgtcttaaagagctttcagagcagcttggctaaacattgtgaaggaaactggccaagaaaaagtttggagggtttgtgtgtacatatacatatgtatactcacacacacccgtgtacatgcacatgctttttcttagaatacaaaggataaaggctaaactgttaccaaccatttatatcatatacatatatatatagagagagagtaggtgttattatagacagaaggcagaaaggatttggaaaataggataaaattagttacatgaccttttctatttttctttttgtttcttttttttttaagagatgagatctcactctgctgtccaggctggactgcagtggtgcgatcatagctcactgcagcgtcaaacttctggacttaagctatcctccgacctcagcctctcaaatagctgggaataaaagttcatgccactgtgcctagcattattattattttttttttttggtagagaaagagtctcactatgttgcttaggctggtcttgaactgctggcttcatgtgattcttcccactcagtctcccaaagtgttgggattacaggtgtgaaccaccgtgtccgtcctattctgtttttcttaagtgtcactgggaaacatggtcttccaatcaaattggcagtttaaccttggcttgaatgcaaatatgttgttattatggtccaataggtggtaactcgcacttgtagaatgagccattgcgtgtggaggctagagtcttaaactgagactcagtttctgggtaaattgaccattggaaggaggtgttgtgggttaggggctggtttattattcaggtggtcatgattatactcaaagaaaagttgttaaagttctttttatcctttacgtcctttacgtcaatggaataaagagcacactcaatgtatgcaggcagtctcacccatttagagctagaatcccaagccagaggaaggaaatcacaatagcctacaggggtggatggtgaggcctggattcaggggccatttcttgtgtcttagtcatgactttgggccaaatgggcactggatgtgtgctgagatgagctgtgctccctggagctgctttctgtaggagcaggactgtggtgagcatcgtttcctctgcagggccttctgagggaggagtttcttctaccctggaagtcagcttctgcttctcttcatcttgctggcatcttctctaccacaatggttattagtgtctttaatcttcaatcccatgggaagaaagagctgttatctctcttcccataaaggacactcagtcacctaagacatttctctgtagttgaacatagcttagttctcactcacagaatgacatttgaatagttctaaaggctcattgcaaacatgagcaccctacggtgttacaaagtccctgtggattggctggcatggctctgctgatagggctgagctcacctacgtgactctaatctgcgtgttgcctgagtccactcttgtttaccctgcactaacaggctaaccatgatgctgtctctttctggcaatgggagaggtacaagagggctgagcagaaacaaggcctaggctcagactgcccacaagccatctgccaaaccaagtcaatgagcaagcccaaaaccaagggaagagacagccagccaacttttagtggaaggaacacagatcagggaagggtgaagaatggggatgaataattcagttttccaggagcatgattgttgaattgaaaactgcaagcattcaggaaaatggaccggcattagggaaactacagaaaagacatttaaaaagaaagaggactggctgggcacagtggctcatgcctgtaatcccagcacttagggagaccgaggcaggtggatcacccgaggtcaggagttcaagaccagcctgctcaacatggcaaaaccccatctctactaaaaatacaaaaattagatgagtgtggtgatggtcgcctgcaatcccagctacttgggaggttgaggcacgagaatcgcttgaacccgggaagcggaggttgcagtgagctgagatcatgccactgcactccagcctggcaacagagtgagactacatttcaaagaataaaaataaaaataaagaggactaactaaaacaatgcaagaatgcagagagaaaggaagaagagagtaagagagaatatgagtgacttcaagatcaaatttgcgatctgatctttatataataggaatcttgaaaactataagatcagatgcagaaccattaaataaaggcattttaagggaaatcttcattactcaaggcaaaacattaatctgtagatctttagatttgggccccctagtctaagtcacccccagcaatcaattagattctcctaaagagatacataaactggttgcaaactataaagtatattagtacagttgtgccctgaaggtattttcgtccttgttgttgaactaagaatagcttgaagacactgaaggaggaatagagaatagtaaccaaagaacaaggaacatttctacaaagaaagactaagggaaattgggccatttagtttagataacaaaaggataatggtatcataactcagaacttcaagtgtatgtaggatctaggccatgtcttaattctttatgtgcaggccattttgaatatggcaaagacttcaaataaagcatgcaaatttctacttagatgtctatttccctagatacctcctagaagaaagaacataatcaccttttaattcttattctgtgattctttacagtgccagtaactgtacaagaagttccaggtttacagacatgtttttttccaaaatgttatttataaattggtggtggtttggaagggcgaatgttgttcctctgccagaattattatatgtggtgcttagcttttgagggcagcccacgaagaaggaaggaatggaggaaggaaggatggaaaaatgtaactagaatattaaaccctgggcattagaatcacttgggaaggtttttaaaaataagaattaccaggcctcattctaggaaatttggatttagtgatccaagtaaggagtcctgtaatctgttttttaaaagggtgttccagataattctgttgtatggtcaggttcaagaatgattgcagtaaatggaaaaaaggatagaccataaatgaaatcccattttaatacctagaaaccccccaaggagagtgggaagtaaatcatgtttataagaaaactggcttcacacacaaggataaaggacaacccaacccttgattcagactgtttctgagccttcctactttgacccaaggatatgtgaaacctgctttggggattcctgtaggtgagagtagctctggcttagagctgaagtctctcctccataggccccacagtagagctaagctttcatttgaagtggattagaaacagccttggtttaccaggctaaagatgatccaggtcaggaaaactgtgtgctttaccaaaggccagaaaattctaccattcttccaagatttcttgctaaaattcaaagtaatgtggtcttgaaggggtgacaccaaagcagctgcaaaggaagaggaaaacccggctgccacagtggagaaatagattgtcattcttttgcacagcttttccctgggtaatgtcaggattatatttttggctccctggaaaccagaattaaaataggctaaataagattggaattgttgaaagcaaaatctgtagacgtttccttttttgaattttttgaatgtccacatcttctgtatgctttgcttctttttggagtgacgtattgagaaagcccaagagattgtttctggcttgggcccattgccagccattgtccgtgccattattgtgtgtggtgggtccctggaggccacatgtggacctcgggttgatactttcggagattgtaggtagttcgagccacactagccctgtttacttcatgtctgccccaagcatcaagtcttgttgtttaccttgtcactttcccacttaagattctctttcatttcactgggttttactaaagtgtttgaaatacagggtttttaacttcctttgattagtgagaaatatggggaaaatttatctcccaaccttatcagttgggggcagaccaaccccagtgaagatgagaaacttcatggagtattaaatgaaaatgggatgagctgtcacaaagccaggatgttaattctagctctgctgatcatttgctgtgtgaccttgggcaagtcttttgctctcttcagtctcagtttcctcatatcttcagtgagccatctctcgggatcttccagctctggtattctgagtttctctaatttgaggagttggttagagatctcttttctcaacagtgtacctgttccgagaaatgttactgttatagaaggaagtggttttggaaacgggtcagagtggaggaaagaggttgagttctcaaaaaactaaaggctaggtataagtaactgattcatcacagagatgactaattcatcagaacagctgtctgttctaaaatatgtcacatcaaatattcattgaataaaatattgaagtctcaactgctaacctagagagagccaagcagcttttaaaaaatcaggatagaagtgtacttttcatttccacattggacctgtgattctctgagtacctgtgtgggtctctggtaaataccagaattcacttaattttccatattgttaggaggctcaaagccaaaggcgtagagacattaggcataagcatatgtatcttattaagcatctgtatgttatgttgtggggtttggcaaccaagaagatgacagttacttacaactgttctagaaaaggcaaccactgaaacattcattgaaatcacaaaggacacttgcttgagattcattgtgttcttcacatttgctatttttaactccatgattcactgttcttttgagcagggaggggaacactccacagtggcattccacatctgtgcacttccagccggggtccccaccccacgttcagccacatttgcagcccaattattgtttccattcttttgtttccttccaaaataaaactatatatgctatgtatacagtaaactatatagtagtgtctctatattgtgtaatatttcctgttttgtcactcccttctgggtagcggcctagcttttctgcctccatttaattcattaattttctaatttaagccttgtaatactcccatgaggtagtgatgatgatgatgatgatgaagagagaagagaagcacaggaggtgaagtaacttgctgcccccccctaaaaaaattcaatggaaggacatacaagatgaatgaaaaataattttaaaaaagtgaaagagcaagtatttgaactcaactctgcctaattctaaagcatgttctcaaaaatcccaacagaagttgttattttaagctaaatttttttgagacctctgatattgagtgaaattacactaacgtgcacctcgtgatgtaggaggagggacaggtaatgtgattctccctcctcaacctccacacatgcttcttcagaaggcggtgcatcagacgcaccatgactctggaggtgccggtcttcagcctattgtgggtggtcatcatgatggtgagactgcccccttcaggttctttcatgaagtgcaggtttcattttgggcttggctcctttctgtctcttttggaagccctttgttcctgattgcactttctagcctgtgtacagtctaaacctctgcgggaaacagtgtgtgcttctgaaaagggctccagcatagcaaactcactagaaagccggacctcagagcttgaccaaacttggctggagtcctagttctgtatttacaagttgtttgatcttggacaagccatgtaaactctctggacttaagtgtcctcgcctgtacattggggaaaactatacccaccttgcagtgctgttgtaatgtgtagaggtcaggtgtgtttgtgaagtgccaagaacagcaggttgtcagtaagaatagtgctgttggctgggcactgtggctcatgcctgtaatcccagcactttgggaggctgagacagatggatcacctgaggtcaggagtccgagaccagcctggccaacatggtgaaacctcttctctactaaaaatacaaaaaattagccaggcgtggttgcaggcgcttgtaatcccagctactcaggaggctgaggcaggaaaatcacttgaacccaggaggcggaggttgcagtgagccgagatcgcaccattgcactccagcctgggcatcaagagcaaaattttgcctccaaaaaaaaaaaaaaaaaaaaagaatagtgctgttcttattgttgtttcttccatccccctacagcagagtttcttaacagctgtgctattgacatttagggctggatagttatttgttgtgagtggctgtcttgagtattgcaagatgtttagtagcatccctggcctctacctagtggcttccaggggcaccattgccctttcccagtcatgataataaaacatgtctccagacattgctgaatgttgccttgggggacaaaatctctccaagttgagaactactgctcaaaagcctggcattatgtgtattgatactaagatgagaatctcaccaccgagtagttccagaatacagaaccctaaaaagatttatgaagataacattagtgattctcagtgcaaaatgacaaagtgtttcagttacttgaaaataaaaggcttctcttatgcactgagccatgaaagtctgttcagagttaaaaagaaatagttgcttttttggtttttgcattcagtattgtgctgcttttgcaaaggcaataattttatgacagttcataaaaccatggaatcttagagtatgcataactgacatgttatgcggatcaactcctatctgattcttgaatttgcaatgaacgtaatgagtgggagtgaaaaaacagtctctccccaaagcctgaaagtgacaggaaactcatttacttgcaaaataaaacccaagtatatactggaacaactctaattattacagaggatcctcctttgggatgaaagttttgttccctgcagctcctaccctctctctggtccctgccctatcctccaaggaccacacagaaaaagccctcttcactgactgaaaaaatctagatgcttagggtttgtggtcagctttgcaagctggcacaggtaagggaggaaacactctgaaattgcagtgcagcatttcaacatttcatgtgtgttacttagcaacaatagcaggaggcctgccagatgtaccagagtcatcgtgcctcgctcaggttttgtaggatccattataatcatctcattattggtctggcaaattgggtttatagtgcccagaactatgaaaatagtagttgaatttcttccatacactgaggccatgtaagagccatatttgggaaatacatgcatttcccagccctcagaacaattgctgcaatggaaggaattctgcaaagtcaacttttttggtagccagttccaggctttttggcctatgattgccacaccccaagttttctctctacaaaaagctttgataatagtctttttccaattttaggtcaccttgcatagcccctctggcttgtaacgtggtcatttccaaccgttctacattcttgatgaaatgaaaacagcaagcttcctgttgacatactcttccacagttttcatgaattatgcattttgaaggcagcagacaagatggtgtctcagtcctttccagcgattctccagcatggaggtcttatttggtacatccatcacaagggcccggagccaagatgatctcttgagcacaatccccacttcgtgtttccccttttcactgtgtaggccacagggaagagtactgtgggacccgaggctgcttgatactcatcaaggcccgcttcctccagccttcctagcttctctttccctcaggtctaggcgtggagccctccaggacagcgaacgggtgataaaatatacaaactgtctctgattatgggattttggctccttagccaatgcatgcaaggatggtagaaaaaacactcatcttccttctactatcctaaaagcaacttccgacatcaagaatttttttggatctctcatccaaaggtataaaccttaacagtgggaaattcagaccaggtgagaggaaagggttacacactaagagatgacttaggtttgggtagtttcatcaggagaggtctgcctgcatcctggttcctgtccttgttttgggaaactctttttagcatacttggagtacatattcagttaaacttgcaaagtgaagaatcagagaatggaggcctaaatgtgattcacctgaggccacacgcagagtgaggagataccagtgtgcttcctgcagaagcatctcccacatctctgccaagcctttttatctcctttgaaacagaatctctaatggaataaaccactccagggatcctagagtcttgtgtttgttcctcctatgcagaaaggcaaaggaaaaaattaaataatatctgaataccgcccagtgcacagagagtacctgtgaaattacagggacattcagccagcaaagaatgtccccctggccagggtgcctggaggaaggcttttaagcattaccatgctgtacagcatggggctgccagcttgaccagattctagctggaaggatcaggcatctttaaagaccggtagcattcagggccattgctgggccacatggctcctttgtgcaattagaaaatgcagttccacagggtaggcagcacttagaaagccactggctggacttcacctccctttgttcccttggctagcatcttgggcaacaacattctgtacaagcatgcaccatggccctgctggcttcttggtctccacgtgcctccttcttgttggtcattaaggttatgccattttcccccattattaagtaatgtcaggtaaggtctgaggagatggagatgaagacttttacaggtcgcaggggaacactgacatgtcactcatcattttgtgtgtgtgtgtgtgtgagacagagtctcactcactctgtagccaggctggagtgcattggcagaatctcagctcactgcaacctcccatctcctggattcaagcgattctctcctgtctcagcctcctgaataattgggattacaggcacccgccaccatgccaggctgatgtttgtatttttcgtaatgatggggttccaccatgttagccaggctggctttgaactcctgacctcaagcgatctgctcaccttggcctcccaaagtgctgggattacaggtgtgaatccccgtgcctggccatcacccatcaatttttaaatggtggagtagctcccatgatggatgttatgaaagggtctatgggtgcatatgaaagggagtggtcattactactcagtccaggtaaaactccctggatggagggtgaagacaatgtggtttgagttgttaggtaaatgtttccttatcatttttcattatatgttacatttacattctgttcatccctaagatataactccttaagattacatctctcagatgtaaactccaccagagtaaggactgtcttggttacctactgtgttcatttcctgagactgatgtaacaaatttctacacgttcgtggcttaaaacagctccagaggccagaagtccaaaatcaagatactggcagggctgtgctttccccagagcatctagaggcaaatccttccttgcctctctcagcttagtgggtccagacattccttggcttgtggctgtgtcgctctaatctctgcctttgtcttcacatgggcttctcctcttgtctctgtgtcttctcctttgtctctcataaagacccctatcattggatttagggccctcctaaataattcaggataatctcttctcaagatccttaaattaattacatctacacagacccttttatccacataaggtcatattcataggttctgggggttagggtgtggacatatctttctagggccatcattcagtgtactatatctgagtgcctagattactgttttacacctaggaggttgctcaataaatagttttcaatttaatttatatgtttcagccttagtttatccataagcttgccatgaggttcagaaaccatcatttatatccagagatggtataaggcagtggttaggggcatgaacatccgcgtaatacttgctgggttcaagttcagaatctctgcttgctgcctgtataatttgaggcaagttctttagcttctctctacttcagtttcttcttctataaaaagaaataataataataataaagatcaactttattggggaggggtgactattaagtcaagatatgcaaagagtacccagaactgtcttggactttgtgcccaataggttttggcttttattataaaaataaaagaatgatatgacaatgtacaatatataaacaatctcaaattgtttgattttatcagactccctctccactttcagaaacagctgagagggctgtcactgcactgagattagcatggcattccagaactcgggcccggtaagcatccaggtccaagggtgccttggaggggtacacctcacctttgcagtccagggcagaggaaggcagggaggctaggagtgcagcactgagagagcagtggccactgccttacaaggccaagaagcgtcccatctccccaacaactgtcaggttccttcctgccctgggaacagctctaatctgtctgtttaccacctacctgccagccttcagcaggaattccaggactgctgggcctatcagctgaagtagaggatgaaaaagaacaaatccaaaggcagaagaaataggacaatatgatagatggatttgacaagaatccagaccaattgtgggcagaccaagttgaaaagcgtgagaggctagagttatctcagcaggggtttcgttttgttttgttttgtttttgagacagtctcactctgtcgcccaggctgaaatgcattggtgtgatcttagctcactgcaacctctgcctcctgggttcaagtgattctctcgtgccttagcctccagagtagctgggattacagttgtgtgccaccacacccagctaatttttgtattaacaccgtagagatggggtttcaccgtgttggccagggtagttttgaactcctgagctcaagtgatccatctacctcagcctcccaaagtgctgggattacaggcatgaggactgtacccaaccatctcagcagttattttaaaaaatgtttagccttctgatgagaacacgtggacacgtggtgcggacaacaaacactggggccagtcgagggggctgcggggagagagatcatcaggaagagtagctaacacttaggtggtgggttgatctgtgcagcaagccaccatggtacatgttcatctctgtaacaaacctgcacatcctgcacgtgtaccccagactttaaaataaaagttgaaggaaaaaagttcacttttctgctttccagttgcttatttaaaaaaaaaaaaaaaaaaaaagaagcatctggctgggtgtggtggctcatgcctgtaatcccagcacttcgggaggccgaggcaggtggatcacctgaggtcaggagtttgagcccagcctggtcaacatgatgaaaccccgtctctactaaaaatacaaaaaattagctgggcatggtggcgggcacctataatcccagctattcggaaggctgaggcagggagaactgcttgaacccaggaggcagaggttgcagtcagccaagatcgcaccattgcactccagcctgggcaacagagcgagactccatctcaaaaaacaaacaaacaaacaaaaatgcatctaagttgtctgagtgatgtcctgctcaagtccataagggacttgctttattacagaaaagtggccaaacccagtaatattgaaagtatggtccagggactgcttctggtcaggcaactgtttattaccagtctgtgacaaagacagaaattgccagtaaggtgtttagaaactttaatagcaatatgatatcccaatgggtgatcaatggacccatcttactgaatagggtagagacaagtttgagtgtcgttgcactcacgtggtgagctgcatgtgtcgtgggctgagtgctagtattggtctgtgatggattgggatcagacccttgtccatgaccataaaatcttgagcaatattgcagcaagccaaatggcaaagatgactatgtgccccaagaccacacttttttttcctatagtttttttaagagagacacggcctcgctctgttgcccaggctggtcttgaactcctaggctcaagcaatcctcccatctcggcttcccagagtgctgggattacaagcataagccactgtgccaagcctccctaaatgtttaaatcttgtcattgccaccattctgcaagatttacctttgaatctagaaaagaacttggagtctttctactaggcctatccccacaccacttcccatcatagaggtgaagaacctgaggccgggacacaccacaggactctcagaatgacacagccagtcagattttcctggcacaaaacccagtgttctttcaaagccaccattcttttcctgtaactaatgcaaaagcaaatcttagcccatgacagggaatcacagattccaaatgagtgccctcagaatgactggtttccttgaaagcagctgtttcataaacatgactttgcgggggcagctcaggccttccatgcagtggagtctgctggtcttggggctgctctgttaagcaaaggatgggaaccaaaggtactgacattttaatattagccacacagatgtcttggcttgtaatctggagaaaatcagtcagtgtcccagctgaatctgtaaataggaacgacaataagatttgctctctctcgggacatcctaagaatttttgtcaggctagaagaggcagcctggagagatttgtttgatctgggaaagcagaagtcaaacttggtttttcattcggtaagatccactgtggttaaaatgtggtcagagggctcattcagcctcctacttcaggtcgaactatacttaccttctcttacttttaaagaaggaagggagattctgtaaatgagtggcttttcttttagtcagtgctgtcatatgccatgacaatattgtatttaagtctgttctcacagtgctaataaagacatacctgagactgggtaatttataatggaaggaggtttaattgactcacagtttagcatggctggggaggtttcaggaaacttacaatcatggcagaaggggaagcaaacacatccttctttacatggcagcagcaaggagaagcgctgagcataaggggggaaaatctccttgtgattcatgcctgtaatcccagcactttaggaggttgagttgggtggatcgcttgaggtcaggagtttgagaccagcttggccaacatggtgaaaccccgtctctactaaaaatacaaaaaattagctgggcatggtggcaggcacctgtaatcccagctacttgggaggctgaggcaggagaactgctcgaacctgggaggcggaagttgcagtgagccgagatcacaccattgcactccagcctgggcaacaagagtgaaactccgtctcaaaaagaaaaagaaaaagaaaaagaaaccattagatctcatgagaactcactatcacgagaacagtatgagggtaaccactcccatgattcaattacctccccaccaggtccctcccatgacacatggggattatgggaactataattcaagatgagatttggatggggacacaacgaaaccatatcaaatattaatagagtctggcagggaggaagcatgacttcatactggtggtgagtcagaaggggcatcttcatattttaaggaaggtggcacttagattccaagtgcgtcctgtgtgcagtggagtcatatgcagctctaataaagaacattattcaggccaggcatagtggctcatgcctgtagtcccagtttgttggcagcctgaggcgtgaagattgcttgagcccaggagttcaagaccagcctgggcaacatagtgagacctcatctctacaaaaaatacaaaaattagccaagcatggtggtacatgcctgtcgtcccagctactcgggaggctgaggcgggaggatcacttaagtccaggagtttgagtctgcagtgagctatgatcatgccagtgcactccagcctggacaacagagcgaggccctgtctccaaaaaataattaattatttaatttaaatgttcgaaagaacattatgcagatgcttctcaggcttctcttcagatggcaaaatctcactggttttcaaatatcctaactgaaatgttcagttccagctatcttttgcttcatccagtaattagtttcaagtttttttttgcctctttttagatatgaatcccatgctaggtaacaaattatagtgacaggaaaatgtggatttttccataaagtttaaatattcaccactcaaccttttagcagaaagctctgggaccaacctagcataagtatagagttgagggttaagagtaagcattcttcccttcgtcacttatgtggccttgaaccaattagttaagattttgtgcctcattttcctcatctgcaaaatggaaataatcataaggtatactttggggattagtgtgaggggcaaatgagttaacatgtataaattgcttaaaatagtatttggcagccaggcttggtggctcatgcctgtaataccagcactttgggaggctgaggcaggtggatcacgagttctggagttcaagaccagcctggctaagatggtgaaaccccatctctactaaaaatacaaaaattagccgggcatggtggcgggtgcctgtaatcccagctactcgggaggctgagacagagaattgcgtgaaccccggaggcagaggttgcagtgagccaagattgcatcactgcactccagcctgggcaacagagggagactccatctcaaaaagaaaaaaaaaatagtatttgacaatgacgatagctgctgttattatcatgacccaaatgctatatttgcttcaagcaaatggaatgattctcagaccaaattttttcaccaggcatttattagaaggaggtttcatgtaattctgaattatgctccgaatcatattcacttcattcaatatgaaaagcaagtatagatttacagtttaattgttttgagacagggcaggattcctaatcacatttttagaaatgacttttgtgtctcatattgttcatctcctctatcctctcaccaagattccactgtgtttcataccagcttgttcagttgaacaaggtggagaagcccatttactgtttggattaaatttttttatcaccagtgtatgaggatttgcattaaataaattataggtaattacattaacaaaccaagaagacttacagttaaagagggcaaaaatataatttacttaactgctctatgaaatctatttgtggatttctctcttctcaaaggagaattaatcagagaacaactttgttgttattgttgttgttgtcgtttaagaaaaaaaagaaagaatgaatgaaagatcacatagtagcagtggtaccctattcaccttgcaacagttgtactctgcgcacctgccccaggttatagcaacatcaaggtcaagctcccaatatttcaagtacaaataagacttcacctgtgcacaaacatgtgcttacacacttccatcctcctgaattttctttccagactgttttacagataaggaagcagctctcaaaagacctctctcagacatttgaaaacacattttttttcagagtgctaaattcatgcttcttattttatatatgttagaaataaacacataaataataaacagtcttgcctggactggttcatgttcaattcataggcactgagtattctttattaggacatactcactattgtttgttgaattattgcacttttaagaaatcaatctgaagattaaacattaggagtctcgataaaaaacaagtctctatactttatgaagatcttaggaatttctaactgactttggaacagccatttgttaaaaaacactttcccatcccaaactccactgactccatttttcttctgcactaactctcccttcctcctcccccatatttggagcagcgtctctatgtcccattcactctcctacacctgccaaatcaccagtgactatttaggggctaagtgcaaaggagacttctaaatcctcactttcatcaactgttgagcagcaacggaagctgctgaatgctccctatttcttcttgaaacacactctctccttgtttacttgagatgacactatccttcctctgtccatctgggaaatattggtgctttgaggttcttgacttggggctcctttcttcacttctcccattctctgagtgacattgtctgttcccatggcttctgaaatataggcattctttgatctaattttttctccagacctacccatatagccaactgccccctaaccatatccatttggatccccccagacacctataactcagcatgctaaaaattcattagtcattactttctctgattgattccttttcattgattcttaatctcattgaaaaacatcaccatgcacccagttgcccaagtctgaaatcaggacattgtccttgcttcttttcaccctttcaaatcctctatctaatcagtaattttatataataaaaggattcttgattccttctacactttttctttcccacttccatgacagtagtccaggccaccattatctttcatggggattgatgcaagagcttctcacctagtctcccttcccctagtgttgtgtccttctgacctaacctctgccacccagcagaagtatctttcaaagttcatatttgatgatgctactctccagcttcaaaccctttacctgttttccttggactataagataaagttcaacttccttaatttagcttagagagtcttttatgatgtgacctcctcttacttctctggccttgtctctcataattgtgtcattccattgctgaccactccagcaactacctgccattccttggatgtaccaagctctgtctgtgtcccgttctttggatctactgtcccttctccaaggaacgttcttcagctgctctttatgtggttaactcctactgaaccatcaagtctcagctgagataccactttccctgagccctaaaccctggtttaatgtttcctgtgggcatatttaccttagagcttactgtgtcatagtacattggaagctgatttttttctctatcctcctctagcctcagctgcctaggggtaaacacactacagtgttcacccttgtattctcagatcttagtacactgccaggctcaatgggttttcaaacatatttacataaagaaagaaaacaatgacaaaagtgcagatgacatgcccatggatactctggacataaatgcttgtaatatttctctctgtaagcgtttccagtgggaagttcagcttttgtctcaattactctgattggcatgcaatcatgacaagaaactaaaggaaggagattgttttcttgacatttactgagaagtatagacaagtactgccatgaacaaacattcttgctaacaattcttgctctaaattggttgatataacatccacttgagtcaaaatgattaagtaggtatccattgagtgtcatgcatcgcaatggcaaagcattggagttacagaaaataagtaaaatcatctcccttgctcttacagatctgacagtctaggcacccaatagatgggtaaacaagtactgagagatgtcatacttgtcctcaagatagtagaaattcaagaaagtagtgaccatggaggaccttaggatttgggcttttaccccagtggtgtttggctgagttaatctttctaaaatgtattcatcattcaatcaagtgcttcttctggaggccaagcataattagagatacagagatgaaaatgacagtcattaccctcacaagacctataatctacccaataataatgggaggcaagcctttagagttttttaatttggagttttcagagatttcctgaagcttctggactgacgtttctattgtacttgagtcccatcatttgacattagaagatctccttccaagaaatatttcttaccaccaaaagacagttaactttgacttcagacagaacattctggtctgcacccagaacctttaatacctgaatcttttaaatcagtgatggtctcttcttctaaaaagtaaaaggtaaatcaaattcagtatgtctcaattaattggaagggagtttcaagctcataggaaatgaactacgaagccatgttgggatatgaactgaatggttgctattgagatggagcaaatgtacctggatatcattaggtggaaccagactggaaaatgggggtccttccttgacctcagtgaagatttggccctttcagcctcaagtagtatcccagctccagaactggacctgagttactggataatgctgtcattaggaaactgtgaccacctaggagttggactgctaaatgggcaatgtcagcaggttgttacagatactctatgcagaccaagcttatttggctcttctcagctcagccacctgttgtaaacagctgagaggggcttagctccacgtggaggttgtcactatctctggtatgttgtctctccctgggaacggacatgagtgtggaaacagggaggacacagttgattcctgctttcactgagtcactctgtccattaggagaaacagtccaggcatggccagccaaagggaggttcttcgcaggatcttctgtctctttgaagatgggataatctcaggcctaaccacagaagcagttctggagaagagtcagaatagcagattggaaacagctcacaggggcctctgaatgctaagtggagggacttagaatttatcccagaggccacagaacactattagaagtttcagaggtataataaaggccgttgtgaggttaggatgctggttcaatgtcacaattagagcaaggcaggaggtagagaagtcaagggcagactgggaaccagctgggcaggccactcattttggttgaatttggcaagactgaggaagacaatctaccaatagaggatggatgagaacaccagaaagcaaataaaacaagtcattcaaaaatcccaagatcatcgtggctgggccagagaaagaatcagacagaagcagcgcacggctctggagagttgcagggagaagcattgctgcatccgctgtctccttttctttttctttttttaaatatcagcaatatcttggatctgaatagagttctatcacagattagggtttctctttccccagggttcccaaagactgagcaggatcttattacagatgcagcgaaaagggtacgtttttcagtatcagactgacctcatctgaatctcagcctcacatctcattaactacatgggaccttgggcaagctacttcacccatctgcaaagtgggaatcaatgatatgtatctcatttggctgttgtaaatcttaatcaagttaatatatgtaaagtgtctcatcagtgcctagcgcatagtgagttcccagcttctatagcaccctttcatctttctctccttacagcatcagagagcttgtcctctgtggctcccgtttctctctggccagaggcagagcctccatgggagcatgggagggatataatcagaacagcagcattctttcattatgacgtcaattcagccatccctcaatttactgagcccctgaaaggccatacagtgagccatcattgtaatgaagtaaaagtagctggatactccaggaagcccttctagtggcactttgttaggtgagatgtgtcagcattgacttcttttgtaagtgctacttctgttgaattcaatgcgttgaaaggtggaatgcattgatgaatgtattcagtgccttggccacttctcagttagcttttagagtagaggacctcatggccacatgacagagtctaactgtcagtttccagacatttactgtgcccttggccctgcttggactttggaaatccaaagatacatatgaccgacgcctgctctgggaggaattccctgtccatgtggaacacatctatgcccttctggtccaagtgagaagagaacatgaaggagcaagtgtgcatgcccataagtgccggtccctactcagttctcactcagtcccacagatacccaggtctactttatgtaggtccttgtgttggtttctggcattgctgagatgacagaggccccagtctctggagcctcagagatttcatggacacctttttctgcttgagctcatgagccagatatcactcctggcccaggtcactgggttaccagatgcacgggtgaaagagctgctcttgagcaaagggcctgggacacacatgccggagaagcatggtgagccagccgcagggaggaagagcactttgcaggagcatgctgtgcggggtcttgctgctgcttttcagaagcaggagagccatgagccttggggttcacatcagcaccgagactggcctttggtggcagggaggatatgcgtaccgggaggggttggccatactggaccacagggccactggttgggttgttcataattgatctttggggacacttactgcaacccatttattaggtgccccctctaaagtgatgatctcaatgaagatggttcacataggcccactacttctagaaggcccgaatccctggaccttcccaaccactttttctccctgttcctgggttacatggcttagctggatatttttgcacacagcattaagggcaagtgcactgttcctttgaaaacaacaagggaacaaggagttcagtgttgtggacatttaatgaactttctcctcctaagtacacaataccaaatcagcagaatcacagctgtctcctcccagctttacctaaattcccacatgtgctacctcagttagggaactatgacttcacctgccactagatggccctccatgtgcacataagccgctcccacatagcgaacttgcatcagattttctggatttttttttttttttttacatgtagacacacatgtgcatacacaatcttaacttttaccatccttgaagccaataatcaacactttagttttccttctggcattcaaatgatagaatgtattctcattctctggaaaatcagtttaacatcagaatctacagatattcctgaatattgtgggccacaaagcacatattaagatgaatttgaatttattctattaaatagtatgctttggtttatcttataaatgctgtatttaacagacttgtttctaaattaaatttttttaaagcactggaagagaaaggaagcacaaacatttgaatagtacttgctccatggaggcgggcagtgttctgaggtattttaaacattagctcatttaagcttcataactttgatgtaggtattccatatgcatcattataaccattttatagattgaggagaaaatcagattgcagcatgaaaggtgtttagattcccttttgccttcctgtcaattttcttacctataacatgggaataaaataatccctaattgctgtgaaaggatgttgtaaactctaaagcattacacaaatgttgttattattattatgacttgggtttcatgggaatataattttcttatgtgctcaggaggcttgtgatcattcattcattcacatgaaaacatttatgcaggtcccaggtcattgcctctgcatgagacgtctcataccgagatgcctgtactatttctaaaacaaatctagtctgtcttgaactctcttatagctgagggttccagggaagttgctgtgtgctttcagcaggtaattctcccttagtctcaggatttagaaatgatggatgtggtaggacaacttcaggggtgggacctctgctgaacacagaggtggccggtgctgatttcacataagccaagccagcgggaagaggcaggctgttttttaaaattattattctggagcacgatgtactatctctgtatccaagagttcacatttcaagtggactatcagatcatctctgtgacagagggctttaattaaaagcataagtctctgggtggattttaagtggcattgtttttctttggacgttatgcaagccacttctgtgctgtaaaagggcttttaaaatttggcttaaggaaatttgctttacccctcaggctttgatccctgcgtgtgaatcattttgtatctggaggttccaatttgcagtctcctgggtgtaaggaaaattctaccctcacagaacattttggatttgaaaactgagaaatctgcatcattctcgacataatagctgttgtaaaatagaattagggctgttaagtctatagggataaagttcaccaaagaatattttaaactttagttttagttcctaaagtttttgtctccaactcccataataaatgtactgggacagtgacctacccactcaacacctgaagctcagtgttctctgcactcaggccaggtggactcagccatcgaggccattgtccctgtccagcctcccagggggcacgcatgagccagggccaggatacagatacttctgcctcaacaccatctgtaccaccagaaaagggccccaaaggcccttctcactgccatttgtaaggcaaaatgtctctattttatctaagacaggaaaaaggcagagagatgccagagagaatgcaacgactgtgcccgtgagaaaccaacagtgcagggtggcgatctacccgcagcacatgcaggatgcagcgttagatgctgactcagtttctcagccatacaggagaaaagtttcagcatttctcaaactccatgaccatccttcagtcggctaccccaagccccgttttgctgcagccgggtgagggcagtaatgcagctcagtaggttaaggggccaggctgtccttggacttcagatgatatcagttcagtccctgggacatcttaaattagggcctcaagcttcaaattcatgccttggccaacacgttaccataaatgatcacagggagaagaaacagtcaggccagggatggtggcaggttcctgtaatcccagcattttgggaggctgaggtgggaggatcacttgaggccaggagttcaagaccagcctgggaaacatagcgaaaccctgtctctactaaaaataaataaacaaataaacttttttacaaaaaagagaagaaatggtcagtttacgttgcatttccttcttttcctcaagaagaggtgccccgtggtgcctgggacagctgggccatcacatggaagtggctgagaggtgggctggaaagaagaggaaaatccagggctcccaccaaccccagccaatctctagtcactgggcaacctcaatctacttctggtcatagttttacaattttgcgggggtaggggggatggaatcttgctctgtcacccaggctggagtgcagtggtgcaatctcggctcactgcaacctccaactcctgggttcaagcaattctcctgcctcagcctccccagtagctgggattataggcctgtgccaccatgcctggctaatttttgtattttccgtagagacggggtttcatcatgttggccaggctggtcttgaactcctgacttcaagcgatccacctgcctcagcctcccaaagtgctgagattacaggcatgagccactgtgcccagcaatagttttacactttaatattgccaactttttttcagcccagcctgtgcagccacacaaatgcaaaaaggttagcttaggaagttgtcaacatcattatactataaaaatcaataaatggaaccttcttgcttcccacagtagtccatgctaagcttggcttcaccatcccttgcttggacaactcctaattgttctttatggtttcactctgtaaccctttcatacatccaaatccgttcttttcacatctgtccacatggtctttctagaacatagccaatcctatcactgacttaaagcaaacacataaacaggcagacagacaaacaagaaactcaaatggctttctgttactttccgaatcagactcattagtgtggcattcaagagccatcatatcctgagcctgatcctccctgtcactttctttccctcatgagtgcactcagataggccagtcctacagaggtcctcattcactcacttgagcctgccttgcacatttctgcatcaaagcccctttgtccatgttatcatcctagcttgaaatgctgtctgaacacctctatgccttgatcatttttctcttcaagatcctactgacatgttccaacctcctgaaatcctgccctgcctccccacaagcagagttactcagactctcttctttgcattcctgcagcattttggtcttgcaatttgagctctactgtgcactgcattgtaactattcatatagcttcctccctcatgagatgatgaatttctcaaaagtagagactgggcagctgttactgaatatagcccaacacttgcttgataatgctcgataaacatgaatgagtgacccagaacatttcaaacttcccttccaagacctgaaagactcatatttctgggtgttttaagctctgtgatttctgctctggtcacctgggccaggaactgcctgcctctattttcatttcaggcctttctctctctgccagatgccttgatctctgagccgagtataccttgacccaaagccatgatgcagccctcagcttctgagaggaaggggtagggttcagtagttgcgcctctgagaacatgacagagaacaatagcaggaagcagccaagcgggaaacaatcagcccggcacaacccatgtggaggagcttcctgattggcttgatctggtgggagcaggaactcttacaataactctggaattatcccagtgggatgacaaatttctccactgaggagaagctgtcacctggtaatgtcaagcacggaaaacacagttagcaaaaaacaaaacaaaacccaagacaaagttctcttgaggaagagcagtttggatcagttggaagcctcccagccactgccatagcaccccatgccgacctccttcctagtctctgtttcaggtacaattaagtcgtcatctctaccttccggatagatatcattctgccgtccatggctcaaaggtcagaggtgctgtttattctttggtgtccttttgggtagtttagggaaatccatgctgtaggtgaccacaagagagaatgttcccttttagaactatattgattgagcacaggctgtgtgcaaatactcttctaggcactgtggatgccatagcaatacatgctgtttctgctttcatagagcagtgatttccaaatcctgtgtatcctatggaaagaccaagccaggcaaggggtggagtgacaggagctcccagtcagctttctccttaaaccacagcagctccctttgatcaagatgttggaaaagaaaaatctaccccaaaaagaggaaatgctgaaaacatttggattgggagtggtttcatttgctcttaggcaggacacactgcagggtagcagttaatattctaggctctagctacaagcagacctgggtttgaatcccagctctgccacttactggtggaaggtcataagttgcttgaactctctcaacctcaagttcttcatctgtcaagtgcgaataacagtagtagatattttaccaagtgcaaagaattgaataatgcttacaaaccatttagcatatcatctggcattgtctattacagtaaatgctcagtaaatgtgaactattttacccctgttgtttgacgttaattttttttcaatgaatgactcattgagatactaactcatgcgtcttgaaaacactaccagtctctccagagtaacctccaatatggacaacaggcaaaaatatggtgattattcccagtttgggcatttgtgaaagatgtggctgaggctgtatggatgcgtgtgcacacacacacacacacacacacacacacagaggccgatgggaaaatctaactcagcaggaaagctatcacagagcgctggatttaggcacaatgagtaaacagggatttggaagagaggaatgcaccacataaacaattttcacaatctggtatgaaagcccagatgcttcctgcatgaaggggtgaactcagagagcgtcacagggcaaaatgaagtaaatgctgagactgtccatcattctggcccaattcctacatatctgtgcatcttctacttatggttttatttaggtgagaataaataagagtacctcatagtagataagaatagtacattacacacgcgcgcacgcacacacacacacacacacctggggttagatgaaattgtatatttggggaacttggggtaaagagtacagagccacacagcagttaccttctgcatcctcctgcttcagagaaagcaaataagaccagtttctttttaatctgttgtttttactaagtccaggattgatgttaatttgaatttgttcttttaagattcatttttgactgaaagaactgagccggaaggtctgcttgaggctacttccagttgagaaacaatttatgtgttcattgagacagtcatttactcaaccaacacttactgagaactttcaatgaggcaggttccttgctagatacaggccagctagatgctagaagccatcatcaaaggaagatgaaaaagtgatggtaattatcctctagaggtttgtaaactggagttagggaagggagcccaaaatccatgaatgagtgattaaaatacagtgggataaagttggtggtagaaatatgtccatgagatatggcagcaaagaagaagagcaccttcatgggaaaagtccaaagaagacttccataaagagatgatacctgagcagatgctttaaaaatgagtagtaattacccatgggaaggggaagagagagaacaagggcaatccaggcagaggggtggtatgagcaaagtcattgagccaaacaaggaaatcttcatttctgcaggtaaatgagaggctgggagtgtgtcatatccatgagctttagcagagagcccatgaggggttttcagcaggggagtgctattgtggtgtgtctaggcacattctggattttagggtgatggggctgcatagaagcagagagattggttagaaggttgttgcaggcatttaggagagagcctatactagggctgaagagaagcagctatgaaaagagatttgtggggcaaattggcttggtggctaataagacacttagttgacctggtgactaataagatacatgtacgtgatgatagtaagcgagggtcaagccagaggtgaagacaacatctaggtttccctcctaagtagaatggattaacggtggtaccagcatctgagctagagaatagggaggagcagctctatggagaaagatgagtttggtcctgtatatgttgtgtatgtggaccatccgggtggagacattcaaaatacaattgtacataaaggctggagttcaggagagatgctgaagatatagtttggatagatttaagcatgttcggtaggaattaaagcatgaggctggacatgagtagccaagaattaaatgttaatcaataagaacaataaaacaaataaacctttagtggtagagtaggagaagaggtgcccatatggagaacatggcgtcatggtctcttcatcatggaggaagagtgatcaaatatgtttttaaaaacgaagaagtcaaacagatccacaccaaagagggtccgctggacgtggcagtcatggacttgactaggagcagacgcagcagggcatgagggcagagggactgaggctgaggcatggacttgactaaaagcagatgcagcagggcggtgagggcagagggactgaggctgaggcatggacttgactaggagcagacgcagcagggcggtgagtgcagagggactgaggctgaggaggggtcaggatgtgaggatgttgaggcagtaagagatgactggccttggggaagtctggaagagggattcagcagcaactagaacaggatgcagggtcaagagaagttcacttatttttagtatggaaagagataattcttgtttattgactagcaggaaggaggcatcttggagagaggtgaagacacaggggagaggggatagttaatggggtatcctcccagatcagtctgcacaagctcaggtgcaggggtggaggcgctggccttcaacagacagtctgagtcagaggctggaggtcagaaggtgtggctggatgggactttttctcttcctagaaaaaagggacatttttagggggaaaaggagggggtttaagctattgagaaaagtactgctttgaaatgaaataatctcactttcctgtaatcaaaactctttatttctgatgaaacagactcaaataagaatcacaacaaagaaatcagtgctcagctcaagcctggaaatgatttcctacacggaaatccacttgcacagattctgatagtgtgagtcatgtgattccagatggagtaaatacacatgaaaaggagagaaaagctggtgtctccatgggctgaagcacacttatggagagagaaattttcatttatttgtatttgggcttcaatatgattacatcaccatcaataatgaaaagtgctgccatgtcccagctgtatacttagatcaagatataaatcagtccaatattgttcttttttctcactgaatatctaaatttgtatatttgaggggaaagtagaaaaaccaagccaagattttaaaaattacatttactatcaccatctccaagttacattcactatagaatcctttagaagcatgttcttgggtagctttgctttttatgcactcaacaaatatttattgagcatctgtatgtacagggaagaatgtgaggtacagtaacacaaaatatatagtcctatctcttaataagcctgcacttgggagaaggtatagatagggttgggaaggataaatatatttttaacactctaatacaaggcagagtgtaccaaaagttagaaatgctgtggagaatcagaatgaatgaacataccaggctgggttggggggctgggggaattatggaaaacattcctaaagagatgtaatttgatttgggcttttattatgatatctgttttcagacaatggagttgagagtggggagtccttcctggctttgtcaggagcagtttgaggtcttggctgaagacaggaaggcataaggctggaaaggggtgggagcagaacatggagggtgtgaacttccagccgaagaagtttgatggggtttgggaaggaggtgagagggagccaccaggaaaggatgtgagctggacctttggaattcttaaagggacccttgtcttctctgccatatttctgtctcagggatgacgtgaggaaaaaaaaaaaagaggaggaaatgggcttgagtttccactgacaccttacagtcaaggaaggccctgttctttcataaggaaaagtggaaatcctctgtttacttaagggccattaacatgttttcatattaaaataccaaatgatctgccgtgactccagatagactcatctaaataaaaggaagctgtttccttacaaattgagtcacaaaggataaatatttgtggagtgccatagaaacaaatgcgctgtcttcctgaaatgtggaaaatgaattttgtagcattgatttgcatgaaaacaatattcttcccagtgttctacctagaatattgaaatggaggtattaagatagatgatagataggacagatagattgctagagagctagattagatagatagatagatagacagacagacagacagataagatagatagatcgatgaggttaaatattcttaggatggaagaaggggtcagataatcacatctcagacagatctggaattccaggcagcaggaactaatgaagtggtctcttcagagttttaccatgggacgaattcacccccgattagtttttattctttgagtcacttctctcaagacaaagatctttgggcaagagttcagttggcctagcttagatatgtttctactccttggccagggatgtgagccttctgaccaatagtttcaccaaatctacaaggaaccctagagagacttttttcccagtggaggagctggatgttgttcctaaaagaaaagggcagagggaccctgggcaggcaaaattttcagctgcctgccaccttagcccctgtccccacactcacttctgaaccacatgtgatcagtcttctcttcccaccacataactgaaacttcaaggtcatgggtgagctctatgttgttaagtcttatttataggagcgatcagctcgctgcactgcaaggctggaaaggtgtttaaaatgtatacttaggcatgtcttggctctttctgatataattcagctggcaaaggctctggcaggaagccagacggacacaaatagcgcaccaaagagatgctaagacatgggtgattataattgtgcaaggagtagaaacttctctgctgagactttggatgtggcagagatttggggagtagaaggggggcaaagcacagttccagccaaccccatttacaggcgttgattagcagtaatgaattcacaaccttgcaattgctcatttttttttcttctgctgctgagtcatggataagactctaagctctgattagctgtgatccctaattctcagcacaattctaagagcattccttcaaattcaacaatatgtggtaagtgtcttgtattaattaggattccatgtggatgcaaggaacagagacccacaataacagtggcttaaacaagatgcttatttctttttttttttttttttttgagacggagtctggctctgttgcccaggctggagtgcagtggcgcaatctcggctcactgcaagctccgcctcctgggttcatgccattctcctgcctcagcctcccgagttgctgggactacaggcgcccgccactacgcccagctaattttttgtatttttagtagagatggggtttcaccatgttagccaggatggtcttgatctcctgacctcgtgatccacccacctcggcctcccaaaatgctgggattacaggcgtgaaccaccgcgcccggccaagatgcttatttctcccttcaataaaaatccacaggtctgcagttatgtaaacatccacaggcatgcagttaagagctgtttggtggctgtgccctgtgaattccttagggacccagacctgttccactttaaccctaaagactgatccttgtcaacagtgaccaagatggcagtttgtgcctcagctgcatacatgtgcatttcaggcaaaggatgaagaaagaactggagaagaaagggctaaagaagattctaggagctgacatatagcactttcacttacatgcctttggccagagcatgtggctacaaaggatgctgagagatgtggcctttactctgtgtggccatatgcccagctcagccacaggaatgacattgctttgagagaaggggaggatggaaattgagcaacttagcagtcccctttccacttttacttgtgctgaattcataaacatgtgggcagctttcctctcctctgagcagcaaacacttcttctgaggttcttgttttggcaggttggccagacaggcaccccacttgactgctcaactatgaaactgcagttccagagaagagaacaggtctgaattaagcaccttaagccagttggtcagcatctccttttattcggagagtagttactgagattcaaacccatgtcaactgagtagcaatgtgtttggctatagggtagggcgtaaccctagtctatgtctctcaatagtgagttatttcataaaggctcagcccatcgtcaggaatatgctggtcttgcgtaagcctttttcagaagtgttcatagggtcctgagaattttgtgagcacttctttactgcttctcttgcctcctcttttagttggtgctgagttcactgcatgaagggtcccaggagtcctctttccccttggtttttctactcctttccttttctgctctttctaccacctcctactgctggacctctttgtatctgtactccaccatggaaaataagttttgtttgccccagatcttcccatttcccagagtggagcctttataattcatgatgtttactaaacttgatctctgccctttcaagggatggaactcagataatgaaagatatagggagggatacattgcttaaatctgtgagtgggcattacgatgggcctaagtgtcccaagagggattggcttgccatgggaggtggtgagctccccatgtgtggagaagttcaagaaggtgtgaaataatcgttgggtggaggacagttcaaggacttcatgtttctggagagcaattaagttcaatggcttctactcccagtctgacctgtgcttctgtgagcttgaaaaatatatattgtgttgcaatgtgcattctttagggaatgaaggtaaaagggcaagtggtcatgggaggatgtcaaggataggggcaaagggtactggttccccagccagaccaccagggtccaaattctggctgcacatcatctctgcaaccctggacaagtcagtgctctttctgtgtatccatccatctgtgtcatgggagttgcagatttttttacttcatgggatattgtgaagattaagtattataatgtacgtaaaacactcataacagttccaagcacacagtaagcactcaataatcctaatccttatgattattattgttacatatattactgtatctagcaaaaacaatattagaattgttagtattataataattattatcatcattgatggggaaggaaaaatgaagcccacctgagttcacagacaagaccctctccaaacagtaaaacaattaaaaaccaagttgtatttgtctgtgctcctttggattcaactgaccaacacccaggcaaagggaaaatatattggcttgctttttttttttgagatggaatcttgcactgtcgcccaggctagagtgaaatggcatgatctcggctcactgcaacctctgcctcccaggttcaagcgattctcctgcctcagcctcccatgtagctgggattataggcacctgccaccatgcccagctaatttttgtatttttagtagagacggagtttcaccacattggacaggctggtctgaaactcctgacctcaagtgatccacccaccttggcctcccaatgtattggcttttgtaagtaagaagggcaaaggagtagctgaggatctgggaagcaggaactggagattgaatggcacgggtccccagcagccagcatgctctgtcttcccttctctttgtttgggccttgcaggaaggtaggctctcagcagagccttgaaggccaggtatttgagagccaggcaagtgaagcagaaggagagcatgagtgagccattgggagtggggacggaaacggcgagaacctatccaaggcaccgtgctgagctatgaagctggagggcagcgcaggctgtgacccaaaaaggccacacaaggccacatgctcctgagtgacaggagggacatgtgatatgctgggccttggcccatgctgtctcctctgcctggctcattttctcctcttttctacctggtgaatgcatccttcaaggcccagttaattcatcatctactttgtcgagtttttctcaccacctgtatcagttgagaattgcattcagctatgatcacaacagaggcttaagcccataacaagcaatctggagccaggcattccagaagtggtgtactctttccatcgtgccctctgggacccaggcaatgtctctctttctgcacactcagacatactattgcccctgtggacataggattactgctctgcctatagcatcatatcccttgcagtaggtagaataatggacccccagagatgtccacaggctaagcctcagaacctgtgaatatggtaggttccatggcaaagaggaattaaaattacagatggaattagagtttccaaacagctgactttaaaatagggagatcagtatcctggattatctgggtacactttgtataaccacaagatccttaaatgtggaagagggaggcagaaatcagaaggaggggtggctgcagggaaggtcagagagatgcaacagtgctggttttgaagatggaggaagggacccacaaggcacggaacgtgggtgacctcagggagctgaaaagggcaaggaaatggattctcccctagagcctgcagaagggaacacaacgctgccagcaccttgattctagcctggcaaaccccgtgtcagacttctgacatacagaaatataagataataaatgtagattgttgtaagccactaagtttgttgtagttgttatagcaggaattggaaacgaatgcgtctctttagcaccaggtccctgtacctggcaggaaggaaggaaaggcaaatgtcacttaagccaacgctcctttccttttttttttttttttttttttgagacagggtctcactctgtcacccagactggagtacagtgttgtgatcatcactcactgcagtcttgaactcctgggctcaagtgatcttcccaccttagcctccagagtagctagaactaagggtatatgtcaccatgcccagctaactttttattatttgtagaggtgggggtcttgtcttgccacgttgctcaggctggtctcatcctcctgggctcaagcaatcctccagcctcagtctcccaaagtgctgggattacaggcatgagccaccgcacccagccctcctttcccttttagggagttgtgtggaagtcccttcggatcatttttacttacatctcattggccagagctgtcccatggccagctttatcttcagtggaagctaggatacataatttttttcaggtgggcatgttgccatccccaaccaaataaggattctgttagtttggaagagggggagaatagatattgagaagaccactcagcgtccccaccacacactcccaggcagaaccaactattctacagcatgttgttctttcctctattattgctatttttggtttgtattgtaatttatgtgttcacatggctgtttgcattacttgaccaagaagtctcatgagcagacactgtgtctgatttatttctccatccccagtgctcagcatagtgcctgatacagagaaggtgtttgcatgaagttagatggatgaatgtctaaataaactttgaaataagagcatgatcgatgcacttcccagagcgagagttcctttctgttttcttgtgaggatgatctattggggttaggtacattttataagaccatttggccatgattgcaacctcatctccagtaaattaaacctacacagctgcagtgtgtcacctttccttatggcttattacagtttgctttttgctcagaaggaactgagcaagcaggttagaggctgttatgtgcacctgccacagcctacggatcctcaattaaccttgcgtgtaaattacacttcctgcccattctttatttttagcacagcaacatctacttggctcttccagagaagactgcattagatttcagtcatgaaactacaaaacagtggcgtctgcagcctggctgggatgactgttgttaaccccatgacactctgttccttgcgaagctgctttgccccaggactcaggttttcctgagaaagagagcagcctggactgaccacaccctcagagcctggcccaaggccacatgtgaacttatagaaaaatctgctattggatctgacataaactctccatttccttcattcattgcatttgggttgaaactcagttgttgttatcacaaaggtttcatttcgttccttttttttctctccctctctcttcgttccttctcagttacacagtatcatgacccaaatctttagcacctgaaccatatagcgcagagccttgaaacccatagggccagggcaccccgtggagacaggccagccagtgggcatcaggtcgcagagaattcttaaccacttaaggttgcttcactggaagaagtgagttactgagagacagccattttcggttttagtcagccatttttatcacgatcttgtttgttttagaatcccctgtagtgcctagctcggagtccaaccaaacaagctccataaatgttgattttgaatttaaatagatgttggggtgctcccatttccccttcactagacacatgggaagctgaggccctggcccctctttcatgccacagcctgggagatgctgccttctcagcagaaagcctcaggaggtattttgaaaagggaatttgttgttttcattctggttagataagttacaaactaattttttaaactgggaaaatattgaaaattgttttttaaaaatgaaatcacctttaattccattactcagagacaactatcactgacatttttctgttttttcagtcttaattctcatgaaggtgtgccctgtttccctccagatttctcagaggattcaggattagggaagggaggagagggtgccttatgttctttctaatcgtttagctttgggtattattgggatatatataaatacattaacacacatataaatatatgtgtatatatattatataactggcatatacattattgggatatatattagtaggatgtatatatatatatgtgtgtatacatatgtgtgtgtgtgtgtgtgtgtgtgtgtgtgtatatatgtaaaatgtatacacacttctatttgacctgtaccagttcattattaccacaataatgctaactaacacgccctcaaattcagtggcttaaacccaaagtcatttattcttgcccacacttctgtgagtaggctgggtatttgctgatctaggctgggcttagctgagtggctctaatttcaggtgcttctgaactatatagctgagagccctgaaacccatagggccagggcacactgtgcctatctatgggtttgcctcaggtctattccatgtgtgttctttctgtggtccaggctgaaggggcagcagctgcccagataagttattgtcttggcattggaaggggtgcaagaggacaagctcaactgggcaagcacttttcaagcctctgcttgtgtcttatctgctcacatcctattggctaaagcaggtcacatggctgcggccagtgccaagggactgggaagtgtaacccatctaccataagcctagagcaaatcacatggtcaagattgacatcagtggcttggggaagcatgtactcttcccatggaagtaagggaggaaggaagggaatatttttgagaataatgtaatcttttttttttttttttgagatggagtcacactctgttgcccaggctgaagtgcagtggtgcaatctgggctcgctgcagccttgcagcctctgtctcctgggttcaagcggttctcctgcctcagcctctagagtagttgggattacaggtgtgcaccaccatgcccagctaatttttgtatttttagtagagacgggctttcaccatgttgatcaggccagtcccaaactcctaacctcaggtatacgcctgcctcggcctcccaaagtgctgagattacaggcatgagtcatcgcaaccggcccaagaataatataatctactgcacaccctaaatatctgctaaagtactctgtactttgagatttaaatcaaatctgctcaggccaggtgtggtggctcatgcctgtaatcacacctcaaataaataaataaataaataaataaaacctgctcagagcccacctggttggtagtatcatccagtctacacagggaacctctagtccagagctcctctactcattgaattaattcagtttctggataatgtgactgtctcgtgtgttgttcctatttcacactcatgtctctttacttactccccccaaaataatttacacagatgtgtgtagaagattttgctgaacatctggaccagcaaagaagttttacatctttatgttcgtatctctagattggccagccccctctccataaattctctttgcgtctcgcccacacacagcctctcaagttaaagcttgctgaagaattcactcttgtctccaaaattctgaaagtcttatcttggctgggccacacctttgcgcaacttagctcagctttttaaattcattcaatgtaggtgtattgagcatttgtgccctctgtctgaggaatttataatctagtaggggaaattaataatgtatgttactatttggggccagaaaattctttgctgtagggtgccatccggtgcactgtgggatgtttaccagcatccctggcctctacccactatgtgccagtaacaccagtcccacccccttgagctttggacaaccaaaatatctctagacattgctgaatatcccctgagggacaagatcacctcagttgagagccactgctctaatatatggtagacttgataagacttctgataaaacaaaataatgtgctaagaaatgttcagagggaagcgatgttatttcctggcagtgaaatctgtgaacacctcatgacaggtggcatctgagctgagacttcaagaatggttgggagtttgagttgagtttcctagaggaggaaaagacatggggtacatgtgggcaaataagagtggctctatttgactaatgcatgaagtgaaataggcatgttgttagagtggagctgataggtactgggaggctagataccatggggacttataagctgtaggacttctacttttaccctgagtgaaatgacaaatatttcagagctgtgttcatttggaggaggttaatttggatatagggcttgccttcataacccaaagtaattgctgcaaagattatccctccagaggtcacttttctgacacccaggaaggaaacagaaaggccatctgaggggcacagtatgtcgctaaataaattcatgcctggatcttggtgttccttacctttcagaaaaccccactctgaactccttattttaggtctaagtctaatggccagttcccgagagcagattaaaagatggaaaaagagggccaggcacggtggctcacgcctgtagtctcagcactttgggagcctgaggcaggaggattgcttaagcccaggagttcaagacccacgcaggcaacatagtaagacctcacctctacaaaaaaaaattaaaaattagctgggcatggtggtgtgtgcctttagtcccagctccttgggaagctgaggtgggaggattgcttgagcccaagaggtagaggctgcagtgagctatgatcgtaccactacactccagcctgggtgacagagtgagactctatctcaaaaaaaaaaaaaaaaaaaaaaaaaaaaaaaaaaaagatggaaaaggaggaaggcaagggaggggacttatataggcagacacagactcagcagcaaagcttccagcacaacagaggggaaagagaccaaaagaaaaaatgaatgaatgagtgattgaatgaatgaaccaatgaataaattcagatcaaataattcaagaggcacagcaatctagagttttagcaagagaacatttatcccttcattcttcctgaagacattgctgcatatcagtgccatcctactctgccaatatatgtaatgtttaacaaggtgggggatgtggagaacactttagatcccatgtggtaagagttgctcaatggttaggaacagggtctagagtcagagcacctggcttgaatccttgcttcaaggctctgtggcactaaagcctgctttactaggttacttcaccttgccaagccctactgatctcatcggtaaaatggggattccctactcacagggtcattgggaagtttggataaaataatccacatgaattcttagctcagttcctggcacagaataagtgctcagtaaatactggtggtaattattatcatttcactgaaagaatatggctgttgagactttccccaaatcatagctgcagctgctattctggaatatttccagagtctcctggcagtgctgaaatttcccttttataaaatacataggatggctgtgaaaattgaggaaagttccaaaaggcaggggcagttgcatctgtcttcttcatttcccttctttttggcagtagaatccagaccacagagggagaggacaccaggctcccaagggtactggccaccagctatttcttggcaacatacttcctttgagcaagaatggccctttactttttgaccaacctgagagagcacttactctgagccggtcaggagaatatgaagctattttccttctgatgttatgtcctatgctatgtaaatataatctccctccaaataagaaaggtgcacatgcatggtgttggcagggaaacatcgaaacatattgcatagtggtggctgtgaaccagtggaggcagtgctgtgttgatttcccttgaccaatgtctgcccagtggcagagctggaaacacaagatgctgtgtaatgtaaaaccttggcctggctcctcagcgtaatgtaaaacaaaggctgccaggaaggtacaaatcgcccaacaggaaggagctgctctcttgcccgtggatggcaggacaataaagtaacttgtcctttgtttgtgtgttttccaggctggagcaagaaatacaaacgctagaaagtgaagagtcccagatatctgccaaagagcaaatcatcctagagaaactgaaggaaacagaaaaatccttcaaggactttcagaaggtgaagaaaaccaaaacgatttctcaaagttatttccatggggaagtagggcctagcaaaatggtgctaactgggaaacaggccagtgggcattgatgagaaatctgagccacgaactctatgaaatgaggggcagatgtgtgaggaccaggggccatcctgaagctaagcatgacatatctttgggtgtgggaccatctggcctgctgcaaggcatagggaagagtcattagattaccccatctgcctgctctccggatccctgatatgccttgtgcctgaaaagccttctcttattggactctagaattctaaaaccaattctgatgaagcagaataaacatgctctttgtggctttaattatagtttgctttttgagtctttcattataaaaaggccagaagcaacaccttatgaagtggacaagaattccaaatacaaagagtgtaaatacatgacattttactgtatatagaaacagatggtgcctgtaatcccagcactttgggaggccggggcgggtggatcacgaggtcaggagatcgagaccatcctggctaacgtggtgaaaccctgtctgtactaaaaaatacaaaaaaattagccaggtgcggtggcaggcgcctgtaatcccagctactgaggaggctgaggcagaagaatggcataaacctgggaggcggagcttgcagtgagctgagattacgccactgcactccagcctgggcgacacagcaagactgcgtctcaaaaaaacaaaaacaaaaaacaaagacaaacaaacaaaaaaacaggtggtgccgtgtatcaaagagtagagtccgtaaaaccagtaggctctgaacaaacatctcaggacctccctccattttataactgtttctgctgtacctatgagtgacagaaaagcaatctaatgaaatcaatttaggatgggattttctgatatcattctccagcatgaccaaggatatttgctagatcattgaaataaatctctattgggagaaatttagtataaattgggaattataattttggaattctaaataaattgtccagaagaaaagagatcgttgcgtttccccagcacagtcaaattctgggctggggcatgggagaaagatgggttaagtctttaaagatgggaaaagatgggattgtacccccacatgtagagtaacgctctgccttgtttttgttcctacagggtttctccagtacggatggaggtaagtgctctctgccccgactgtagatgaatgttttaatcctggtcagcttagggggtttcattaacaggggcttaaggaagaggtactgtgttgatttgtaaaggcatcagaagaagtagcagcgctggttgcaggccactgaggaggtccacattccaagccttccctgcctctcttcttcaggaactatctcttggctcactgtttctcctcttacaaaattggcctggctcttctccttcccattagtcccaacactcactgcttgggcctctcttgaaaggtacccagcaaagaagagtactaacatcaggacctggtcccttgtagggatgagcccatttgtcttggtggttaggtcctcaggttgaaacatacgtgagaagtttaagaaatttggggaaaatatttggtgtttgggaaacctttctacagcctctggattttctttgctttctctctctctctctctgatcagacaactgtcgtttctttcatagaaacagggctgggcaaaaacttccctccctgtgtgggatagttggttcagagcataggaaggtaggagtggggtcctggcttcctggtggcaagagcaggtctttcaccttctctaccttccctacctttcctctgtcctctcctctccttacctggactgtggggatgaacttgagattgtgtacttctcacccttcaccttgctccctatcctcagctgcaaacccatgattcctactttcatttggccctcagctagacctgctttacaatgcagggacttgttggaaagaccagatattgtctgctcccctggctcttagaaagtcacattctagggctgggtgtggtggctcaggtctgtactgccagcactttggaagactgatgtgggaggatcccttgagcccagaagttcaaggctgcagtgagctatggtcacaccagtgcactccagtctgggtgatagcaaggtcttgtattaaaaacaaacaaaaaaggtcaacctctagactaggaagatgatcaggagccaggataagaattggcatcagtgttttcccagcgtcatttggaaatatacggggaaaggtttaaaaatgtgtttctctggattagtcaaaggtatttgcatgaaggatagttctgactttggcaaaacaaacaaacaaacaaacaaacctgtgatttttaatttttttttcccctagcaagagacctggattttgtctccccaggtgatctttaggaaggtactaaattaaacttcatgctctgagtacatgtaggcagggccaagtcatgtccaagctagcaaggactctaggaaaagcggacctacaatacttctaggaagtctctatggtgtgaccaagtcagggcacttgttctgtgctttgggggtggggcacggattgaggaagtggccttggggaattgtgggtacagcatggggaggatggcaggcttccctgagtctgggaagacctgaggcatgccacacaattagcaataatacagtgcatgtcaggctgggatgaagtgtgggacactgacccatgaacacctacccaaagagtgcatgtcggccttttatgctttcactttttttttcccttcccttctcaaatcaggaatttccctagacatctctctgatacttagggaagggaaagaccctgtatgtcatgttcctgaggagtctgtgtggggcatggagacctgtcatactctgtgacttgttaacaagcaaaaatgcagccgcatcataaactctcaccacctctttcatttttacctcaaacttctttcattttcttctgcattgcttcccattgttttcacttatccacctaagccatttgtagaggtggtaagaagcctagtcataactgaaaagagcctgcagggaaagttgcccacagactccatcctccaggatgggggagctcaggcttaagaggatgcaaaagtcttagggatctcatttcttgggaagtggcccagggaagagtttccgtggtcttacctgtcaccctgcattataattcctgccatctgtggttatcaccaagcctgggtgacctctttatctgtcataccacatctattagcaaagaaagaagtttgaaggcgggaacacatacatcccagaatgtgattgatgtatatagagtcacaatgtggtgaagcacatcccagttgagggactttgggatgtctctttatcttctcattcttcaatttcaaaggccccgagttgccaagaccctcttagaatcatccaacttgctacaaaaaactaaccagatattattatagaacaatggtgacttaagaaacacagttaatttctgatgcgtgcagattacagaatccaggtccagttaggattatgtaactatacagacactgcagataagcagcaaaagcatcccaactcgtgaggtgctatgagatagctgctggtgtctgtgtgtgtaatgaccccatctcaggtaacctaagtgtgtccctctatgcatggcagaggaaatagaggtaccgtactgctggatcaccagtggcttttgattgcatgatagcctgggcaatcaagaacaatttattctattcttgagtagaatctcctggtcatatacattctgacacccactctcctcccccgccaacacacactgttgttatatagcagaacgctcatctattgggtgggttggttttcactgtcttaggcataatgtcttgtacacctataaattgcatatagtatatatctggtgctaattctgttctttacccactgaggagggagctgatgcaaaactcttgccagaacaggcaaaggaaaatgtctgtcctgggcctatctcagtccttggtgtatgatatggatcttcttaggttcccatcccataccagtctgtggtggcttagagcgtttcccacatcaaaaccttcataccagttattcgcaaacctcaatcttcagttgcctgtaagttatgtgtttgtttgtttgtttatttattttgagatggagtttcactcttgtcgcccaggctggagtgcagtggtgccatcttggctcactgcaacctccacctcccaggttcaagccattctcctgcctcagccccccgaatagctgggattacaggtatcagccaccgcatccagcctaagttatgttttaagaagagttttcatcaatttgtttctctggctttagctgtttagattcttcatagctactgtaaatatttcagcgggattagaactaagaagcagcactcatctttaatttctactctataagttactgctttccaccttctctgtcagtggggagaatagtgttagactattctgactttggcaggaagagggcagcttattaattgaggccacctgaagaagtttttcccattgaagttttggcaagcctgtttgttactctttgtgctggcctatcagacacttcctgtctatataaccttagggtttagtacttaatcatatattgagggggctgctctgtcctctttctgatgccccattctccactcccttatctttctctcgctctcttttttttttttttgagtcagcatctcactctgtcacccgggctggagtgcagtggcgtggtctcagctcactgcaacgtccgcctccagggttcaagcgattctcctgtctcagcctcccaagtggctgggactacagacacacaccaccagtccaaatttttgcattttagtagagacagggtttcaccatgttggccatgctggtctcaaactcctgacctcaagtgatctgcctgcctcagcctcccaaagtgttgggtttacaggtgtgagctactgcgcccagcccattcccttatctcttaacagaagccatgtagcccaaccctctaagtgctgtagacttcaagcttgtagccagtaaacatctggcaaaggtaactccatcatccattcccatctggcagggagctatctcctggaggaggctgagacataagccctgggaatcacatgttctttcagatggaaaattccctgtctgtaagtagtttttttttttttgtttcttttttaaactgctaaaacattgagtatgcagacacacatgtgaccagtccatgagatctcacatgggctccagcctccatcttatttgaatgcagaaagtcaaattcaccaagatcccattccacagatttctggaaattatcagtgaatcttggaagttctacaaatctgctctggtcatcccttctttcctaaactgaccctctagtcctagattactgcttcactcttcccacggacaattgtcacccacctgcccctaccccctcaggactactgacctcaaggtgctgctctttctagttctgccttgtgctgctttggggcacagacccttcctacagccttccacagtgggaattaaaggaaagagaagtctgtgacctaagtttaagaatcatggaggtggctcacgcctgtaatcccagcactttgggaggccgaggcgggcggatcatgaggtcaggagatcgagaccatcctggctaacacagtgaaaccccatctctactaaaaatacaaaaaattagccgggtgtggtggtgggcgcctgtagtcccagctactcgggaggctgaggcaggagaatggcgtgaacctgggaggcagagcttgcagtgagctgagattgcgccactgcactccagcctgggtgacagagtgagactccatttcaaaaaaaaaaaaaaaaaaaaaaaagagagagaatcatggaggtgcagttcaacatggagaataatgcacaacttcagacatgtggcttcactcacagcccctgactcaaatccaaaaccatcttcagggggtccctgcaggctgctttccagccatctcccagcccaccatcatctcaaaggctcaatttccttccttgcagtgaggggtgccttcaaccatgtctgccttatccaggatccaagctccaacacatataaggcacctgagagggaaagcaacttgagcctcactccaccctaagtcctgctgttctaatcttcctttctcattccttctccccaaatggttaatatggaaaaatctatttttttttttttgagacagagtctcactctgtcacccaggctggagtgcagtggcacaatcttggctcactgcaacctccgcctcctgggttcaagcgatcctcctgcctcagcccctctagtagctgggactacaggtgcatgccaccatgcccagctaatttttgtatttttagtagagacggggttttgccatgttggccaggctggtctcgagctcctgacctcaggtgatccacccgccttggtctcccaaagtgctgggattacaggcatgagccaccgcgcccggcgaaaaatctgttttcttagcgatactctacctttgcctatgaacataatggtctaatgtcaatacattctggattgttcagactcatttgcaagtcagaaaagggtctggttggtctagaactgaactaagcctagtccagtgtgtgtttgcaatcctcttcagcaagaaatgaaaaagaaagctgctagaatggaagcagtacgagtggggatgcagaggaggggtcagtgatgagaaatgcggaggattttgaacagaggcagaggctattgaacagattggataccagcagggggaagagtgaagggtgctgctgaggatcccaggtgaactgcagtgctcgtgagccaagatagaggacaggagaagcagcaggtgagcagagatacaaggtccattttgcacatgttgagtttgaggtgattgtgggatattcagtatagacctacagtgagcagttagatgtaaccattgatgactgatggacgttccaggattttgtgatatggtcgtgatgcaaggaagggatcacatctcatggtgcccagctttccggaatcttcctgctttcactttcccacttctttctggggtgtacccagatttgtcttgtcttacctcaggggtttcctcctttcctctgataccttggcatgcttgctaatgttcatgctccccatgtctcacctccctaaagaggcttgtcgaggtatttgcccaagcaaatctaatgggctccttcttttacatagcaacattccctgcaactgggctaatggtgggctcaaggggtattgtcatttagaatctcaggactttctagctgaaacaccagcctgcagtattgaaaacatgagatcaattctgaagtctgtttatttgttgtaatgcatataaaattggtcttttgaatgaatcaggctcataaagctatattgccagttcagggaatgaaccccataataatcagacacagaaagctttatttccggttcagagaatggatctgtttttcagtactgtttaatgtacatttctagttccatgttttctatttgtcaatcccaccaagttgataatggctcccacaagcccatctctgaatcttccccccgtccctgaactcattgtcctcctagaatctagagatttctgatgactcttctaatacatagagccatcctggggcttgagctctctggccaggatccctcctgcctcagctactctgctgaataccagtcactgggcaaatgcttgtctttgtttaccctgatcctcctgttcagtggccgcctcagcggtccattatgtagggcagacaagctgctgtctcggcagtgaacccattgggcctcccaacactgtgactaattgtattccctgttctctgctaccagatgcagtaaattacatttcctcccagcttcccgacctgccaatcctctgttcacgaacagcagaaccatcacctgggcaggacgggaccagcagagcggctggtaagtcctggggacctttggacgctaggatggtccaaggggcttgcatttcactgagctttattaatgagatgagtgccctgctatccttacatagggggagctcaccttcagcccagcctcagatgcagccttcacagtggccacacaaggcaggcaccggccccagatgggtaactgaggaccaaatgggaaggagttctgaggaaatcatacggcatttcacctccgacttcgggggagtctttctttggtgtttgtggtccttatatctgtgtttattctcaaagttaatctgtattctgcctccagggattttcattttcctcattggaaatatacaaattgagagagccatccatgatggaagctggatgggaaatattttcaaagcctgtggtatctttacagaatcctttgggaattgtgctatttgtatattatgaatacatatattcctaagtcttcccatttctggaattatttcttagccactgtggtatatttgggaggaaaagaagcaatttaaagcacacatgttacttgctaatgtgtctcacaattggaaattttacaaataatatatttatgagtgttgagtgtagggagaaccatgctttgctctgcttaatgcagacatgcctcagaaatcagaactggaaggatgcaagcaataaatctgtacacgaacccttatgatctacacagaaatgtgctgagggctgggggttaaatggaaaaatgaattgcccaaggttgcatggttagttacaacataggtgacttcaaatatgagtatcagattctgctttgcatattctaggtaagtgtatgtttaaaataaatcacataatggcagattttttaaagtaaaacaatcatggatgtttaagccagaggatatcttttatataggccaacctgaatatttcatgaagcaaagaatccctacttattttaatacaaaagtaaaataaaaggcaagtaagaattaacatagttgtcacgtccactggctaatttaaatatctgttgggcatctctgtaaacatcttagcagattacttttatgtacagactcacagagtcctagagatggttgggactgtaagtggtatctggtcaatccagagccagttccacatcttcctggacagtgacaggatggataaacaggaacctgcaacctgcagttatgcttcaaaggactcactggcagtcactttaacattggactctttaagtactccagggtacacttctgaggtacacttctgaggtcaacttaggtaaaatgtgtttaagagtgacaccccttccctctggttattagagacatgggtgttgatggctcctgatagttgtgggtaaacaacttctcaggtcctctgcacaagttcctgcacttcaaaggacacaggatatgatccaacatatggatcagcttatgggagggtagggacaatgtatgagaaataattttaagagacagaaaaagaatttgagcagtgtgggtagtcaaagagtttaaagttcaagagtaacacatgaatgtgattgtagtgctgtgtaagcagcaatacacattattaccacaacccagctccctttatctttgaagatcctgcaaaacatgattttaaaagccaatgcattttcaaaagtataatgtgatcagaatctttttcaaagtaattttacatatgtttctgctgattagttaagagttaatttgcgtaaatgcatctactgtgggattacatataagcagagctatggaaggaattgtatttgttacgatgaactcctttgtccaggctgtttagggaatgggatgttcagattcatgatcaattatggttaatggtgactacacagagcatgtgtggcttaccaaccaagggtactcactagaattctcctagatacagtccatcttgctttaggaatgtccttttggaaatttatataacctcagggacattttgacaaatgtcacttgtcattactgagtagtataacaaatatcctggttgtttggcgtttggaaggtttgggactctgtataaatgggaatttatttagaatcattgcttttcagaattaggagacatctattccaatcctttatccaaacattgaatccttaacatagcagccctgtgaagaggtcctcaaaccctggtcacacacctctgtgattcatgtttaatcttcctccaagtttcccattccatctctggttggttctgactattgggaaattcttcctctgatggagccatcatttgtctgccttcatcatccacccacttatccttatcctgcaccctggagctactcagagcacatctaagttctaatttcccttcaagtgtagaaagtcactgttatttcctgtttttcccagatcctcactctaaatcccctttgtgctcacagtcccagtctctccagctggtattgagatgatgagattgcctttagacaccctccgccatccctgtccctcccctctgcacgctcttcacttggttgctagtcttcttgatgtatcatgctcagagctacccaatgccttcagagctaggctgctcacccccaaaatagagcacgacgctgcagaccacatggctgactttgctggcaatgtggcctttcagcttcagttttgaaaggcctcaaagtcatttcatgtgtgccactgctcagcctcactccgtttatccatagaattgttgtttctgagtcatttcagttgaaatgttcagtctgtttcccctagctatacatatactacttcacctgttcatacatagaaggacctacagaattcttttgttttttaatctcgaaagacaaaaataagcatgagctatgcacttttctgtcctttgtagatttgctatgactattaaatttcttcttgttagattgtctctcaagaatgttgcgggtttcatggaggcactgaggaaccacagcaggaagtgggggaagggaatgatgtcatgggatttgacagggctctgacattccctcccatttcaaacacgcgcagttcctccatcctcatgtttacatattgtgtttccacatcagatttcacttgaatctaggcctcaacaagttttgaatgtagaaaaccctcttctctattgttagggtctttgtagctcatgattatggtatcctcatagcctcactttgcttctcagtttagtaccccctcaaatctgaaaaagcaatcttttattattttttatcatctcattgctaaaaatgttgcatgttggaaccaaagtcagagccctgtggcacaccattagagatctcttggccctcaataaccctaaattgacatctttggggtatgatcatgcaaccactaacaagttaattgtcttaacacccaaggcacatgtttctgtgtagtccacaggaatataagggattttgtgataatccaaatactctggatcttttcaaatgcaatttgcctattctttccagagaccttgaacagaaaagaaaatgagattaatctgcatagtttctgcttgattaacccatgctggctcttagtcatctctggtctttgaagattaactttagaatttagctagccatgatgtcaagctccttcgatgtagtttagaatcccctcattctcatttttgaaaatcagacctttgagtgtcagcttccagcacctttcctgatgttcaagattcttgagacaaattcaacaagggaactgggaccctgatcccaaagcactgagagcctttatatccctgcagtgctatgttattttccaatcttctctgctcatctgggcttcacttccctttctgccactttctttctggcactttacaggctgaaaactctccttcttgaccaaaaatagaagcaaaatcagacacaagaaattggcttgcctttattatccatcaacatcacacccttgctgacttatttttgttactactgaggtgtcttggaaaaacaattgattcacagaaatttttgatcactgttttttttggggggagttacaattttttattgatacataataattgtacatatttatggggtacatgtggtattttgatacattcacacaatgtataatgatcaaaaaagggtaatgaggatatccatcatctcaaacatttatcatttctttgtgttgggaacattcaaaaatcttctagctattttgaagtagacaataaattattgttggctttagtcaccctactctgtattgaacattagaacttattccttctatctaactatatttttgaagttggagattgtgctttcggatgagagggagaacccattctgaattaatttcctcatttttattgtcattggcatcacaatagccatttttacatttccagcccaaagataatatgtgaacacatatttatatgtataaccatttgctcgaagggataagactacccatatgtgtgttcattcaataagtcaaccatgtgcattgcttgtctatcacatgccaggtgcaatgccaactcctggatgtttctgttactgagatgaccctgaccccccatggatgacacttatgatctgcttctctcctactgtactttacgcatcactgactcgtgaaccacgcagggtgttcacagcaccataaaatatcaaatctggataactttcattgtacaaatgagaaaatgaagccccaaaatggggtgtgatctggataggaattcagatcctatctttctccctcctcccatctccctgactaatgacagcggaacatgtggtgcttatattttagatgtgggctctcagcctgttcctcctcccgtaatcacagtgagtgaaagaaagtgagctgggaaaagcctgaatcaatgattgaactttccatcctcctggaatagtcttgttttgtatgctcttggactgatgctcaaatgtattcatgtccattgctcttcccgccttgcttgtgtcggttactcttgttccctcttctctaggctccctacagcccttgcagttgctttcactctgccaaaggtgaaggcaacaggcaacacaggcatgtgtagagccagggggataagtctgaatcagaaccaaacattctctgctcctcagacccatctctctgggccctgcagagcaatcgcttctctgctcaaaactaccaccttggtttttaggtgggcaccttccccagaggcctcacactccgctccacacctgggtgttttcagaacctagagactggaattctcaacctcaacttaatgtctctactccttcagggcgtttccctattgatgaaagaattattagggagcaagaaccaagaaaaccaaatgcggaggcccaaaatcaaagtatccatgcagtcattcatctgtatccctttgaataagctagcaacattcgttcttactctctttaataaaaagagcatattaaaataaaataaaataaaataattcttaaaaacagcatattactcagctgtctcgctggcttcttggaaggagtagcaaatatgctttatatactccaatctcattgtcatcagtatatagggtttggaaatcaataattaaatacataatttaataaaaacatacttccagatttcagccagcctatcagtgaaacttccattgaattgtcttctatttcttttccttcttccccaggtccttcatccaggaaaatttccagagctttccttcaaatacttttctgtatgtccatgtatgtttcaagatttctttcagggctccccagaaagccctcacccctcaacagcactccctcctcattttttaaataagatgaacaaaggcagcaagccctttgaccctcatcattatacaaattgtagtgtacctctgacatggagaagctggagagaagacagggcaggttagagagtatgctctgtgctttgtggttagagacaaagggatgaaaagtgtgagaggccattggtataaacttttggcagcaacaggaagtagaagagtttttaaaatcttgtgcatcaaaaataagacattgcactgaaaacgtaagtcttatgttcctattggttcatatgcactctagttcatgcttttgtatattattggctgagaactgaagcaaaatataaatgcttactcataaagatgacatttaaacattcacacctcttgcatggctttctaaaaggcctagataacattctcatatatgtatccatgaaaacgaaatattgcctttgggttaagtcagagcttctcaaagtgttcgcctttgttctctttactggaggaaagagtgaatgcagaaaggaatgtagaatcacactcttaagtgtgatttgtggttcctctgaagccttatgttttatctaggaaaaaaatacatatgcattttgtgacataacatatctaagtttattttattataaaattatattaaaattcttaaaatattctatgctcatattctaggaatattggaagaatagtgtacaacatgtaaatataaataggtaaccctagtaaaaccatgtcacatgtggttcagtcccagagccatatcacatttaaagaactacagcttaaaattgcacaccaaaaaaccattaagaaggtgttctgttctttaactatttctcctgaaggatattaaaagggaccttggccgggtgcggtagctcacgcctgtaatctcagcactttgggaggctgaggagggtggatcgcttgaggtcaggagtttgagactagcctggtaaacatggtgaaaccccatctctactgaaaatacaaaaattagccaggcttggtagcatatgcctgtaaccccagctacttgggaggctgaggcaggagaatcgcttgaacccgggaggcagaggttgcagtgagacaaagtcgcaccgctgcacttcggcctgggtgacagagtaagactctgtctcaaaataataataataataaaaaataaataaaagggacctaatttatatctccactaagtaataattctcatattcacttttctttcctccacatatcacctgctctaaagcatcatttaccaccacaaaatactccttctctatgcatatttcatacagtttttactctctttcccactaaactccttctttctcatttgtgtattatgtggatatacttaacctttccagcaaagaacttttcatcatcatctctcctttcttccaggctctgattctagaacaggcaaagattaaaatgacagaaaattggaccaacaatgatcagcattctcattggtgggaagagggagagggatatctgtaaacatccccatgttaataatttgtatttttatcctatcacatatggatataaaaatagaaatattttgttccatattctgtattgatcgcaggccagtgtgtggatttgttcacagataactgaatgtttgcagaataataagatattgtacctacaaactaacaattattactttccttatttataactgtgtcccatgagtgtgttaatagtgataagatatattctaatcccaaactgctttttaaaataagtgttatatttcaagaacaggcttttggagtccatgcaaattttaaatgcctattctattcttctgatggcacattttgtgagaaatcaggaactaactgagataaatgtttatttggatacacagtcattgtgtgtgtccatgcacctctatgacaaatgctggttggcctcccattgtgtcacttgaagaaacttgagatctttatgctgaacaagtgaaactttcaaaatggatctgatgaaaaccaaacatgggattttgtttcataatctttttagttaagtgttaaccaggaacagagtgtatcttattatgcaagcagatggaacaatatcatcactgttattttttcaaacaagttcaaacattaattactgtgtgtaccatttcattggtgtcatattatacaaagtatttgttactagattacaacaaccatattagactcttgaattattagcctttgtttgagagatgtgtatattgggtacctgctatacaaatggctctaaggtaggtgctgacagggagggggcatcatggataggtgttgggcaagaaactaaccctcaaaagatcctaaaaatctatgaagctgatgaaacattcccacagataattatacaactgagtggtaattgttaagagccttcagagaagtttagaaaaagtattgagaaaattttaagagagggatgacttagagatggaaggatcaaagaaagcttatggaagaggaggcagttgaccttggcgttaatcaatgggccatatttggatatgtagaaactcaaaacaaagacatttcaggagaagggaatcttaacaaaagcagaagatatttacgtctgggatggtgttatttggttgtgctaaatggaaaaggagcactagaacatatggttgaaaagatagtttggatcttcttaacacagggaacttattcagaaagaggtagggactcaagacaatgacaagcagatgggctagatctctagaagtttggaggagcaacagaaggctatctaggcagagggacagcaggcacacagatgagcagccgtgggaggaagttgagtgtcctgggaatagtgagaagtcgttatggccacaatgtgtaaagaatgagagagcccacaagacaaggctagaaaggaagtttgcagacacatcctgaagggaactatatgccatgctggggagtttggtgtttattttctaaagacacaaggaaccaacagagggtttatgactcaagtaactgtgggcaggatggagcacaggctggcaggggtcggcaaaatttttgtataaatggccagattttaactattttagactttgtggaccatatagtctttgtcacacattaattgttttctttctcttttctctttccttcccccatcttttcctccctctctttcttcttctccttcctcttcttttttcttccttctccttccccttctcttcttcttcttcttcctcttcttttttttttttttttttttttttaaagaaacaaccctttacaagtgtaaaaccactcttagctcctctggccatacagaaacaggctcaggctgtctttggccctctggccacagtttgcagtcttctagactagagcaagaagacagaagtgttaggtaaaataaaaagcaaggctgttgtgcagagagcagaggagggcctggactaaggccttggtgacagaaatggtggtgaggagatggatgagatatatctgaagtagaatgatttactgtcagtgagtgtttggctgtaagaaagtaggaagaaaagaacaagtcaggtgtgattctcaggcctgtggcttgagagactaggtagcagtgctgctgttatttggcatggagactgtggaatagttttgatagaagaagctggagtcagtttggaagctgctgagtttgatgggttcgtggcacatccagataaagggcacctggagcctggtggctctatgggcctgatgcacagtttcttcccatccaggaagactgtgaagaaaccagtttggaagtatgaggtgtcacaagagtctataggacaggaaagagctgtccttagcaaccccagactggcagcaagagttgggatgaattagaaaggatacaagactgagagacaggggcaaggggagggggagaccaggtaggaagctcttccaacaatctagggaagaggaagtgaatgtcttacattgaccagtagcaatggaacaaaaagaagacaacagatgggaaaggtattaatggaacaaaaagaagacaacagatgggaaaggtattgtgggcagcaggacttggcactctgtgcatggaagatgaaagaggccttctgcgatcattgtcttcaaattccagtgtcctatgtgatgttacttctgtcttgttcttttcttagttcttattttaggtacctagtttagtgactgaagtactcacagggcacataatatgaatgctcccatgctttttcaattgttgaaaatattctgttgtatagtacagtggaggatagccatgacccacctatgaaaacctttgtggaaatgtagagaaaacgaaaacacttgatgaaagaggttttttcatttatttaaaattttggacctggaacacattttaaccaagggtttgtaaattgtctgtcagcctgggaagccctcagtcaaggtagtttgcatgttgccagcctccatgaaattcttcacactaagatctaaagtctcttgtgcccttattttagcagatcttccttaaatgtgtgagtgccattgagatatagcaaccgtgcatctgtcttccaagtgcattaaactgctgtgttacaatacagatataaccatctttattcacagtgcgcacctcactctaacactcaagatgcttggcagttagaatagaaagggcacaaaacctttttttttgtctgtttggcaattaaccattcactggctttttttgttgtaacatgcacttcctttctcttgttttcattcaagctgtgtacgccatggaaattaatgtggagaaagacaaacaaacaggagagaccaagattctctctacatctaccattggcccagagggggtccatcagaaaggagtcaaagtctatgatgatggtaccaaagtagtgtatgaggtgcgctcaggaggcaccgtagtagaaaatggagtgcacaaattaagcacaaaggatgtagaagagcttattcagaaggctggacaatcaagcttaggaggagggcacgtgtctgaaaggactgtgattgcagatgggagcctcagccatcccaaggaacacatgctctgcaaagaagctaagttagaaatggtacataagtctaggaaagaccattcttccgggaacccagggcagcaggcccaagcccccagcgctgcagggccggaggcaaacttggatcagcccgtcaccatgatttttatgggctaccaaaatatcgaggatgaagaggagacgaaaaaggtgctaggctatgatgaaaccatcaaggctgaattggtcctcattgatgaagatgatgagaagtcattgagggagaagacagtgacggacgtgtccactattgacgggaacgcggctgagcttgtgtccgggaggccggtctcagacaccacagagccctcatccccagaagggaaggaagagagcctagctacagagccagccccaggtacccaaaagaaaaagcgctgtcaatgctgtgttgtcatgtgaccacttctttcttctcctttcttctgggcagcctgtactctccaccactcacgtagacctcactgtaccactaactgcaatactgtgaactggaagcaaacacctgccttgccttgcagttgaattgctttgatctctctcattttttttccttttcctcacctgagagacaacgtgcatgtgtgtgcttcattctctccaagaacttgcttttcctctaaacctttccttgtgtcttcaagagtgaatcacttccttcctgctcgattggaatggactcttcgtatcagccagtgatatggtagccttaactcacttgactggaattgaacccattggcactgggggtttcattttgtagtgtgttcctgtaacgtagtcacacactgccatgtctctggtttctcacttgcctcctttgctgtggatctttgtttttatatcttgtgtggcaaaatgctgttggctctagccggttgctagtgtagccaaaagtggaccttacttagtctgtccgatctagggtgatgctttttgctgccttacataagcttccagattacagtattgtgcattcatggctttctttctgttaaaactgaaatgaagtcaatgtagaagaacccagagcttgtcacagctgaaatgtagggactgattccataacctgcccatcagcggttgtctctctttctatggtttaaccgatgaaccctttatataagaagcaccattttaaaatttctaaggacatgaaacaaacattgtttgaagcatcagtagcaattgatctccaaacttaggcaaattcacaagccttgtttctattctcttaaaaaaatgtaaatttttatattgtttcttttttctggatattttctggtcatgttaatctattttcaatgaggagatcatcttgagaagtatctttgcagtgaccatatttctaaaacagtctgtccaacctacaatggttgccatgatgctcccacttcatcatggatggtgctgtaatgcattaactgttcatctcctccccagttgattacaaagccttgcatccatactcttttctttctggccccatgagaaagagaatgttttaggtaacttcaacttgtaggtttatctgcccttcaaaaaaaaaaactttaaaaaacttttaaaaattaagaaagacctatcttctcaatgttaagcacttaatttcataacaaatattaagtggcacatagctgagcttcttagggcattgttttgtttttagcttctggagattccagaagagcaaagaatattttttatctagaacacaatgaacagtttttgaaataccttctcagcactcccccaaagcaaaaagccacatatgtagtaaaaccaaagggaaacaatttaataaaataacaatagtatagtaatgaaataaagatataacatgattactggttttaataagagttatcttaactttaagttatttgcccatttatagcattgttatgaattattcataaaattatgtcccacagtatatagttttgaaaaaacatatgatatactacatccagtctaacttctgtggaaagtagatcagaaaaaataagatagtcttgagagaattttattatagaagctgtctaatttgacctattttgcttgctcagtgctaaatctattgcttttttttaatctcctggcttgaaattatatttacttcaataggaaaggtaaaaacatcagtttttacttttcaaagttaattttctgaaataattgcattttaatgagcacaaaatgggtcattttatttttattatactcatcttgtttacacctatacataaacagaaaacgttaaagaagagaaaaataaaggagctaagttctgctgttgaagattatttcatccaaggcttggttttgaataactgagggaaatatctctaaatctcaagttcatcaaagcagctgcaatggaataaaattgctattttatcgagaaacctggtttggatgcttataaattccactactctcagcttcattttcctgagtacgtggtcactgaagcatcatttagacattacataaactggcatgcagataaacctatttacatagagggagaaaacagtttcaatgtcttggacaatctgttattttaatgatttacttaagaaagaaacaatctgaaagcttaccatagcttatcttttctactcacttggagattcaagctattcaatgtgagttttaaaaagttaagcacagttagtgagtgaaatggtagaatgtagaacctttaagcttgctggttgataaacagaatcaatcttccaggacagataattccctgaagggacctatccttgcataagtgaactagttactcatacagaaaatgatctgcacatcttactacaacactacacacaagaactaaaagattaatgattatctgtattctcttcactaattactattatgggggaataatgattagcaaattatatgaattcgagttctctctatacttttattagtaaagcttatcatttaatggactgaagtaagatgtgttacctttattcgagctatttgtagccacactaaatgaaggtgtgtttgaatatggcgcatatatttgcatatgtcccatcattttcttgtcataatggggaattcaggcttagccagtacttctatgggatgagacctataatcccacctatagcagcaagtaactacccttcatgatgatagtgtacatggagctgtgattatgaacatgctgcctttcctgctgccattggcattctctctgtaaattttattatgtgtggtatcacactctccaaaaatgcagggtatttggttacataaccaaactaattaaagaatcagtaatgaaattgcaaaaccatgatcttttttgagctaatgattagttgggctttcctttaaaataatataatcaggccgagtgcagcggctcacacctgtaatctcggcactttggaagtccgcggcgggtggttcacctgaggtcgggagttcaagaccagcctgaccaacatggagaaacccccatctctactaaaaaaaaaatacaaaattagccaggcgtgatggcgcatgcctgtaatcccagctactcgggagactgaggcaggagaatcgcttgaacctgggaggcaggggttgcaatgagccgagatgtgcactccagcctgggcaacaaagagcgaaactccatctcaaaaaaaaaaaaaaaaaaaaaaaaatcatataatcagttcccttttaaatagaaagaggaggaaaaaaaaaaggaaaagggggggtatctcatttgtatacaaatagattttcaatggcatttaataaaagattctttaatggttaaaatgataaagattaattctacatatcttgaaaaatcttaatgacttctgtattcttgacttcttaaaaatattttctttcttttagtgtgcaataagacaaactaaggggaattttttcagcttgtatctcttttacccatattattttccttgcataagcaaaaaaataataattgcctctaaaactgatttgacagtgttcagtgacatcatttaatattggtgatggggtggaagagaaggtagggaatgcccttatggccaaacctaaaacacagtttccttgagccttctgagcaatcttagaattattcagaagctttcaggaaactcaaattctattaatttgatttggttcctttccaaaatgttaatagacatgtatttgcttaaaacgtctacctattccatttaatttcctgctgataaatgtattttatctacaagcaagtagaatattttgttttggttaaagtcaagtttttataaaaggaggggaagtataagagagagtttcctagagatacaatatcatctctggagcaaaatgttgaggccaagtgtaaaaacagactatttctctttacttcctgcagaatttcatttcaagggaccacagcacacccttgaaaattaccatttatttaatgccagttgaaccaatgggtagcaaaagaggagggagggaacatggtcatagagacaaaatctaactactataccaggtcttcctttgtaagaaatattagccctgccaatataaaacgcagatggacatagacagaataagcatcgaggactttttcttatttacttgaaatctagaagctcagtcatctctgctcatccctggacccactggagagttttactcactaacaggtcctttcctggaagaaataacctcatctcctgccatattagtttacaataaaaatcattccaaagtgagccatttcacattgcatttttgccacatgcacatttgctattgaaaccacagattctcagcataagtaagacataggtgtttcagaaacttcataaatacacgatctttcaggtgctcctcaatttcttaatcaaggtatattgaactccagtgattaggatagaacctgaaaacatcctttgttctattggatagtacaacacagcaagagcacacagttatttgtataataaaacaacttaattaatgaggaagatgggatgtttgattcctgctaccaccagttcacttcacaaaggccttcttctggtattaccaggaaaactttcctgcattttctagggaaaaagaaaagtcgtttattaggagcacaatgcagatatgtatctgtgttttcatagcttcagcaaacttcttagtaaaattcccatttcaacaaaaaccaaaatactgattgtttgaatgtagaaaggtatagaataaagactacaaaggggaattttaccagggctccttagaccagcttccccagcataatttttatataactcaagtaagcctctgcttcccctctcctttccagtataatataagaaggtcggaactgtcgcacaaaagaacttgatttcaatatgaaaatataatatgtaattttggggactgcagactttctgcatcaaagatctggacagccttaacttttataaaaataatttttcaatgttctcttttactaaccaggaaaacaagatgttttctgaaattaatgactttttctattttgggtctgttttctaagtttttacaggttgaggtataaagggtcgtcttctcctcatattgcctcttcataatcacctggggctattttttgcaagtcactgcatttttacaaaaaataaaaataaaaagtacatctcacaaatcataaaattctccctagacttcagacagtccttctggagtgaaagaatagaaatacagaaagaaaagaattacagggtggctttctttttattttcctatggttaatgtactgtatggtatatatgtttacagaatgtatctgccttgtgatgttaacaaaatgaatgacaaaaaatagtactgatgtgccatttgacagtttgccttagcatcactgtttatgttcttcttttctgtcctttttggtaaaaaaaaacgcaggttgtattccaaagctgtattaacacaacattctcttccccactcctacccagccttcttcagagctgtgaatttcattacaggagcattgaggcagaaccttgcaggtgtggcccaaaggggctaaagtgggcataggttgggatttacttctgcccgtctaccaaccaaacacgtatctgtgttctcatataagcctgcaaaattttacaccctgcctttcagggagacaggccacatggagcgcatgacctcttgtagtcgtctcctcacagtccttcccactgtgagagaaggaaacttgcagacccccaactggatctgggagcatatttttaagcacagttggcattgcttgaaaaagcaagagagatggactcaaattctatgattgagccatgactgaggaatgtgcccattcgttatagtcgaagatgagtaggatgatatgggtgagaataggagtggctgtagaaatggaatattttacagttatgtatttttttaaggaatagtatttttataatgaaatctatatacattatggagcttgagttggaaaacacccttgactgagctatttcttcattccattaaaggtaactttctggggagtcctatagcactaggccaagccttgggggcatgaacaaagggcctgtcacttggccttgcactgccattacatgagatccagtgtttccaaataggccttggttggaagattgagctttctatacctgccattaggtagattagatagatggcttgatagctctctgggctatacttttaataatatataataatctttgggaaggagatagctattttaaatgcaagcaaagcccagaaactatcaaagtccaaatctttcacatatttaaggagtaattgccacatttgaggttaagggaccacttactatggtgcatttgagaaatatatatgaaacggtgagtcagagccctctgaccatcttcagtctacacataagcagataaaccaccaatataaatcttataggggccagacgaggtggcttatgcctgtaatcccagcactttggggggccaaggcaggaggatagtgtgagcccagaagttcaagaccaggctaggcaacatgttgagaccatgttgtttagtctctactaaaaaatataaaaattagccagcatggtggcacacacctgtagtcccagctacttgggagactgaggcaggaggatcacttgagcccaggaggtggaggctgcagggggctgagatctcaccactccattccagcctgggcaacagagcaagactctgtctcaaaaaaaaaaacaaaaaaacaattatcagttggccttctacataacacagggctacactgtatttttagagttaagtagatacaggaaaagattgtctttatccataaaggagattctgaatttttagagttcctgaatattttcccccaagtttctgtcaaattcctgaagtcccttccctatcacactcagtttcctgaagctcttcccctacacctgctcctctgtctggctaacagagttgtcatgtctcagaaactactcaccactcttgtgagactctcttcccaagcatcatccttcctcaggatgaggcctttttctactacccaagagatcaagaccctttttctaacaagacaaggttatatctactccattttcaagagaaataacccctctggttcccatgcaaatcgcttaaattccttcatcaccagaatctctccaacaggcccaactccagcccagctgtgaacactgctgtcatggagacaactccaaaatgaaagaactatgcaattgcctgaaggtgctaatggagagccagtttactctaatctcttattactaaggaacctctcggtttcgagattaagtgggcagggagacatccagtcacttagttttgcaatgacaggtcttgatatacacagaggccaccaggcaatgcctgatccaaactattctgtatgtagctccaactccaattctgtgatatcctattctggcaggtgggaagagttctattctttgcagggttctggaacattctttcctgctctcaagctcctgacttaggagagtcaaaatcatacaggggttccagaaaatgttgtgtctgatgcagcttctcagtgaatgtaggttgttggtgaaattttcagctttagcatctcactcggggtgagtgatgtctctgtaaatactttcatttgtggttggttggtgggggtgggggtgggagcctgtcgtgcttactctgaattagcttactgggctagctgctgtactttgtaacctgaagtgtactttgactgttctgtttccttcagatgaaaaacaaaataaaaaccgacttcagaaaagacactaccagcgacagctgatgctgtacttgtagcttctctctgttcctctgtacagtattaatagacaataaactgccttttcactgcatctacctctgtgtgtctgtgccctgattctttccccttctcacctgccactagcggacttcaggccagaccgtgttgggagcaccttccgctgttcactaaaactaaacactaacccagtgcctctcaaactccagtgtgcttcagaatcacccgggggtacctgttaacagtgtggaagcttagtcacacctctggaactcagattccgattcccaggtggggcccagtagcatgcatttgtaataatgtctccaggtgattctgatacatgtggtacctggaccgccggtttgggtgccccttggtgggaatcctcatggcccacctgttgtagttggtttctacactaatccaatctcccaacatgtcctccctctaaccccctttgcatgtctctctccacaactgtcatccttttcttgttccttgcaagctcccagcagcagcccagactgtgatcaaacttgggctgccccttaggctaagtgacagggttcatctggtgcagtctgctgtttaagagcatctgaagacacgtggggactttgtttctcttgttcacctctctttacctggaacagggtcagcatagtttttcaataaatggccagatagttttggctttgtgggccaaatgatctctgttacaactactcagctctgctgcaaagcagccatgtatgacatttaaatgaatgagtatggccatgttctaataaactttatttacaaaaacaaatgctgggtccgatttggcctatgggcttataatttgccaacccctggcctcaaacagggcctggtccatagtaagtgctccaaaaaaaaagtttcaaaaaattattgcatgaaagaatgaatgaagagtagatatgatgcctaccacctgcagagcagtcacagaaaatggttttctttgaggagattaagtaaatgaatcagttgggagttctcatctggttgggttccatggtagattttttaaatgtctttatgcatggaaggtaactttaaagatggaaatatgagtggtgttttatagattgctcaaaccgccaggttaagattgacaagagtttcaaccaatagaacgtggaggaaatgcaagaacatcttgtcctcatcaaaagtgctggggataccagaactgggtgctccctatgtacctaagcatttagtgcagttgtttgtggagctatgttttgtcagattcatcttacacagtgaatggcagggctttctttacattattctctttgttaattgaaatactttttaatgtgtagttaggtaggctggaaccatgatagcacattacacatcccacagttctagagcataccaacgggttcaaatgtaggagcatatggaaagtcgtgtgcttacattcatccctagtgttgttgtgaagttaaaggaaattatatttattaaaagcactgtgtaagctggaagtagatgacaaatgttagtttagttataatgagaaagtgtctgttgcccaaccagaggcctcatgctgtccaaatatagagattataagctgttcaggtgtgtttcagaactagtatagaaagggaagctgctttggcctcctttagatttgtgactagttttgtagtacattgaaccttatgaaattgccattttgtagatccataatattgactattgacagttccatatagttcaacctcataattcgattctggggattatatctcatcatggagggcaaatgattaccagatgaactctaaatatagcaggaggaattagatgagaaaattagaactttggaagggaatgtagttcagtactaccaagtagacctagacatttcacctgatagggtaggatttcctttaatctcacatcaactttgtaatgtagccattgaggttactgtccttttatacatgaggaaactgagttatagagatagtaagtactttggctaatgtggcagggctaaaaatccgtgtggggtggaggagggccaagttccaacctcagttgtctttacttcctcccacacagagagctatgttatgaaagtggtgtggaggccgggcgctggaggccaggtgcggtggctcatgcttgtaatcccagcactttgggaggctgaggcaggtggatcatgaggtcggaagatagagaccatcctggccaacatggtgaaaccccatctctactaaaaataaaaaattagctgggcttggtggcacgtgcctgtaatccccgctactcaggaggctgaggccggagaattgcttgaacctgggaggtggaggctgcagtgagctgagatcgcaccactgcactctagcctgggtgatatagcaagactccatctcaaaaaaaaaaaaaaaaaaaaagaaaagaaagtagtgtggagatgcccctgagactggagacaaaaagatttagataatgaggttatttatgcaagaaagacccaatggcaccagttcttattttgcacctttacctactcaagcaaatgctctgttaattataccaccccctggaggctgggaggcatctctgcagcgcttccttaccaaaggagaagcggagggtaaaatcactttgttttcttatctgttcatcaggagtcctgttgttctatttgacagtttttccttcaccattcataaaaaggattaacaaaattgcccaaaacaactctataaagtctaggagtggcacgtcagtctctgaaaaagcaaagggggttttgttattgttgctgatgatggtattgttactatttcaccactgtcataacagcaaagaggaacagctgccctatggtgttatgcaaatgccttttgatctaggctatatcatccttgtgcagctattaatagaccacatcatctccccagcagcccccaagccctagcttctgtcctgcttttctcaaacagtattaaatcttgcattttatcaacagcacaaaaaagcaaagatttgctatttagaagtggacacaggaaggggaatatcacactctggggactgtagtggggtggggggaggggggagggatagcattgggagatatacctaatgctagatgacgcgttagtgggtgcagcgcaccagcatggcacatgtatacatatgtaactaacctgcacaatgtgcacatgtaccctaaaacttaaagtataataaaaaaaaaaaaaaaaaaaaaaagaagttaaggttgcaagatcttaagtgatcatgtagggcagaagtcagaaaatggttatgcagattctgggctgaatctggcctacagtaaggttagtttacctgcacagcaattaaaaatcattttgaattcattgccaataataataaattaagagagttcttattttaaaagtatatttccgacttctcttgagaattcagtctctggcaataatagcctgttctccccactggcaattgtctggagctgatggtggttgctaactttagaggagccatattccgttgttcatcaccaccaacaccaacaccaccaccatctcctattatttttaccaccttctattattcttactcttggcccacttcctttgtctgtatcacctgcctggcccctattggcatttgagcatgtgacccctaatctaccatcattcactcattttatggctgggtcaaataagtcctaggtggaaatgggacttaccttagcaagataacagcagactcagaactaaagtcccctgaactctttggatgaatgaggctttgtactgtgttgggattcaaatcttctaagggcatttttagttttgaacaggctacaagcagaaagctaatgccagaatctagtgcttttgctacagaggaacccatgtgacttatataatgatgaattaaccttaggttaaatgaacagtgtaagtttgtaaggaactttagggtatcctgtgtttcatggtaaaaagtttcattcccaggaaaataaatagatactttgtagtcaacacctcaatagttctggaggcttcatgttccttcttagcaaaaataacaagaggcacagcccatacttatttaaattgaaatgtgatcttccatgccttcctaatccttagtctttgattgtgttcctgaggtcatgtggttgtagaatactactattctgtattgtccactttttttatcttcctaagagcaataatcctcacagaagcttgataattcaaaggactaatgaaacagagatctttactcccagggcttgtcataaatcctggccaatatggtgaaatcccaactctactaaaaatacaacaaaattagctgggtgtagtggtgcgtatctgtggtcccagctattcaggaggctgaggcaggagaatcgcttgaatctgggaggcggaggttgcagtgagccgagatcgtgccactgcactccaacttggcaacacagcaagactcctctgtcttaaaaaaaacaaaacaaaacaaaacaaaaaaactgatatgatttagtgtttgtttgttttaaggaaagactaattttttttttttttgagacagtctcactctgtcacccaggctagagtgcagtggcatgatctcagcccactgcaacctccgcctcccaggttcaagcgattctcttgccttggcctctctagtagctgggattacaggcgcatgccaccatgccaggctaatttttgtatttttagtagagatggggtttcgctatgttggccaggctggtctcaaacttctgacctcaggtgatctgactgcctcagtctcccaaagcgctgggattacaagtgtgtgccaccgcatctggccaaggctaattacatttaagatgataattgtatttcccaaattaaaaaaaatatttccaagtcactgaatattaaaaacacgagctgtgggcctattctcttcaggccagggttcttaggtcaacctcagacaacctgaaagtgagataaattctgcagttagtgtgaattattcagactatcagaatctgccaaatcaaattccatttcttcaagaacttatttccagtcagagtacaaagatagagtcagcttttctacttttcctgaaagactgcctaaattctaactatagctcagagactcagtgtgaggtgctgtcacataccttaactcagtttttcctcaaacttcagacttttgggcatcatatttgttatttttgtcctgtgtgtaccagctcgctcctgttaaaagaaggaaatagccaggttagagaggtgtcaaaaacatagctccatctctttaatataatcagatgggagtgaaagagaatcaagatagcagtaactttcttgctatgtgagtcagtgttacataatgccatgcccacttacccccaaaatttaggaaacactgtcttgcctccttgcatcctcttaaaaaaaataaaaatcccaattcctcgtttcaaagagactagggttagaaatagaaagtgacttgctcaaagccacaagaagagcagagacacagagctgggattcagacccaggcagggtgacttcaaattctttccattgcaccaggtgcctgtcatgctgttccttttataaggattgaatcgagtacatcagtagcaaacttaaactctccagtaagatcacgatcgtttaaacaaacaaaagtaacatctgttccagctaaagagctgtctctggcataagcaatttttcaccgatggaggctagatctgattgggctcttgctgagttaattgagcaaagttacgtggccagatgtgagttttcagatagaaggggaagggaatgcaatatacaagcacatggggagactgatggaccaaatggctggctccactataaaacactccagcgtttagcctttgttctgcctcctgggcgttagcaagctgactcccgcacagaagacttcttggttgactcttgaagagtcagggatttagtcaatgcaagctgtaaactggctcagcactagagaagcagcagacatgagtagaaaaaggttctcccaaagacagctcagcttcacttttctcttctctcttcactcctttcttctctcctcttttctactgaatgaacttaaacatttttcagctgagatgcattcccacctgcagggtgaactgaacttttaagaagcctattaattctcccaggaagcaccaggctgcagctctctggttctcatttcttgcttgctatgtattagaacctgggacattttctccaaaatataatgctatgagggcccccactccagagatcattatttaattggtagggtgaagcctggcacatttattaaatggttccaggtgattctaatggagattcagccagtgttggaaacagcagcacacgggtgcccagggctggccgcagtgagtccgggctatgattcttgcctcaattctgcaagccaagaaaaacgggctttggattcaggaacaaagcaaagcccaagtctgtcattggccagctgagtaatcttaggcaattaatttcaattcaccaagcctcagtttcttcttctgtagaatgggaataatacctaccttgcaaggcttctgttaggaatgtttcccttctcctttccttcccattacaaaagaaatatatttgaggcagttgattgaaaaaaaaaaacagcagaaaaagaaacagatggagaaattaggccaagagaaaaataagatgaaattagaaaactccatctagcttatattactgaacgtttacttctctcacttgtttgagcaattcagtttgtaaaatgtaccacataatactactttatcaaccaaaccacttaattctaagatcttgggtctattttgaaaacaacaaaaacatgatgtgacagaagcagcattcttgagtgtaaagggacccatggactgagctttgtctcatttatgcctttatcgtatgacttagaggaagtcatttttcctctcttggtcccaacttgctcatctataaaatgagacaacgtgattgtgggtgacattctgagtggacgccaacctcaggagtatttttctataatttaaaaagaaaggagagaagaaaaagagaaggagaaaaggaagaggagcgagagaaaaggaaggaagaaagaaggaaggagggacagagagaaagaaaaggaagaaaggaaggatgaaagaagggaaggagaggaaggagaggaaggaaggaaggaaaagaaagagaaagacattaagaggaggggagttgttccttgaaggtgctgaagtccctggcctttagaagccatcacatcagccatctgctgtgcctggccctgtgaagttactagtaagccacccgtcactgccttgttccagggtcttgaaaccctgtggctattttcctgtgtatgaaattcagtggggggaatacctgcctgaccaaaatttgtagttccccatggttgaaaataagagtctgaatcttccttttaaatatatgaacagaatcgtctttgcctgccatctttgtgccctcactttctccttggagacttggcaaacccccccaccttgagggagaatactgcagacacgtgccactgctcccctattctagatgttttctccaaaggaacgttgagtttgtgagcaacaggctgacagtgcttctctccacagacaatgtttaactctggacaaaatacaggctccttctcttgttctcacttgtgactccctgctccatgaatgtccagtgtactgggtctgaaagcagtaagccagttctgctctttaatagctctgtgtctttgggtcagacacttagcctctttgctctgtaatacaccatagagagttgtcttaagtataaagatccaggccaggggtggtggctcaagcctgtaatcccagcactttggaggccgaggcgggcagatcacaagctcaggagatcgagaccatcctagcctatacagtgaaaccccgtctctactaaaaatacaaaaaaactagccaggcatggtggcgggcgcctgtagtcccagctactcgggaggttgaggctagagaatggcatgaacccgggaggcggaacttgcagtgagctgagatcacgccactgcactccagcctgggtgacagagcaagactccgtctcaaaaaaaaaaaaaaaaaaatcctaatatttccattgatccaaagaattttagaagtggtagatagaaagttaggcatagaaactccaagttgaatggggttagttagctgaagtttggctgaagagagtttgttttcatgtcttttcacctaccaggagaaaatttccctcattgaatgttggaaggagacgtgggaatttttggataatttcctgaggcagtggctgggtaatggaaactctcattgtgagcgtacaagcatccatcctcatcactaaggcactctcctactcagtaagaacagagaatcactgctttgttctctttctccagaattaagatcaaacccttctctctggaattcaacatttgctaaaatgcaacaacttcttctccatcacccccctccgcgaaaccttagttcccactgattcccaacataaatttttctttttaattaaggatcccaccctggccctcactggccattttcaccccttccccacacttggcccatgctgttctgtgcacacttggaatcatgtccctcttcccctggagaagccttcatcctgctcagcccagctgcagtgctttcatctcatactgccccctgcacccacccacctttcgctatcagccctcctctgcacactgcactcctgctgtctttaccatacggctgacccttcagtggggctcctctgtattcattggataaaatactaattttttagttccaaaatggatcagtagcagcacctttgatctctgaagtagttgactttcaccctgagacacagacttatagaccatagatgaaaaatgacaatcaagatataatgcataagttgagcacggtggtatgtgcctgtaaatcccagctacacaggaggctgaggcaggaggattgcttgagcacaggaatttaagtctagtctgcacaacatagcaggaccctatttctttaaaaagaaaaaaaagatgtaatgctatcttttggctcccaagagtcagtaggaaggatgggagaggaggggacaggagcccttgccagaaaaggaaattgtagttttattttctcccgtatgtcagaagagaacagattggtatggtgtgcaggtagccatgggtcttctcttaccaggccagaggagaggctgaacttccctcagcagttcccaagcaagtttagcagcagaatcatagacaaattgtcttcctatgccttgcagtgtgggtgcttgtttactatttgagggaaaagtgtttaggcaaacaggtatcctgagggtgaccagctgtgcaaggattaggctactgaagcacaccagttctggctggtgggaatggaactggagctccccagcagggctgccaagtatgattgttcaggttgcatactgcacaatcctggaaggctccattcacatcaagtacaatgtgaatggtgctcttggagttgttcagtgcataacatgcatactacacctgctcaggcaaaagcaacctatccgttctttggaacatatagctaaaattcaaccagaaacttactttataatcatagcattgcacatatattaaacttgctgtagcctgtcaagttgcaggaatcagtttataccctgaagactatggacttgacttctaggaaccggtaatgaagacatacttccagggaccaggcatattcttccttgattttctccagtgaagtttagcatggtataaacacatggtatggggtagatatttcatgatgttgtagctgggatcatggagcagaatgaaagggcagaaccagttgctcttttctcaggggcggcattgcccaagcatgaattgttattgagtggccacttagaagaaagatttctctgactggggtgaccatatgtcccagtttgcacatgttttaccagcctaattttcagtaatgttcagttgggatgatgaaccatatggtcgtgtgacctctggcatggagatgggcatctctgctttgtcaactactccacatctgcaaccagcctttccttttattgatgccttggcaattctccatgatacagacacaatgctgagggcacggcaagactcctgtacgcaaactgttctgaaggatcagagtgttgtagggtgacagtcagcctcatccacatcaaagcatttcctttttttcttcaccatttttgatcagtttcatattcctgtgggtactaatgaaaaggaacagcagaaccactatcaagtccagtacttactaggcagatagagacccactggcttctggcctgtgccacttgctgctgcccacactcatcagtggaggagaattccctactaagttttcagtagttataattgccaccaacattgcatgggagagaggagcatgacttgaagtcgtttgcaaatgtatgttcatccaacaacagccaagaagcatacccgagactgtgcaggtgctgcccaagtcctgaacacattactgcacagttgctcagagttctggttcgactgctacctcttgtaccccagtttcttcatgtgtagaatggcaaagagggttaaatctcttacaaagtgttttggacactgcctggtaaatactggcagaactaaaatatagctattagtaagaatagtatcagcagctttgagagccagggaacaacccctaagaatggtatgaagtagggatcagcaactatggcctttggagcaaatgtggtcctctgcctgttttgtaaataaagttttattggaacagaattatgtccacttatttaagtattgtttatggatgccttattgagtagttgggaaaaaaatcatatggcccataaacctaaaatatttattgtctggtactttaccaaaaaagtttactggcccccaattaaagcataagtaagatactcaaaatctcattcctattcctattccactagcagttactgagcactgattaaatgccctgaactgtgccaattttttttttttttttgtaagacagagtcttactctgtcacccaggctggagtgcagtggcacgatctcggctcactgcaacctccgcctcccgggttcaagcgattctcctgcctcagcctcctgagtagttgggattacaggtgcatgcgaccaagcctggccaacttttgtatttttagtagagatgagatttttgccatgttggccaggctggtctcaaactcctgacctcaggtgatgcacccacctcggcctcccaacaaatgttttaacatagattatcttatttaactttcatgagaagtagctcttcaaggttaatggaaatatcccattttatatgtgaggttcagagcacttgtgcttgtgtacaattgcagagctaggattcatactctggtctggaactttaggagttatgaggacagacatcctggaggagttcggtttgcacttgttcttgaagaatgagtatggttttcagtaagcaaggagaagacccaggggagggtattgcagaaagaaggaattgactgagcaaagggcctgaaataggaagcttgggctggttgtctgatttgtttagcctgaagggactgaaggagacaaggtgaaagaagtggctgtatgccaggatgtagagagacaggtacttcctcgaggaagcagctataaactgaaagttcaaggtcaagcccatagacatattgtgtttggcctttactgtattgattcacacaaggatgtttgctttggttttcacttgaatttataaccagcccatcctacatttcatcttctcttaaaagactgcaagatctagccagactcagccacatttccaggaggtgggaactagctagagttgagtttagctgccctctttagatgcagcatctgctttcctatgggcctttactcatcttagactcaagcaagcacagcccccatactgggccctgggctttatagggccttgctctagtcacactcttttctaaggggtgaggagtctttgggccaaggtgacttgcctgctccctacccctgtcccctgactgtgcttcacctcccaagactctgaattgtctcctgaacggtcccagctcacatccagaactcacatgggcctcttctctgcatctgtcttcccaaggatgggccactctgaagggtgtaccaaagggaagcagtttgccttgaaggtagcgtatgtgtggatggacctttgaggtgcaggctagggtgtccaccatgggtgtgcaaggcctctagaggtgcaggacagagcagagggtacaaagagtagggaagaaggtaacaggccacagaatctcgctctgcaccaccaaatctcaatatgggacacgcaggaatccaagaactcacaatttgaacttggccttctcagtcagtatgaagtatatttgccaacttagtaagagagaacataaaatatttaataattttgaatttgatttcagatattgagatatactgtatgtcagcatctatttgtgcacttgctccaagccccagaaatgttcggcataggcctggctgcagccctaccagttcccattgtcttacaccagagctgtgtctctcatggacatgacctgtctggtgcttacaggaatgagaggttttggccctagctaaattggtttagtggtgaagaagattgaaggtttttgatcagggcagattgtgccaaatgggctactgcaggcagaggcagaggcaggaaggccagtgagggagctattgcaggagaccagctgggaggtcagagatttgaaccagtaggagcgagagaagaagggacagatgcaagattaattatgtcttttccttccacaatgatctttaggttaaggtcgccaacttaacccaatttagcctgtgactttcttggtttttgctctgcaagcttctgtcccaggaaaccccacagtactggtcacactggggaggctggcttgcctgcctaccacctaaatatcagccaccatcatattgagctcttactatacctcagctgggaacttgagctcaaggctttggacttgagtataactttgctcctggaagcaaactgtctggctatttctattccttgaccctaaatcaaaaaatggcaaataactctcaggccatggagcttcccttgggtgttacagttacagattttcaagtcaaggatatgttcaggacctaattagctcatccagacacttagaatctagattcatgctggaagggaagaaaatgtctccctcctcacctttgctggacacaaggatgtgtcatctttcatctgtttcttgccattgtcattaccatcaacattgacagagataacacatagaaccttgaattatggaatccttattaagttagatactcatctcttctagaaaataaaatgtttattagtaaaagcagaatcctcaggaaaacagtatttataagccctagacacatggccctggaaaagtcacttaacttctctgaacctctttttcctatgaagtgggactaataatccctacgatagatttgtatggagaataaagtttaaaatgcctcatgcacaaaagaattgagagcaaggactcgaacagatatttgtataccaatgctcacagcagcattatttccaatagccaaaagacggaaaaaaccccaagtgtccatccacagatgaatggataaacaaaatgtgatatatccctacaatggaatattattcagccataaaaggaatgaaattttgatatatgtcacaacatggatggaccatgaaacatagtgctaagttaaacaagccagagagaaaaggacaaatattgtattattccacttacatgagatatctagactagtcaaattcgtagtgacagaaaggttaccagaggacctgggggagagaagaaaggagagttattgtttaatgggtacagaatttcagtttgggatgatgaaaaagttctggaaatggctggcggtgatggttgcacaacagtgtgaatgtacttaatgctatcgaactgtaaacttaaagtggtaaatggtattatgtatgttttaccacaataaaaaaataaatgcctcgtgcagtacctggccattgaagatactcagggggaaaaaaaagagctaaaaagagatattaagatgtttctaagtgttactgagttcagaagtgggagttcatactttaaactaaaagtagtcaacgaaggatttgccaaggaggtgggatttgagatggagtttgtaggaccaggcaagggaaaaggcaacccagccaggaggaaatgtgtaagcaaaccatgaagctcctgtgtgtggtgatggggacccggtgatgatgttgtgatctgttttgttttttgttggagactagatttgggatggggtttcaagggacttggagtccaagttgacctgtttaggtgccaggcagagcagaggcactaaaactatctgggcagggaggatgaaaagatcagtgtcggcagaaagatcaatctggggcatcgtagaaaatggattgaatggtgccataccagaggttcaaggcagccagggcagtgttgcacaagtcctagactaaactaggatggtggctgtgcaaaagaaaagggagagatggagactaatttcagaagagccttgatagacttaagatatcaaggaagaggtggcaaagtgttaaatgtttagcagaatagctcaaccctggagccaggtaccctgcatttagtactgctaatgttctaataccagtactgctgcttatgagcttgtgtgaccttgagtgaatgacttaatctttctgtcctgtttcttcctctatcacataacaatgaatgacaaagtagtgcctctctcacaaggctgtcatgaaggttaaaggagtcaatatttgtaaagatcttacaatagtattcagcacagaatatatgcttgctattttttatcttttaaatctggatggttggtacgttggtgtctgttacgttattttttggtgtttgaatattttaaagcatgaccttaaaataatgtactttcaaaacagtcttgctaagcagtgcttcttaaagcttaacatgcatgtgaaatgtttggcagtcttgtgaaaatgcaggttctggttcagtaggtctcaggcggtactcaatggtctgtgtttgtagcaagctcccaggtggtctggtgccgcgggtctgccggccactccttgagtagcaaagttgttaaggaacggagttccatcacggtgtttctaggattgttctggttgtcttttgccacataacaaatcatccaaacctagaagctaaaacgaaaatgatttatgttctatgctgttgttgttattattatctcttgcagttcagctatgtagttcttgggatctgtcacaagctggtggttagatgtagctggggcaagagtcaagagtcatcctgaaggcttcctccccctcgtgtccggtggtagatgctggctggctgttgggacctcagctggggctgtcagcgagaacatctccccagggcatctccatgtggcaaggggctcttcacagctcagcagctgtatctcaagacagagaaccaggcagaagatgtattaccttttcttgcccagcctccaagtctcacagcatcgcttctgccaccttctatgtattagaagcaaggcactaaggccagcccatatgcaagggtagcgcagtgagactccgtgtcttttttttttttttttgagacagagtttcattctgttgcccaggctagagtgcagtggcacgatcttggctcactgcaacctccacttgctgggttcaagtgattcttgtgcctcagactcccgagtagctgtgactacaggcaggcgccaccacacccagctaatttttgtatttttagtggagatgggatttcaccatattggccacgctggtctcaaactcctgaattcaggtgatctgcccgccttggcctcccaaagtgttggggttacaggcgtgagccaccgcacttggctgagactccatgtcttgaagggagaagtgtcaaagaatttttagacatgtctcaaaaccaccacaatggcctgcttaaggaagctctgggaggaacagaaagtggtggatgagtcaaccagggaaagttgactttgttgtgtttaaatttgtgggtttggggtaccatgaagaccacttgaagttattctccaacaggcaggatggtgtgtgagtatctgagtatctatctctcacaccagatcataagcttcttgaaagcaaggacttggtctttttctctgcaatagttctggtgtctaccacagtgcttggcacacaaaagtgacccaaacaatgtttgtttgatgagggaatgaataaatgaatgaatgaatgaatggtaaaggatttaggactgaggctgtgtggtctgaagaagaaaggatactggaattctggaaatctctcccagaacagtcctctctggcacttctcccagggagagggactcctgcatttgctcagaggccaccatggccctgggggtctggcctgcctgctttgcaacttgaggccctcgcgtaccccataggctgtggaaggcctggatctgctgggaaacctccttcttccactaaatggaaactggaattccaggagaaagcaaaaatcaacaagagctattttgattataatgatatctcatttctaagcagctctctctatttcctgtttatagcccaaactgagagcagaagcgactagatctctcagtgaaaggttttctccgaagacgtctagctatatcatcaacaggaaacagtactctcccaagacaaaagtccctgtctctggccactctgttgggtttcattgcaccctacaaagggaggtgggaaacctgggtttctgaaagaggccctgattttgtgttagccttcagcatctaccacttgtacccagctcccagtcccccaaatttctggggactccatgtgaaatcaatgcacaggaattgtggggggaagccctaaggagtccagccgcgattttcagcgcgattttcagggcagctacatttcacttcaaaactcccagtaagtctgccactaagacccctggaaaggctggctatgtcagccctctgtcttcattagaagaatctcaggatttcttccagtgacagaacatgatcctcagattccagggagtgaccccagacccagttcctctccgggctataaaactgtggagtgtgacacagacagagagactgtggtaatttagagactaagaaaaaaactgactagaaagcaactgaacagaacagctgcaggaatgtaaaatgcaagaccctctgatctgacagtcttttcctgcacctctacaaatgtgcgtgcacacacacacacacacacacacacgactcccagaaaggaccctctgaagacaggacatttcagctgacatctgaaagatgaggaaggcagccatgccaagagtattccagaaagaaggaacagggtttgcaaaagctcagcagctccacagctgctggtctgggccaaataggacagacagcctgtggctctccccacaccttgtgcttcctcactcagccactgtgagtctcctctcgcctgaaacagtctcccgctctgtcctaaccttccagcatctttctcattcactctgtctcctgaatatcacccacaaagggtagcagtatcagtcttggtccacacacttatgcaagaagtgccactttgttttctttaaatcaagtgatatcagactctgtaccccaaggctgctggtctggcaggcagttcaaactcagtcgttcacggggctctctcccacccaaggtcatgcaaaggtgacatgctcatcttggggaaggcccatcatcactggttctcactggatttatccttgggtgtgcattgtcctggttttcagagccccttcagggctgaagtctgtgtggcttctgagccaagcttggagacaggagccttggcagaggctgggagcctggaatcagcatccagcttccctgcttacaccacagtgtagcactcccacatcctcaccccaccccaccccaagtgcagcctacagcccctcccctctactgcttctgggagaaagtgcacccctccccgaaccccaccaggatgcctagcttcatctctttagtgaacttttggcttttgcaaaagacctgaaggcccattgaccaaaagtagcctctgcccaggcaagggagcacaaaacccactcatcttctagaaatggactggagagtgcaacacaggaagtgcccacacagatgtttcctagaccttgcctttagggtccctctgttctcagggatgcagtctatccagccctgggaacttgaactccctgagaacaatgtccctctctatctatggtaaaggattaggttttgttttttttcttttaagcttccagttcatctcagaacagtacttttgtaaagtacaatgaaagtgaatgatgagaaaagtaaaatttttgaaagacacacagaatacaggtactgattttttattattagattcaataaattgttattaagggttctaaacatattctttccatttctgcactcacttggtcaccgatcagtaaccaactgtggagggacacggattggtgggccactcactttgaggagcgctgccttagagcactcaggagggagcagtgagtccttcttcacctctagaaatgtggagcttagtgaactgtagaatcttcaaggggttagggtagaagctggaaacaaggacagcctttacctagtgagccaagaaactaaaatccagcctcctcttacaactacttacaatgcaaaaagaattacagtgtaggactatggagcctgcctctggggcaggctgcctggtgatacattcagcactgccacttactgccttgacccaggatgagttaatagctcacagcctcagtttactcatctgtccaattaggatagtagtactatctcatagggtttttgtaaagactgaagttaataagtgcataatcacatagagttgctcttggaaaatagtaagtgcctgtgaatattaaaaatttcctggccaggtgccggggctcatgcctgtaatcccagcactttgggaggccaaggcagaagaattacttgagcctaggagttttgagaccagcctgggcaacatagggagaccctgtgtctacaaaaaaaatttaaaaaattatctgggcatggtggcatacacctgtagtcccagctactcaggtggatgaggtgggaggattgctcaagcccaggaggccgatcacaccactacactgcagcctgggcaacagagcaagaccctgtctcaaataaaataaaataaaagtttccttagaaagaaagcttcaggaggttagggatctttatttcctgatgtttcccaaatgcctagaaccatgcctggcacatagcagtgctcagtaaatatcagtgaatgaatccatctccttatccaatgctgaacttcaggcttccatgtttatcccactcttagtccctttttttttttttttttttttttttttttttacagagaaaaggggtctgtttgctctttgtgttctttgtgttcatagtgtttccaagccccaggccattcagagcttttgtctccagtgccccacacattcaagaaagacttgaattgcctctcaggtctgaacctgttttgtgcagggtgtccaagctggagtgcaatggaccggtcttgactcactgcaacctcccactcccggcttcaagcgattctcctgtctcagcctcccaagtagctgagattacagacgttcgccaccaagcctggctaatttttgtattttcagtagagatagggtttcaccatgttggtcaggctgatctcgaactccttacctcaggcaatccgactgcctcagcctcccagagtgctgggattacaggcgtgagccaccgcgcccagccaagatacattgttgcagagtgtaaaaccagatcttgttgacctggcatttagaccttccaaaatctgatttccacctgtgtttctaggcatgtgacccactgcacactacacagcccccacagggaccatttctcctaccctgagcaagccattcctccaagacacacttctttgcaactcctgcccgttgaaagattactcattctaccaagccaggcttaaatgctgcctactctctgaagctgtctctgatattccaccagagttcgtctctcatctgcacatctactaattctctgttctcaactcctgttcagaagaccttgtaatcaagttcattgtttgcacatctgtccctttactaaggtggaactccttaaggacaagggaccatatcttcagcagctctgaatagcattggtgcttcatgcagggccttgcctataaatacaacttcaacaggtgggagttgttggtgggttcccacctgcaagcataagtcagcaggcttcacagtgagtggcctaacataggtgtggatcagaaggaaatgaaagcttcattctagcttccccaatactacttgtctcttaccattccgttgtcttgagtattctttggggaacctgctgatataggaggaacagtggcttcaatctgaaggactgtgccagcttagggtgagtatgactcagtctggaagcagaagcagaagggaatatggttttgtggatgaacgtgggagacagcatggcatgaggttagtgctctgaggtctggtgcatctggcttcctgtctaggctctgctgctgactggctggatgacctttagcgtattcttcatgctttgatgcctgtttccccatcagtatactatagacaatgttgggacctcccctaacccctgccactaggggcataatgaagaggaagccaaggggtgtgcatatgaccccaccaccagtctgcagggaatgccacaaagatgctagcctttgcaaattctggtgcagtgttacgaggagacaaagttcacaaacattaccttgcccctgggtaccacgtgacttttgtctccctatatctcctgcacaattgcaaggattaaacatgctaatatgtataacggacttagcaccctgctctccaataatggcttaataatgctctggtttctcttcagatcatataaatctttcaccttttaccaataatggcttaatacaccttttaccaataatggcttaatacacataagcaaaaagactcagttaatataggctataagttggaatcaataatccatgaaagaaaccctggatagggtttttaggacacaggcactgctataccctaatagaatggatcaactttcattcagttaaaaaaaaatctacttcttttttatgccacaaagtgccaccttaaatttatcttagtgattgaatgtcatacccaaaagaatcaaaagcactggagcagttgatctggtagaaacttcagcatgtgtttgttcattccacaaaggtttactaaacccttgctttgtgacaggcactgtataccagttggccttctctctacattatgctgttgcaacaggcaaccccagtaatggtttctttcttgctactggagctctgttctaggtgtcttcattcctggacccaggctgcaggatcagcccctatatggaacatgccattcttatgacagagagaaaggggtactaggagaaccatatagtggctcttaaagtcatgcttggatgtggcacgtgtagcttatattccattggccaaggcaagtcacatggccaagcctggcaccaatggggtaggggagtatcctcctcccatagagcagcactgcagatctcttgacaatgagtgaggatatataatcctcccacagggaaggcagaaaggatttgggggcaataatactgtctgccacatgctgtcatgaatgctatctagttttagtctcttgataactctgtgaggtaggtattattatcctcattttacagagtggaaaattgaggtttggtgtggctaaccaacttgcccaagatgtagccagtaataagcacagctgcctgaatcgaagccagtaccaatggtatatagccagccttgggcttcttgaggactcattttcatatagatgttgtcattcagtaaacattgataaagcatctactatgtgcctggcgctgtgctgggcattggaaacacagtgatgtgcaagacagacactcttcctactctcatggagtttagagtccaaaggaagagagaggcagacaggacacatgtaaagtatgactggtatgtgcttctatgagggagatgcagactaaagcaagagtccatggagagagcatgcaaccagactcagagcataagaaatggacatgtctctgatgactgcacagaatgtaagagctggaggactgggtcacatggctgttgtcaaggccctgcctggcagggtgagtgccaagggcagtttctgattcagaattctaaagggcactcacaagagttcaatgccgatgggcatatgcccagcctgttgctaacgggactggacaaaccagtggctgtgtggcaggaacctaccatgtgcttccgactagtgagtctgacccaaagcccttttcaggcttcttctgggagtgttgcctctgccttacctacactcagagccatgcatgctgaaaaaaaaaacccaaagacccagagatgtcaacaacaacctgagagagaaagagaaacccagatttgatctgattttgaatcggcagagtgacacatgttgcttagactgccaacgcacgccactctcacttccctgaatggtttccattttagtggcattgtaataaaaagaagaaggaaaaaaatcccctgcaatggtttacaaagtgtaccgcaatagtaagaaataccattttctcatcactgctgctgcagcaccagagtatggggcccagcactaggcctgtctttgcaagcaggactaattacatagtaagtgattgcccctcaaacagagatggcatgtgtgctgggaaataggtcacttcttaatgaggtgaagctccagcaagaagcaagcacagatgcagactattcctcttgggatgcaaaaggcatctgaaaggtgagcacatatgtcccataggggagcctctggccaaatgtcacatctccagggaaatgtctttgaaacagatgactctactttcagcttggttatggacacacacaaccttgaaagtttcagaaaatatcacaaagccaaatatatatgtatctgcacgtgcacacacacacacacacacacacgtttgtgtatattaggattcttaagaaaagcagaaccaataagatgtatgtagacatatggaaaaatattatgagggattggctcactcaattatggcggttgagaagccccacgatctactatctacaagctggaggcccaggaaagccaatgatgtaattccagtccaacccagaaggccagaaaccaggggagtcagtggcacaagtcccaatccaggtccaatggtccaagaaccaggggcaccagaagacggacatcccaggttaagcggagagagaaagttcacccttcctccacttttgtgttctattctggccttcaacaaattggatgattgcccacccacactggtgaaggccatctttttactcagtctaccaattcaatgctaatctcttttggaaacaccttcacagacataccaagaaataatgttttaccatctatctagccattccttggctcagtcaaattgatacataaaattaaccatcacagtaggtatatgtatcttcttacccttgattgtatttgaaaactacacatggacactactgggctttgagtgtcgacttgctttaaaaatagtcttggagcttggaaaggagcccttcttggagagacaagcaaactgactcagcccgagggttatgggcagagaacctgcaaaaattgtggttcacagccaccatcatacattccttgctaactctgacacaaatggtaaaatgatgaagagctacacattgctggggaaccacggggcctgtgcattcagggtcagccggtggggaggaggaagagcagattaagcaagtatgtcccatgccccatgcctcaataatcaggataaatcatattttaataatgcagtattttagaaaatcaaattagcaaactatggccatgggccatctgcctgtgtttataaataaagatttattggaagcattttttctgaaactattccaagttttactggaacggagtgtagtgtgcctgtttaaattttacacccaagccaagtccttaccacctcatcttagtcctggccctgcctcatatccatttactcatcatttccttctcatccagcactacagagtgccaggcactaggagacagagctaacagttactgagcacttaatatatgccaagtactatcattagcagtttacacatattacctcacttaatccccacaacaatttcataggtaagaacagttattcatgccattttacaaaggaggaaactgaggcatagaaaggtgaagaagctttcccaagatcaaacaagtaggaagaggtagagtcagggttcatatgaagaagtttgagggctttgatggagatggatgcctggagaaaggaaggattactcagctctgagaggtcatcacagaggaggtgactttaagcagggtgttgaagggtgagtagaagattgctaggcagaaataataaatctaggttgctgtagtgtttcagaagagaaaatatatctggagaggttttctctggcttccctaggcccatgtgttgccctaaaatcagaacagcagcaaaataatacaaataaccaacatttattgagtgcttaccctatgtgctaggtactgaactaagtactttatatgtgttatctcattaaatcctcaaataaacctgagaaatgggcactactcttatttctgtctgacatatgaagagtctgaggctcaaaggagttaagtaacttgccaaagctatacagatagtaagtggctgagccaggatgcaaaaccaggggatgccacagtgtgaaccgcagtgggcactgctcatcttgtagtctgtgcaaaacccaaaaacttggtgccagagcttcaggcttagcaaaagcaatatgccagtggtgctcaaacttcacagtgcatccagttcacctgaagggcttgtttaaaaaaaaaaaagcaagcagatttctaggccaccttagaatcagagattctcatttaggaggtctgaggtgaggccaagaatttttatttctaatgctgctggtcctgggaccagacacggagaaccactgtatcacattgactctcagcaacagcaatagtactgtcctcctaagctgcaccagggaatacaagtacaggaggtagttgaaagaacatgcttcttccttcttagtatatagatcaggatccacttagtgagaaacattcaacctcccttctttttattccagttgtccttttctctgacacttgcatcaattttctgattgcctaggctcttaatattgctttctgttcatgtgggctttaatgacttgctcgacatgctagtgcttttgcagaattaggcagcccatgtcccaccacttctgctctgagcctgatgtgcctcttaaattgacacaaactccagctatcaatgtgagaaggatcatgtgtttcctgatggttctctaggctccacaggggccaaattacaccaaaaagtaattggtttcatgtattagtcaggagtctttgggttgcaagtgacaaaacacaatttgaactgatctggaaaaactgacatttactgacatacatatcctgatcacaggaagagcaagggtgccgctggtctgcaagcgtgacacatcagggctttaaatgctactgggactctgcccttcaccccctgcctctctctgggtatcagcaacatcctttcaggcaggctccaaacagcttcctttgactcccaagctctgttttcagtcccaccttgaaatagggataaacagacctggtttctggattctgggaaagggctcttggtggcctagcttagatagttgtccatccctggaccaggaccttggccattttggatgtctacccatacccaatctgagatggagtgggacagggcttgtagaagatgttagctttccctcaaaccataatgtcagagtgagtgaaggagcatttctagaaaagagaggaagagatatttggtaggaaaataaagccccagaggtgagtgggtgagtggaaggagggatgcatgcctcctcaggaccaggtgctgaggtggcagaggggagatggagagaggggagaaggaaagtctcagccttcctggaactcacagtctagaaaggccaagtcatgccagagatgtcagtggaggttggcagacatttctgtggatcacagcaggaggcatagcaaatatttcatctcaaatattttgagaaaacctgggttcttctggatgggctcatctattcacccccacccccaaccaacttttgagcatctactgtgtgttaaacaacatgtctgcactcaagaagctgagcattaatggaatgccctaaggtggcatcagaccttgtctctagtggatcaatcactcccaaagatgcatttaaagctccctgaaaaggagcatctgcgtcttcactggctactgtccccatcctccttatgttgcctgtaaggactctctttctatatccactcaggctttcacaggccaaggctctacctcacttttgcagggtaatctcactgagaatgaagagtcccctcactgtggctttctattttctcactctgggtctgtaagtggagacagtcttctatctctttatgtcattgcctttgatttccttgggattctccctgagattcgttggccatcttaagctgtggcttccagagctttttattaaaaatggaacaatcattgcaaagccccctcagccattcaatagtgtcactagagacacgcttgactccatttctctgactgagctggcagatgttgaccctgggagaggacaggaggcaggtaccactgggcccctgtttccctttctgtcttctccacaagcctctctgctccaggccttcttttttttttttcttttgaggcagagtgttgctctgtcacctgggctggagtgcagtggtgcaatcttggctcactgcaacctcctccgcctccctgtttcaagcaatcttcccacctcaacctccagagtagctaggactacaggcacgcaccaccatgcccagctaatttttgtatttttagtagagatgggatttcaccatgttggccaggctggtctcaaactcctgacttcaagtgatccgtccacctcggcctcccaaagtgctgggattacaagtgttagccattgcgcctggtctcaggtctcctctttctaagagtctagccatgagggtggaggaagaacgcaagccttgctctcaagccccgcctgtcttaagagtctgaggggcagcatagcctgaggaacttatgtgtggcaacgtggggatatcagtcacctgtctcttaccccactgggaatgtcagtagcccctgtctctacctctgcagcaatgtagtaaaccaagtttaaaggtgtcttgcttcatctttgtactttccatattgaggatacctttctctctgcctgtctgcctgggagcttctatttggtggctgtctttactgtctttatttcctcaatgcctagcatagtgcttggagcacaataggtattcaacaaatgactgatcccattaatggaactaatcaaggaaccatctcaaccattcccttaaaagtaagggatgagtagggacaatattgtgggggcttctgatgttattgttggatttggtgaatgataattaagagcacccttaaattccctttaaattcaaaatagattgaaaaatgagacaacatgagctttttatttgtatggctgattagtgaatatgatttagatctgtgtgctgaatacatcctctgctgaattaaactctcccccagacgcagacaggcctggatgacaccggcatcctctgggaataggctgcttttcaaaggacacaggaaagaagtgtgtcctcaggatattcccaaaagggtagaaaggccaccccacacatgcccatccctgtcatagctgggcctgctctgagctccctaaaccctcactgtgccctgtgcccatagtaggccactccaccatcactcttcttggttctcaagttccaggagctttgcaaacaacagatgcttccctagtataaaggaaagaacaagtctttgggccatgggtcctcctcttctcagtgtccctggataaagtcatctaatcaccctgagccttgctttcctcagtgaaagaatggggctgatctcaaccttgcctgccatcgaggctcagatgacctccaaatgcatcctaaactgctcacattcttttgcaaggagggtttttcttcctcaaagcaaatgggagggccaagtaagagaatttatacaagggctttgaaaagagctctgcatgctccttttggaaactgaggcaagtgagcgctaagtaactttctggaggcctcatcgtacaccagctgggattcagcctcaagttgtgcatgttggcctccaaaagccctgacttctcgctagaaggagccttctcaaatgaatcctatgacgacctaatgcaggctcataggtctcactccagaatactgaatcagagcatctgagatcagggcctggaaacctacaggttaacaggttccttgggtgcttcttactgcagtagctcaagctgtcccatggtgatgggctggagctgccacatacaggccaattgttctactcagttattctcatctctgccatttccataatgacttagcatctatacccatctctaaaatgttaaggcactttgccaaacattattttgtttaattgacagacagaaccatatagtggttaagaacctagtttctggagctaagctccttggtacccagttgcagctggggtgcctcccagcttcgtggtttgtgcctccatttccttctctgtaccatgggaatgcgctttgcatcctacctcataagagttgttagcagtgaagacttcagtgcactaaagtacatagaatagtgcctgttgtggagtaggtgcttaataaatcttcatttattattcctaatgaggaaatggaggatagatttgtgtaggatacagtaaaaagtggactgaccacagccaacacccaggttttctggttctacttctacacttccatgaacttaatctttgtttgcctttcaaagtcacttagaatttaaagcagtagtaaaaatacctcaaatgcagtcaaccaacaaatatttattaggttttactgatgtgtgcaggatgctgtaggaagatatgaatggatgttattagcacacctaagctgcttagatgggcttgaagggttgagagaacagagaagtagcggaatgaaagcagctttgaatggcaggagcttgtctagggagcagaggcctaggtctagctgagctgctcacctggtccccatcgcccacaaagctttaatcaagatattctgatcaggccaatgcttctgaacaggctaataaggaattaacacataaatgttgcttagcaaacttctccctagcatggaactgaaacagggacagtgctgagagggaggttttgttttgttgttgttgttttgtttttgtttttgagatagggactcaaatggcaaacaggtatttgacaaggtgctcaacatcattgatgatccaaaaaatgcaaatcaaactacagtgagaatcatctcaccccagttaaaatggctgttacctaaaaaacacgcaataacaaatgccggcaaggatgtagagaaaagggaacactcttggtgggagtgtaaattagtacaaccactatggagaacagtttagaagtttctcaaaaaactaaaattagagctaccatacgatccagcaatcccactgatgggtatatacccaaaagaaaggaaatcaggatattgaagagatgcctgcactcccatgtttgttgcagcattattcacaatagccgagatttggaagcaacctaaatgtccatcaacagatgaatggataaagaaaatgtggtacgtgtacacaatggagtactattcagccataaaaaagaatgagattctgtcatttgcaacaatatggatggaactggaggtcattgtgttaagtgaaataagctagtcatagaaagacaaactttgtttattttcacttgttggtgaggactaaaaattaaaacaattgaactcatggacatagagagtagaaggatggttaccagaggctcggaagggtagtggggagggggaagtgggtatggttaataagtacaaaaatatgattagatatataactagaatgaataagatctaatatttgatagcacgaagggtaactacagtcaataataatttattgtacgttttaaaataactaagagtataattggattgtttgtaacacaaagaaaggacaaatggataaatgcttgaggtgatggataccccatctaccctgatgtgattatttcgcatcgtatgccagtatcaaaatatataatgtacttcatatattatacctacagtgtacccacaaaaattaaaacagtaaaatttttttaaagagagagagagacagggtctcattctgtcacccaggcaggagtgcagtgcatgttcatagtccactgcagcctagagctccagggctcaagagattcaccagcttcagcctcccaagtagctagggctgttggtgtgtgccaccacgtccagttattttaaactttttgtagagatggggtctcactatggttgcgtaggttggtcttgaactcctgatctcaagtgatcctcttgctttggcctcccaaagtgttaaaaatataggtgtgagccactgcacctggtctttagtctggtttttgacaagaaagagccagccagctgtctgcccatgtctttgagctacatgaagattagatcccattagtcttggagagggagcaacaagaaatagaagagggcacagaactgcacgtagcctcacctacttcaaaagtttcccctaaaaccccttaggcattcaggaatgggtgagaaaagggttttctttctatgagagtggggattcctctataaaatttccggctttcaggatagcggactcacattaaagtgttaggggctagcctgaaaacctaaattgttttccttgacaaaatgtgccatagatgcgaatacctgattctggttaaagagttggtttttgctgattatgtagtataaaatggaatctgttttccactttccttctcttctaccatccctttgctttttctatgctctctcctctctcaccatttgttccattcatgctctctctcttctttttcgtctccttctttttccttctcaccccactcctcctttttttcctctctctctccctcttcttttcctctctgtctatctgttcttgttttcttaaccccatattctacaaagcatttagggtggcttgcagaaatggaaactaatatagtaaaatgtaagtaaaacatgtaagatctggctgggtgcggtctcatgccttcaatcccagcactttgggaggctgaagtggatggatcacttgaggctaggagttcgagaccagcctgaccaacatggcaaaaccccatctctactaaaaataccaaaattagccaggcatgatggcacatgcctgtaatccgagctacttgggaggctgaggcatgagaatcgctggaacatgggaggcagaggttgcagtgagccgagatcatgccactgcactgcagcctgggcaatagagccagaccctgacttaaaaaaaaaaagaaaagaaaagaaaaaaaaattgtgagtcagatgctcaatggcatcaaggagataattcatatagaaaacaagtattcaggaatgaatttattgaataaatcatcataattaatgtgtttttcaggatcaagaggagcaaaataatttaggaacaaatagttctgatgagatgctaaaaacttacctaatgtgtatacgacttcatcttttttcttcagtcttgaccactttttggtgcgaacttctccattgactttgagacccttaaccctatatatttttaataatactattggggtagctaaaataaattagtacagtgaagtatatctctagtctcttaaatacatctctaaataatgaatatattcctgaagatttctttgtatttgtaattattgcagatcaaatattttatttccatagaaaactgaccttctaaagatgatacaaggtgtctctctttagtattaaagaatttatgctttaaaactttagatactgggtatggtgactcttgcctataatcccagtattgtgtgaagctgaggtgggaggatcacttgaggctgggagttcgagaccaatttgagtaacaaagcgagactagattgagcaacaaaatgaggccctacaaaagaattaaaaaaaaaaagttaaattaaaatagataaataaacaaaattttagaaactttgggccaggtatggtagctcatgtctgtaatcccagcactttgggaggccaaggcaggaggattgcttgaggctaggagtttgagaccagcctgggcagcataggaagaatctagctctataacttttttttttttttttttaaagaaaaatcagctgggtgtggtggagtgcctttaatcccagctactcaggagactgaggtgggaggatcacttgaccccaggagttcgaggtttacaaagcactatgatcgtgccactgccactccagccagggcaacagagccacaccctgtctcttagaaaaaaattttaaaaaggccgggcgtggtggctcacgcctgtaatcccagaactttgggaggccaaagcaggtggatcacctgaggtcaggaggtcaaggccagcctggccaacatggtgaaaccccgtctctactaaaaaatacaaaaattagccaggcatggtggtgcacgcctgcagtcccagctactcgggaggctgaggcaggagaatcacttgaatcaaggaggcagaggttgcagtgagccaagatcacgccattgcactccagcctgggtgacagagcaagactccgtctcaaaaaaacaaaacaaaacaaaaacaaaaacaaaaaactagatattttgcacgttacctttttaaaagcctgacatatctgtatgatatccctgcactaaacatttgctatccataatgaggtaaaatgtgcttgggctttttccccaatgtgaaatatgcttaattgtcttgtaaaactgtcttgagtaatcccagcactttgggaggccgaggtgggccgatcgcgaggtcaggagatggagaccatcctggctaacacagtgaaaccccgtctctactaaaaatacaaaaaaattagccaggcgtggtggcgggcacctgtagtcccagctactcgggaggctgaggcaggagaatggcgtgaacctggggggtggagcttgcaatgagccgagatggcaccactgcactccagcctgggcgacagaacgagactccgtctcaaaaaaaaaaaaaactgtcttgagttttctttctttctttttttttttttttaacagtcttgctttcttgcccaggctggagtgcagtggtgtgatctctgctcactgcaaccttcgcctcctaggtttaagcaattctcctgcctcagccacctaagtagctgggattacaggcatgcaccaccatgcccggctaatttttgtattgttagtgaagatggggtttcaccatgttggccaggctggtcttgaactcctgccctcaaatgatccccccaccttggcctcccaaagtgctgggattacaaacatgagccactgcacccggcctttgagttttcttttattccggctgcatacctcccagttaatctgacatctttctcacctcattaaactggctccaactgctaatacgtcatcaaattcaaaagaaatgcgacccgctaccaaaatccagatctgaaaacatttaaccttaggctgtggttcaaggtgcaaagaaagctaatatctaataaagccttggtatagtgtgttccttgagtcaacgtttgagaaactgaatgacatagagctgcgtgaaagtttagggggtaaaagtgtatttgattgaatgtaattaatgtgtttttctgaatgattttcttacagttcacaatgaaccttccaattttacagtaattttcttggccttgattttctgatctgtcttaatttagctgtcaatactatgagtaacaaaattcagtttcattggtgatccttgaaagagaaattccaaaaataaagggctataagcacctcctatgaaaagattcatgcagctgtttcatctaatatggatctgataggtttcctttatgtccagttcttcctttctcaacattttctctgattttcaggcagatgcaaatagaattttcagtgctacggcttctctgacttaaattttctgtttcccttgtgtttgtgccaattaaaacaagactcagtctgtgcttgtgacatatttttggaaattcattgtgtaagaaatattgacattctcttgtattattttctctgagtctttacccacttcatcacaattcttgcctttcttttccttgaagtctgtgtgtttcatatgttttgaaaacttctgtcacatattttagttattataatggataactgcattgaggagaaagctctaaatcataggcttggaatgactagttctagaagcatttcctaaagcacatgcccctcctcaatagacatttctctgccatttattttgtgcagcagttcatatttgtggcctgatgctatctcttttctcagaaatttcagtaagtgtttcaacttgagtaatcatttacagaaacataatgtagtggacattcaataataaactattgccatgacattgaattgtcttatgatctttggtggaagctgtgtgaatatttacattgtcaggatcatgcacctacccgttatgttctgccttcctttctctattcttttcttttcttttttttgagacagagtcttgctctgttgcccaggctggagtacattggcatggtctcagctcactacaacctccacctcctggattcaagtgactcttctgcctcagcctcctgagtagctgggactacaggtgtgcgccaccacacctggcttatttttgtatttttagtagagagggggtttcaccatattggccaggctggtctcgaaatcctgaccttgtgattcgcccacctcagcctcccaaagtgctgggattacaggcatgagccaccatgaccagcctgctttcctttttcataatgtgattttcatgtacacgtctctgtgtttttcagcttcagataaaaacttgctatcttttgggcatttctttgatatatcatctccaaagtgacttattaagtcaaaaatataaattattttatcatttcctggaatgctttttctacaagtaacagaaaattatatctcagttggcttgaacaacaagaaaacaatataattgcccataacaagaattcctgtggtagggctgctatggagttgtttaattttacaacacagtgacatcctcaagggcccagtttgcttccatgtttttgttctgccatctttgggggaacatctctgttgtgaaggatgtcctcatggtcacaaaatggctgccacagcataaacatcaccgtacctcacagatatgacaatgttcagtggaagaagaaaaggaagtttcttcatctgtgtctcttttaacgagcaagaaaatattagagattcctcatcagtctctgtttcattgttcattcaacatttctttggccagtccctttcctaaaccagtccctggcaagggacataggatttctaccatgaatttagtatgggttctgttctacagagtaagggtgctttctgctacatgtcctttgacatgtggcctaggttattattatctcaagaggcaaaactgctttatagtaccaatctgcagtctaataagtgtgtttgttccctaacaaagctaagtttctatatgtttttgcttattgttataaatttgaagggtccttgtataatgaaaatattattgtaatttatgtttcttcagtgataacaaagtcatatgcagtctttttagaatgagttagtttgttttcatttcctctagtgttttacctacactgaatttgaaaactccattctaaccaattttatatagtcattgtgccagaatatttgccaccactcattattctgtaacatttttgagtcacagaccatatctactaaataagccaacattccaaaagtcttccttataagatgttaacatttaaaagtaggggaaaataaaagaaagaaaaggaaggaagggagggaagaaggaaggcaagaaggaagaaagggagggagggaggaaggaggaaggaaggaaaaaaggaagaaaggaaggaaggaaggaacgaaggaaggatcgaagggagggagggaaggaggaaggaaggaaaagaagggaaggaagggaagggaagggaaaggaagggcgggaggaggaagggaggaaggaaggaagaaaggaaaagaaaaagcaagcaaacaaagaagtgaagggatagtaatgtggtttggttgtatccctacccaaatcgtatctttgaattgtagctcccataattcccacttgtttcgggagggacctggtgggagataattgaaccatgggggtggtttcccccactgttctcgtgttagtgaataagtctcacaagatctggtggttttataaggggaaaccccttttgcttggctctcattctctcttgtctgcctccatgtaagatgtgcctttgccttctgccatgattgtggggcctccccagccaagtggaactatgagtccattaaacctcttttcctttataaattacccagtctcagttatatctttatcagcagcatgaaaacagactaatacagatgtgttgagaggtcaaaaattctagatactttgggattgaaagacatattgaatctggagcgaaaaggacaccccatttaacaaactgccaaatgcccctctcccaagggcccctcccttcccacctttatctgaacatcgaagtgtgccatcctgttgtcttgcccaacaatgaatggcaaggcaagcagctgggactatctactcgtagcttgtcacaaatgtgctccaactccagaggatggtgcagtaatttcctccctttttctttcgggttgtgctttctgctactcaaaagttctgctctcctgtgatcaagatggtaagtcctgtttcatgctgttgcccctttggaattgtgccttcaaattccatttgcctggaacagtcacattcttcagagtgatgggcctcaaccacaaaacagcaacagcaaaaaacatttttctctaatatttgttactccaaataggttatcttcaatacgttattgtggtaagagattcttctcaggagtgtttgctgctgtcaggggtaacatggtgaaggatagagcaagccctgccatgctccagtctcagctggctgtgtggattccacccaggaaaaccctgccagcttctcctactgtgggtccatcacagtctgtccattcttgtcccatctaagatataagttgtcatagatggctgccccctccaccattcgccacgtgggcatgtaggtcacatctcaatatgtccctaaagatccctctcctaatctaaatgctgaacttccacgtcagttaaggattgtttctctaaacacacaccaaaaggggaaaacatagttacttcctaaattcttatatccagaatggaaataatttcgggaataacaaactccttatgtttaccactgttccactgtttaagtcactgttttcttttttctttctttctttttttttttttttttcttttgtggcagggtctcactctgtcacccaggctggagtgcagtggtatgattttggctcactgcaacctctgcttcctgggttcaagtgattctcgtgcctcagcctcccacgtaactggggttatagagcccagctaatttttccatttttggtagagacggggttccagccatgttggcaaggctggtctcgaacttctgatctccagtgatccgcctgtctcagcctcccaaagcgctgggactacaggcgtgagccaccgtgccttgcctgaacgcattgttttcttaggggttggctagatgtcttcatgaagatgcaacaggctgcacttcagtgtgtcagaacaggtgtggcacagtgagcccacatatttctgtatagtgtcgtcaaagctctttccattagtgaccctatgtaagcgtaccccaagttgatcctagtctaaaaagcagggtctcagggcagagttcagagccagctcctcagattcttagtccttgcttcaagagctacctttaaaatggctcaaaaattcaactctctgtcaaagtaaaagtgaagccatctggctaggttgaacaaaggcagcttcgctttactgcaataggcatcagaccaaagccacagatcatttgggtgtgggaatgtaaagctgaatcagtgacattgccagaaaatggcacatttgccagaatactttgccttttgttccttgtgagataaacatgagcccagaatcctgtaaatctgtggtaatatttttactcttggagaaaaaaattagaagacaacgttgagaggctttttccgcattttccaaatttccttttggtgccgagtaatttgttttcaactagtgtaagagggccatcttgggctagtagggaagtcctctaagttagggctcagggatatgggcttcctagggcaattaccccttacctctgtttctgactgttgggggttcttgaagcagctcacccagggtgagactggtgcagagagcaacatttctgcctccctggttgggaagggagccaggttatttttttaagtgctacctattgacagcattttctctatgtctcagtttttcttcttcctctaagagctttttataatagccttaaccatcatcacatttttttttttcttttttttttaagacagagtctccctctgtcactcaggctggagtgtggtggcgtgatcacggctcactgcagcctcaacttcttgggctcaaggcatcctctcacctcagcctcccgagtagctgggactacaggcaagcaccaccacacccagctaatttaaatttttttttttcagagatggggcctccctgtgttgcctaggctggtctagaactcctggactcaagcaatcctcctatcttggcctcccaaggtgtaaggattacaggcgtgagccaccacacttagccaccacacttggccaccacgtctttaagattatgaataaaaaggtgtcactttcgaagattctcaaagggagtaactcctccccctaatactgagctgcagtccatcttaagccttgctggtatacatctcaaagaagaagatattgaggatagcttgtgcaacgtagctctggtggccgctaaggaaagagcaaacagctctatggctgcagacatcaggctttaaatgacaccaggatggtgaatgacctaggaacataaacaaagggatgtctcagctgggacataatcgcatcctggaagcttgaaggctgttttgtagaggaagaatagacgtgtgtttgactccagaagaccatgctaggaccagtagttacataaaattaaattctagctcagtgtcgagaagaacattctgacctgaaagttgctaaaaatggaatgggctgtgtattggtttcctaggactgccatagcaaagtaccacatattgggtggcttgaaacaaccttgttttttttctgggttgaaattaatttcttctctcacagttctggagcctagaagtccaaaatcaaggtgttggtagggctatactctctctgaaggtctaggggtgcttccgggcctctctcagcttctgctccccgaagcattgcttggcttgtggtagcataactgtcatctctgcctctgtcttcatgtaaccatcttcttggctgtcagtctctcttcttattaaggactcccagttatattggattaaggcccaccttgatgacctcatcttaacttggctacatctgcaaagatcctatttccacataaggtcatattttgaggtactaggggttaagatttcaaaatatctttttaattttatttactttgtttatttattttgagacagggtctacttctgtcgcccaggctggagtgcagtggtgtgatcatgactcactgcagccttcctgggctcaagtgattctcctatctcagcctcctgagtagttgggactgcaggcatgcaccaacacaaccagctaatttttgtattcaaagtatctttttgaggaacacaattcaatccataacaggctgcctttatgaaagtgagttccttatccctggaagtgtgcaaatgtaatcagagtttttcaaaatacttgaagaggtgtaagcgctaaagagagaatgcaactagatgacttctagcatctcttctgaccatagcatttcctaatgctatgagtcctgtagtaaatgactctactaaatcctgggaccacacttgggaagaccacacagtcttggtgaaatgtcacatgcacggaagcatagtctagcttccaaaaaccattgaaaggagtttcaatcttttcttttaaattcatatatatgtatatatatatatatagagagagagagagagagagagagcagagagagtttatttgggccaagcctggggactgcaacccaggagcatagattcaagttgccctaaatatacactccctccttttaattcttaaagaacatcaatgaagatccctttttctgtcccctgcagctgctcctcttggagtctctctgttcagtactcttttggtcacacatgacagaatcctaattcaaagtgccttaaaaaaaaaaaaaaagataatatcttcttgcaaatttgaaaagtccaggagttgttgttttgggttggactccatttcccagctttgccttcctctctgtgggctttctcttctgcatagtgtttccactaagaggtggccaccagggttcccaggtgttatttagcaattgagcaatttagcaaactcattgagaagagtttccttcttccagcattctaagggaagtcccagggctggctctcattgggccaactctgtcacgtgcatttatcacatgcccatccctaaacttgtcagtaggacactgaccacctcctgaggaagaaaacttaggaatggaggcacctctatgtgagttgcataaactaggaatagaagagggtagcagcccaaagggaaattggagtgctattaacataataagggggagtccgtgttgggagggccaaaggccaaaaccatcactgtctactctgattcctcccctcacaccactattctctcttccttcctctcctcattctccctccccttcctctctccctttcttctctccctctgtttttctctctctcctttcctctctctctccctcttctttttcactctctttctctctgtctccctttcttctcctcctctctcttttactctctccccctctttttctcccctcacatctctcttcatctctccctgtctctcaccctcttcctcctctccctcaagtctaggcagctcagcctctctcttttttctcctttctttttcctcctgcctctccagcttatctcttcctacttattttcccaattcagtattataaatacctagctactgggctggcaaatactgaactctcccttaagggtaaggacgggaaagaaatggagcctgccagtgccaggttcctttagcagctaaggggagggaggacgggaggaactcccattggtaacttttattcacatcgtatatcaaatcatcagagtgatcctgtgtcattttgagttgtgagtgctttaaaaatttgcatgtgtgtccaggacagagatagatgaatttgcacatgacggcagaggaagactttgggatgtatccactttgatgctaagttatggatacatcccaaaagactagacaaacagtatctgtgttttagcttccagacttctgtagtgggtccagccaaactcccgaatgggtttttaaacttgagaaacctcaggcttttttgtttccaatcatacaagcactcttgaattgaaagcaacactgggtcataaagcaatatgaaaactacataactaatatcttgatccttctgctttcagcacatttagccccacagcagtttagactcaaaccctctaaacaaaccaaccccctcaccccactcacaaacagcctgccaagagcattgagcgtccagtccctggactccatcctgaccacctcctactcccccgtcctgcatcactggtcttgctttggtcatctctgtgttctccattgctctgtctcccctccgccaccccacacccacaggcttggtgagttgtcccccaacactcatatttagactctcccttcctcaagcccccttgctctctgactctgctgggaggctctgatcctgagccctgccatggacctggttctgggagttgacctttgccccacacccatcagctgcgagtcaggggctctcttgttctatgccttgacctggtggtacccaagtgcattcatttgctagaattcatttgccataacaaaataccacagcatgtctacaagccaccagggctgccatgtataacactgggtggatgattaccctaaaacccttctggaactttccagataattcttttaaaaatattctcttttataggcttctacatgattcaagtgagtttcctaaatggctgggtgagctcccataggtgacctgacactgccacagccctctcccacccagggactggagaggaagctctggcaggacacccagaactcagggtggaaatggaacatcctggccacctacccaggagaggcctcatgtagtaagaaaagggagaggaaggagcagtgctagaaatcagattatacagacagaaaaccacctcccagactgcctgatggcagggggtgggtctttccatcttaatctttccagcccaagcaccatgcctgcaacacaacagaaatgcaaggaatgcagttgaggtggtgcattagtctatcctcacgctgctaaaaaagacatacccaagactgggtaatttataaacaaaagagatttaattggctcacagttccacatggctagggaggcctcacaatcatgacagaaggtgaaggaggagcaaagtcacatcttacatggcggcaggcaaagagagcatgtgcaggggaactcctctttataaaaccatcagatctcacaagacttattcactgtcatgcaaacagcatgaggaagacccgtcttcatgactcagttacctcccaccaggtccctcccatggcgtgggcattatgggagctacaatttgagatttgggtggggacactgccaaaccatatcaggtggggagtgatgtgagcacagctacatttctgaaaaataatgatggtcatggaatggaagacagatctgagctgaggaccttggaggcctgaactggtgcacttgccatgaggatggagaggaaggatgaggcaggaaagatactgcaggtcccagcttctccatgaatccaagggctttgctctccactctgccttcagcctagtgacacaatttatacagcaagagaaggaatgtcacagaccaccagatgggtagctgacccttccaagagcacaaagactctaaatatgtccctgtcaccacctgctgttttaacaactagttgtttaatacatctcctctggatggaaactagatccaagacagtgactctgggttttgtttaattttatgtcacatttttagggagcaaatgttaaatatgtttccagcctagtaaaataagggtggcaaacttaatcattagagtatgtggagaatataacaggatcttttattggacctggaaaggggccccactgaatggtaatatttgtgaaataattggagaggaaaccaagttttaagctattagttctctaacctttgagtagggaaaaggaacagtcccttgaacttgctgcaagtctcatggttgcttaaaaaggctttaatttctgaggactggcacaggctagccaaaacaaaccatttccaaaattagtttgggcctcaagggtcctgtaaaactcattttaaacaatgtaccatgatccttttttgctctcattttgtgcaattggagtctgcttccttcttcatatacagaaggatgtttaaaacgcacctttgagggtagggtgttgaaacacccagttttctgacccactctcagatgctatgacagagaaaagctcttttctccttcaagagaggtccaagcttctgagtgtactgtggtagctggaaagctattgcagcttcatgcccagatatgcatctgtgtgtgcacatgcacatgggtgtgtgcatgggctgtgcacatgtatgtgtgtgggttggcatgcgtacacacaagcctgcacataaatgtctaagagtgcatgtgtgtgtgcatgtgtgtacataagaacatatgggccaggtgtggtagttcacgcctgtaatcccagcactttgggaggctgaagcaggtggaccacttgaatccaggagttcaagaccagcctggcgaacgtggtgagaccccatctctactaaaaatacaaaatttaactgggcgtggtggcatgtacttatagtcccagctacccaggaggctgaggtgaaaggatcacttgagcccaggaggttgaggctgcaagtgagtcatgatcacgccactgcatgccagcctgggtgacagagcaagagcctctcttgaaaaaataaataaatatataataaagtaataaaaagtaaataaataaatattgattccatcacttgttagctcagtcattttaacttttgcaagcctgttttctcatctgcagagcggggataatattgtgtctacctcatcatgttgtatgaggattaagtaaggtaatacacataaaggctatatatagtacatcctctggatagtctcgctgtcattactgctactattgcagccccgctggcaaacagagcaagggggttgagaagacatggggccacactggcaagacattgagggttttatatacacatatatatatttgagatcctttaacatccactcagaggcactcagagaggactcccctactcaaggagaaatagttggggttgcaggagaggtttccaataacctatggtgagttcgagaaaaataacttatccaaaagatggaccttcctgtttctcaatgagctctcctaagagagagcagaagagggagagggaattgccctctatttggaggccgcagggcctggtcctcatagctatcctaaggaagagaaagctcaggaccaaggaagagccaccacctggagtggggagggtgggacggggttgcatcctgccctcctccttcaaacccggggcagagcttcccatccagaggaagcaggccccatcagcttatcctggggtggggcttcctaaagccaagtgtttaaaggcagatcattgttctgaagttccgctaagttctaatgcccaccctgctgagaaatcctccaagaacaaagtgagattttaaaaatccacagggttacttggagccaaaggcaattaagaggaagagaaataactggccaagtctcaatgtgatggctgtctgtgcagagactctagtgaggaagagagctaaccccattctttttgttgtgatcaagcaagatgattccccagtgggccaatcttttgcctataaaatggggttgatatgattttgtccaggaagaagtctggtttaggaaaagcagaggcattcttgtctccttcagtcccagcttagtggctactgactgtgagactttgacaacttattttccaactcagagccttgtatctctccttgaaacccaaaaggccgggctccagacttcctcaaagttcctttgctgtgtctatgacagtgggctgatgaaggtagaagcaggggtgtgatgaggacgagaataatcaggatggataggaaggctggaaggctgagaagggtataccaaagtcccagcaaacaaaagcgaacactcaatagccgtggagggcgcctcaccatgtcctctccataagccaggctacataggtcatcatctgggatcttatttttctgaattgtttgtggctcagctcttcttaatatggtactttctgaccagggcgggggagtggggagcctgtagtctcagctactcaggagactaaggtgggaggattgcttgagctcaggcattcaaggctgcagtaagctatgattgcaccgctgccgtccagcctgggtgacagcgagaccctgtcgcaaaaaaaaaaaaaaaaaaggggggatagtccattctagctgcccaatgtgcatgaccttgtgaggtagtaagaaccatgaccaggaaaaggccatgtcatccatcaggtgactttgtagaggaggcttctgccctgatgggagagtagcttaggcagcctcgaggccccttccacttcaatttgggaaatatttaatgagctcccactgtgtgccagcccagactgtgctgactgaggcctggggtgggacagcagggaggacagtccctatcttcaaagtgctcagggtctggctgggcacggtggctcacgcctgtaatctcagcattttgggaggctgaggtgggtgcatcacctgagatcaggagtttgagaccagcctggccaacaaggcgaaatcccgtctctactaaaaatacaaaaattggctgggcttggtggcgtgcacttgtaatcccagctacatgggaggctgggtcagcaggatcacttcaaccttggaggtggagattacagtgagccaagatcacaccaagatcacaccactgcaccactccagcctgggtgacagagcaagactgcctcaaaataaataaataaataaataaaataaaaacaaataaaaataaaaaaaatgtgctcagggtctcaccacccagacatggtctagtctagtccacccatgtggttcctgcctctccagtttagggggatggactgaggcctgggaccatctgttcccagtgccctctgccttctctcttgtagcattcttcttttctccttcggcactctctgaagctcctgtcgcccaaaacttcctgcccagaactaacacttctcatttaacaaacacttggatgagactaactgtgtataagcccagttcctgcccacaggtgctttgcgtggagaacggcccgctgaagcagcatcgaccaggaagcaccatgagacacatgtcagggctctccctgcctaggccctaatttgtgtcccactaaatggggccatgatcagaactgtgagttcccagcagagggtggaggtggagatgccacactggggctgagctaagacaccaccaaggaggagctggcagcagaaggctgagtcccaggatcccctgtgtacttagcttacacaaatttgagtgtagattcttccttttctttccttttttttttttttaaagactgaaatttttgtatttattgaatggaccattccatttttctctattttttttctttttttaattatactttaagttttagggtacatgtgcacaacatgcaggtttgttacatatatatacatgtgccatgttggtgtgctgcacacattaactcgtcatttaacatcagggatatctcctaatgctatccctcccccctccccccaccacacaacaggcccccggtgtgtgatgttccccttcctgtgtccatgtgttttcattgttcaattcccatctacaagtgagaacatgtggtgttgggttttttgtccttgccatagtttgctgagaatgatggtttccagcttcatccatgtccataaaaaggacatcaactcatcattttttatggctgtatagtattccatggtgtatgtgtgccacattttcttaatccagtctatcattgttcgacatttgggttggttccaagtctttgctattgtgaatactgccgcaataaacatatgtgtgcatgtgtctttatagcagcatgatttctaatcctttgggtacatacccaataatgggatggctgggtcaaatggtatttctagttctagatctctgaggaatcgccacactgacttccacaatggttgaactagtttacagtcccaccaacagtgtaaaagtattcctatttctctacatcctctccagcacctgttgtttcctgactttttaatgatccccattctaactggtgtgagatggtatctcattgtagttttgatttgcatttctctgataaccagtgatgatgagcattttttcatgtgtcttttggctgcataaatgtctccttttgagaagtgtctgttcatatccttcgcccacttgttgatggggttgtttgtttctttcttgaaaatttgtttgagttcattgtagattctggatattagcccttcatcagatgagtagattgcaaaaattttctcccattctataggctgcctgttcactctgatggtagtttcttttgctgtgcagaagctctttagtttaattagatcccatttgtcaattttggcttctgttgccattgctttttgtgttttagacatgaaatccttacccatgcctatgtcctgaatggtattgcctaggttttcttctagagtttttatggttttaggtctaacatttaagtctttaatccatcttgaataaatttttgtataaggtgtaaggaagggatccagtttcagctttctacatatggctagccagttttcccagcaccatttattaaatagggaattgtttccccatttcttgtttttgtcaggtttgtcaaagatcagttagttgtagaaatgtggcattatttctgagggctctgttctgttccattggtctatatctctgttttggtaccagtaccatgctgttttggttactgtaaccttgtagtatagtttgaagtcaggtagcgtgacgcctccagctttgttcttttggcttaggattgacttggcaatgcaggctcttttttggttccatatgaactttaaagtagttttctccaattccgtgaataaagtcattggtagcttgagggggatggcattgaatctataaattaccttggacagtatggccattttcatgatattgattcttcctacccatgagcatggaatgttcatgcttttgtttgtatcctctttgatttcattgagcagtggtttgtagttctccttgaagaggtccttcatgtcccttgtaaattggattcctaagcattttattctcttcgaagcaattgtgaataggagttcactcatgatttggctctctgtttgtctgttattggtgtataagaatgcttgtgaattttgcacattgattttgtatcctgagactttgctgaaattgcttatcagcttaaggagattttgggctgagatgatggggttttctagatatacaatcatgtcatctgcaaacagggacaatttgacttcctcttttcctaattgaataccctttatttccttctccttcctgattgccctggccagaacttccaacactatgttgaatgggagtgatgagagagggcatccctgtcttgtgccagttttcaaagagaatgcttccagtttttgcccattcagtatgatattggctgtgggtttgtcatagatagctcttattattttgagatacgtcccatcaatacccaatttattgagagtttttagcatgaaggttgttgaattttgtcaaaggccttttctgcatctattgagataatcatgtggtttttgtcattggttctgtttatatgctggattatgtttattgacttgcatatgttgaaccagccttgcatcccagggatgaagcccacttgatcatggtggataagctttttgatatgctgctagattcacatcaaataaaatactgatgtgccagtattctattgaggatttttgcatcgatgttcatcagggatattggtctaaaattctctttttttgttgtgtctctgccaggctttggtatcaggatgatgctggcctcataaaatgagttagggatgattccctttttttctattgattggaatagtttcagaaggaatggtactagctcctctttgtacctctggtagaattcagctgtgaatctatctggtcctggactttttttggttggtgagctattaattattgcctcaatttcagagcctgttattggtctattcagagattcaacttcttcctggtttagtcttgggagggtgtatgtgtcgaggaatttatccatttcttctagattttctagtttatttgtgtagaggtgtttatagtattctctgatggtagtttgtatttctgtaggattggtggtgatatcccctttataattttttattgcgtctatttgattcttctctcttttcttctttattagtcttgctagcggtctatcaattttgttgatcttttcaaaaaaccacctcccggattcattgattttttgaagggttttttgtgtctctatatccttcagttctgctctgatcttagttatttcttgccttcggctagcttttgaacgtgtttgctcttacttctctagttcttttaattgtgatgttagggtgtcaattttagatctttcctgctttctcttgtgggcatttagtgctataaatttccctctacacactgctttgaatgtgtcccagagattctggtatgttgtgtctttgttctcgttggtttcaaagaacatctttatttctgccttcattttgttatgtacccagtagtcattcaggagcaggttgttcagtttccatgttgttatgcggttttgagtgagtttcttcatcctgagttctagtttgattgcactgtggtctgagagagtttgttataatttctattcttttacatttgctgaggagggcttcacttccaactatgtggtcaattttggaataggtgtggtgtggtgctgaaaagaatgtacattctcttgatttagggtggagagttctgtagatgtctattaggtccacttggtgcagagctgagttcaattcctggatatccttgttaactttctgtctcgttgatctgtctaatgttgacagtggggtgttaaatctcccattattattgtgtgggagtctaagtctctttataggtctctaaggacttgctttatgaatctgggtgctcctgtattggatgcatatatatttaggatagttagctcttcttgctgaattgatccctttaccattatataatggccttctttgtctcttttgatctttgttggtttaaagtctgttttatcagagactaggattgcaacccctgcctttttttgttttccatttccttggtagatcttcccccatccctttattttgagcctatgtgtgtctctgcacatgaggtaggtttcctgaatatagcacactgatgggtcttgactctttgtctaatttgccagtctgtgtcttttaattggagcatttagcccatttacatttaaggttaatattgttatgtatgaatttgatcctgtcattatgatgttagctggtgattttgcccgttagttgatgcaatttctttctagcatcgatggtctttacaatttgacatgttttcgcagtggctggtaccagtttttcctttccacgtttagtgcttccttcaggagctcttttagggcaggcctggtggtgacaaaatctctcagcatttgcttgtctgtgaagtattttatttctccttcacttatgaagcttagtttggctggatatgaaattctgggttgaaaattctttcctttaagaatgttgaatattggcccccactctctcctggcttgtagagtttctgctgagagatcaactgttagtctgctgggcttccctttgtgggtaacctgacctttctctctggctgcccttaacattttttccttcatttcaactttggtgaatctgacaattatgtgtcttggagttgctcttctcgaggagtatctttttggcattctctgtatttcctgaacctgaatgttggcctgccttgctagattggggaagttctccaggataatatcctgcagagtgttttcaaacttggttccattctccctgtcactttcaggtacaccaatcagatgtagatttggtcttttcacaagtcccatttttcttggaggctttgtttgttactttttattcttttttctctaaacttctcttgtcacttcatttcattcatttgctcttccatcactgataccctttcttccagttgatcgaattggctactggggcttgtgcattcatcacgtagttctcgtgccgtggttttcagctccatcaggtcctttaaggacttctttgcattggttattctagttagccattcatctaatattttttcaaggtttttaacttctttgccatgggttcgaatttcctcctttagctcggagtagtttgatcgtctgaagccttcttctctcaactcgtcaaagtcattctctgtccagctttgttccattgctggtgagctgcattcctttgggggaggagaggtgctctgatttttagagtttccagttcttctgctctgttttttccccatctttgtggttttatctacctttggtctttgatgatggtgatgtacagatggggttttggtgtggatgtccttgctgtttgttagttttccttctaacagtcaggaccctcagctgcaggtctgttggagtttggtgaaagtccactccagatcctgtttgcctgggtatctgcagcggaggctgcagaacagcagatattggtgaacagcaaatattgctccctgatcattcctctggaagttttgtctcagagcagtacccggctatgtgagatgtcagtctgcccctcctggggggtgcctcccagttaggctactcgggggtcagggacccacttgaggaggcagtctgtccattctcagatctccagctgtgtgctgggagaaccactactctcttcaaagctgtcagacagggacatttaagtctgcagaggtttctgctgccttttgtttggctgtgccctgcccccagaggtggagtttacagaggcaggcaggcctccttgaggtgcggtgggctccacccagttcaagcttcctggctgctttgtttacctactcaagcttcagcaatggcaggcacccctcccccagcctcgctgccgccttgcagtttgatctcagactgctgtgctagcaatgagcgaggctctgtgggtgtgggaccctctgagccaggcgtgggatacaatctcctggtgtgccgtttgctaagaccattggaaaagtgcagtattagggtgggagtgacccgattttccaggtaccgtctgtcacccctttccttggctaggaaagggaattccctgaccccttgcacttcccaggtgaggcaatgcctcaccctgcttcggctcatgcttggtgtgctgcatccactgtcctgcacccactgtccaacaatccccagtgagattaacccagtacctcagttggaaatgcagaaatcgtttgtcttctgcgtcactcatgctgggagctatagactggagctgttcctattcggccatcttggctccacctcttttctttttttttctttcattctttctctctatatctcttctctttcctctttctctcttttcctctcgcctgcctgccttccttccttccattttctctctctctcttcctttctttctttcctttccctccctttccttccttccttctctttctttctttctttctttctttctttctttctttctttctttcttctctctttctttacaagatcttactctgtcatgcagtgttgcaaacacagctcactgcagcttctacctcctgggctcaagtgatgatccacctgcctcagcctcccaagtagctgggaatacaggcttagacctatgccaccatgctcagctaattttgtttgtttgtttttagagatggggtctcgccatgttgcccaggctggtcttgaattcctgggctcaagtaatcctcccacctcagcctcccaaagtgctgggattacaggcatgagctaccattcctggccctgagtgtgtatttctaactaaattaatgagaacgagagagaaaaaaatataaatttatataacataagtgattctgcctgccattccaatctacatgtgcatcctcttgtgacagactgactctactaagtgcttagctgatggccccctacctattcctgtcgttgctagtcaagatcctgtttcattccttttttcatcctccaggtggccacatcctcagggaaggctgagaccttcctcaacccagggtttattcttggttcattaactccaagccagttttgatgattctattccctttcccttattggtttaggagtaggtttatgctgtatttttgatcagtgagactttgggggttcagctttggtgaggggtagggggtgctttggggaaagcttcttttttcttaaaaagggaggagaggagaatcctcccttttcctgtctctgaacattttaatgacacatggaacttctgtgtccatcttgggacatcagagaaaagccaggagaattgcagagaggtcaaactgaggccatcagggcattgagccactgaattagccacctctggtgccatactaccttgggacttgttatatgagccaatcaatcctctgttgtttaatgccccattaaataatctttctaccacctgcaggtaaaagcattctaaatgatacagtatgaggatgactgttcccacagttggtctcagcatcttgtatctctcaaaatctgagcatcaacaaatcccaagaaattctagagtttcaagatacatatttttgtacaacatgattcttagtacaagccagcaacatcatctggtatttaacatgagaaaaggaggtctgttcctaagctggaacttttgggttttagtgaggtatgacactatattgtacttattgggagatttaaggaattttcaaggggagttttgactatgcaaacttctgccttttctctttagaacctaatccttttctgagatgccactgtagggaactgaaaggaactttccctttcaccctgtgaaggttcactgaaaaatcaactcacgaaaggctaataattggtggaaagacgtataaatttatttaacatgtgcatgggagccttcagaaggaatacccaaagatagaggtgaaattgcccatttttgtacttagtttcaacaaagtttggacagccatgtagatctaaaaaggatataatctaatgttaatagacagtgaggaaacccagcaaggcctgtctgtctagattcttcttcagcatgcatcctctaagcatgcattccttccttctgagtgtgaggcaggaccccttctggaatgggggccttatgactatagtcaaattaggtaggtcagataatttttcatggccagttgttacacagaaaggtggtgggaaagtttgagttatacctgtaggttttgtggctggctctgggggaataaagtgttctggtttctgtgactaccctttggggaacaggggttctagtttctacggctagccctggggaagaatgagaatgagagacaggaggacagaagaatgtcagagaaaaactgttgtttctgaggttttcattttagggtatgttttctgagtcccaacacaactaaaccgtgcaactgggcacagtggaaacagagagtggcccaaaagaagtataaagtatgagccattcaagaccagcctgggcaacatggtgaaacctcatctctacaaaattaataataattattataataataattaaatttatttaataaaaaagaaagtatgggccattataacctggttgaggagaaaaaacttaaatggcaggattgattttgaggctagaacacagcaaatttatccaaaggagtctctatcatgggacttggaggttgatggggaaggcgagtctagaaggactccttcttcccatgaggctgggctaggctatgctggtgtaataaacaatccccaatcctgtggcttcaaacaatagcagtttagttctcactcatattacatggccaaggtgggttgcttgtgtctctgtgctgcattgcccttacactggggcttaggctaacagaattgccactatctaggattgccagttgctgtggtagaggggcagggtcatgtgaccagttctggccaatgggtgtgggcagcagagacatctattacttctgggctggagcatttaactgctgatgtaggacaccttgctgcccacatccaatggccagaactggtcacatgacctcagcaactctaaggaggccaggaagtgaaatcctgttacatgtctgcaaggagaaagaactgggaatatttgcatgagcggcattaatggccaccagtcaccctctttgtccagtgatccatctaaaatctgtgtagacaatgagcgagagcaaatttccactctcttgcacattcgggtccattcagacttgtctttctctcttactctgttttcacgtggtggtgcctggtgattacagggagtgtgggtacagtcagtgtccttccatgcgtgccactctctccctctgaggctttgaccctttaattttacttttacttttattttatttttagtactaaccaaggtcagagctaaggaagtcacccagtgattttttctggaatgccatccattgctgcttcaccaggtctctttagccgcctgacgccttcattgtttactgttacattgtctccctttgttcaaagatgcaaagttggccgggcgcggtggctcacacctgtaatcccagcactttgggaggccgaggcgggtggatcacgaggtcaggagaccgagaccatcctggttaacatggtgaaaccctgtctcaactaaaaatacaaaaaattagctgggcgtggtagcgggcgcctgtagtcccaactaccccagaggctgaggcaggagaatggtgtgaacccgggaggtggagcttgcagtgagctgagatcacgccactgcactccagcctgggcaacaaagtgagactctgtctcaaaaaaaaaaaaaaaaaaagatgcaaagttattttgtctacagggtactctactcaaaccctcatggcttcctgctaccagcccaaatccctctccctgcagatcctcatgtgtgtccctggcttctccagctggggcctgaactcagctcctttgttctggtggcacacctctgtctgccctcacatgcactcttcccaacagaagttagtagcagagagggcagccatgtaagtcaacagagcacgccctgtgaatggagacacagatgttggcgctaaggaattggagcctgggctaatggacttattcctctgactgtgcagctaggtgagagggtgtataaaaagcaatacaaaaaatgttatggtggttgatttcatttatttctgagaggtctttataaaactgtccctgatggatatttataaacataacctcagctacaagtagacaggtctcaatttctcctatcgcagggaaatgcaaacttattctcttctttcctcaaggtttggtcttgtattttaaaaatggaataaagattgtagtaatgttgctagggattataggaataatataaatgtaatttctcttctcaaagacattataagtaagaatttcagcaaagggagaagaggaatgtaagaggaaaatggttgtttgaaagtgcagtatatagaagtataatatctatttctatatatagagatagaatatacaattaatatacatactatatatataatatgtattatacatactatatatgtatagaatagttaatatagcaatatataatataattatataaattctctacatatataaattctatatatagaatatataaattctctatatttctatatgttctatacattctattccatatattctattctatttatatattctataaatatatagaatacttaaatttatagaatacttaaatatattttaaaatactaaagtatatttatagaatgtatatacttttgggctgggtacggtggctcacgcttgtaatcccagcactttgggaggccgaggcaggtggatcacctgaggtcaagagttcgagaccagcctcaacatggagaaatcctgtctctactaaaaatacaaaattagccgggcatggtggtacatgcctgtaatctcagctactcaggaggctgaggcaggagaattgcttgaacctgggaggcggaggttgccatgagccaagatggtgccattgcactccagcctgggcaacaagagcgaaactctgtctcaaaaaaaaaaaaaaaaaaatatatatatatatatatatatacttttgtatataagtatacaaaagtatatttatagaatatataaattatatatttctctatatattccatatatattctctgtctagaatatataaatgtatatatgtggagaatatgtgtaattttttatatgtatggaatatatatattaatttatatatggagataatatatataggatttatgtatatttctattatatatatatatacttttttccccaagttcttaggtcagattctttatataggttcttcccctacaaccagaggaaactgtgtttttataactaataatagaaatacatcagcctagaatatgtgtcttttacaattgaacatctaagctttgcaaatgttggtgctatagttataaaccatggatgttagtcgaggggaaactcttctccggaactcaaacatgaaagctgatgttaaaagtcattgctaaaattctagagctgaggggattacaaatcagcattctaagctatcctcctacccactggtccaatgcattacatgttggcagaatggaaatcattttggaaaagggaagtggcattttcagatgtataaacatcttcctataaagaagtgtctgtcattttctatctccaagttctcaagaagacagggtctcctgccccttggtatccaaataaaattggcctgtagtctactgtgcgcagtgtgtgggttaagtgctttctccaagattcttagcattgtgtcctccttcgactccacattctccgggagctcccatgggcacacagctgctctcttgtttccatccccaagtccaagtgggatgtcattcagcttccaacagacaactctagcacaagatactggtgtagaacagatctccaccataggtacgagagtgagggaagaattacatcatgacacagcataataaatactttaaaatgaatttgtaaacattgctgttctgaaaagccctttttaggctgggcacggtggcttatgcctgtaatcccaacactttgggagactgaggtggttggatcacttgaggtcaggagttagaccggtctgaccaacgtggcaaaaccctgtttctactaaaattacaaaaagtatccgggcatggtggcgggtgcctgtaatcccagctacttgggaggctgagacatgagaattgcttgtgcctgagaggcggaggtttcagtgagccgagatagtgccactgcactccagcctgagtgacagagcgagactctgtctcaaaaaaaagaaaaagaaaaagaaaaagaaaagtatttttttattaccccctggtaatttcttactgccaatttttgccctaatttctttcaatttctttccctcttctgactgcacctcttccttcttatcttccttctgtgatgtgggacccacattttcacacccaaatggtccatagagttgctttgttctccaaaatacagttttctccttggaaggaattttacctctagcttttaaaataacatttctgttcttacaaacttatcatcaggattaatcacatttttaaattaaaatgttattactaaaacacttaaaactaaaatagcatttttaaactaaaatgctatgtctgttttctctcactcttgttatgaaatgtttcctaatgtgaagtgttttcttgatggaagactaaaatattgagacaacatatatatttatgtctcacatctccttcttatggccatatagcctttaataaaggtagtgttgcttacaaaaggaatgattgtataatagcagagaaaaaattctttccaaagtgaaataatagagatgatagagatgaaaaccaacacttgtgaatgaaacttttatatgcagaattatattagcatagttaaaggtaaaaatacttgatccataatgattttcatttataattttggttatagattgtatctattagctattgttacaataatgctgcttgacaaaccatcccaaaactcattggctttcgttgtcatgcatatgcagttggctggggcttggctgatctagacctggcttggcttccaggtgcagattggatccagatctgctccccaggactctcatccacttgcaggctgactggggcttgtccttctcatgctgtagcagagtgcaagcctcacctcttaagcccatttcaaacctttgcttgcattatgccctctaacatccctttggccaaagcaaacatcagtgagacagggaagatcatttctcccacagcaggagaggaggagaatgaatatttgctgaacagtaattcagactcttacataagtgaagtatcatctgattgtccatcatgcccaacatctgtgtctctctgccagccaaatccaacaggtatcaaaagtggcttaaagcaggaggggttattagtcggttaaaagcaaagcatgtcaaggaaataatctattcatgtaggagcaaagatttttcttctataaacttgcatttaagataaagctgacaatctccttgcagcaattccttgagaagaaagtgtagaacaaggcacaacactcctctgacccaattcctgcaacctagtcagagaggacaactatttgcaccatgaattgaattatagccaaacaggtcttgagtaattcattgtgcatatatcctatgaaatgaagctctcaaggacccagaatgtaaactttaaaaagtaaccagtgttaatacattaaaatttcattaatttcgtattaatttacttaaagcatcatgtaatttcaagtaattattagtcattcatcaccttttgttcagttgattcttactagaaatgctggagtatggcaatcttacacatctctgggttcttgatttagcacagaggctggtagagtacatctcatgggacaaactagctgtttttgtaaataaagttttattggaacatactcatgctcatttgtttctatgttgtctgtagctgctttcactctacaagggcagattgagaagttgcaacagaaatgctatgaactcaaagcctaaaatatttactatgtgacgagcagaagaaagatggccaatcctgatttaacataatgctagacagttgaaattttggaatttgggttattcacacagttctgggatgaatattgttcttgagctatccttagataactatctaaatacttagagaaaagtatttttttaggaaaatcaataatgtaaacaaatattacacagataattttaacctccttaagaaaataatctttttaatacattaggttatgagcacttatttctaaacagttattataccaatcataaaatttgtatttgcttgttaaaggagactctgaaaaactctatcaaatattgctttattaacctttaaggagatgattattcttgcaataaacctacggtttttaaaaatatacacttgccagttgggcacagtggctcactcctgtaatcccagcactttgggaggctgaagtgggcacatcacgtgaggtcaggagttcgagaccagcctggacaacatggtgaaaccctgtctctactaaaaatacaaaaattagctgggtgtggtggcacatacctgtaatctgagctacttgggaggctgaggccagagaatcacttgaacctgggaggtggaggttgcactgagccaagattgcaccactgcattccagcctgggcgacagagcgagactctgtcctctgtctcaaaaaaaaaaaaaaaaaaaaaaaaatgtatatatatatatatatatatatatatatatatatatatatatatacacacacacacatatatcttgccatttcttcaaacttttcaccaatgtagatcattttaactctattcacgtacataactgcatctgaattagtacaattttactatattgtgtttaaagatatttcaaaacaccacactggcccctgatcttttctttgatattagaaaaaacaaaatcttgtgtcttgccggatgtccactcttggagacaatcgggtagctttagaagaaagaaacattagcatttctaaagacttggagagagaacatgggcagattttaaaagtgacgacacattcttagttatttccagtagatatattgagaacacagaaaaatctggagtcatatctattgggtattgaattagatgtgtgtatttctgtgttctgggattcactttaaagccccaaatgagtctcaatatgaggcctgaactggagaagaagaagagttcgtggagaagaacagaagggtggcttacacctgtaatcccaacactgggaggccaaggtgggtggatcaccggaggtcaggagttcgagaccagcctgggcaacatggtgaaatccccatctctactaaaaatacaaaaattagtcaggtgtggtggcgggtgcctgtaatcccataatcccagttacttgggaggctgaggcaggagaattgctgaggcaggaggcggaggttgcagtgagccgagatcatgccattgcaccccagcctaggcaacaagagtgcaacttggtctcaataaataaataaataaacaaacaaataaataaaaatgaaaagaagaagacgaagagttcatcccagcctcttctccaccctgggctaggaatagctctctataagatataggatttagacaatggatcctaaattggagattaggtaaaaacaaaagaagtgctccaggactacacttctgaaaggaagttttcctagcccagtaactgcaagataggtatagagctataggtcatcatcagctccctttacaagtcacatgggattgtaatctgagcaataacaactgtgtatccatgtcagctgaatgacttggctcaaatggcacttcttttttttctttcaggagtcgggtgggagaatgtgctgctaaaggaaggtgagtcagcctcgaacgccacagaaacatccggcccagacatgactatcaaggtaagggattctcttcaggttgattctcaaagtgtatctctagagtaaaggcagccgatggcaggtttttctgggggcaaaatgaacactaccaatccaccttgctagagttctctctctactcactgaggtcttagggaggcaaccgtacataagattttctgaaatttgggatctggtctacagccgtaccaccctgaatatgcccgacctcgtctgaaacttgggatctggattaggaaactgcttgaaaaccagaatctaagatgtgatttccaatgggcctgtcgtagggtcttcagtgaatatctacacgtaagctatttgtaaatggtaaccccagtgggcacagtggagcaaatctgaaaattctgatctgagaattcaggccccactgtgcattgtgaggaaaggtcagagaggcataaagtagctttgatcttggctcaagatttccactgatgtcagcaggaaggcagcacatggcccactccagctgaaacactaatggccaaaggtttacaaaatgagtcatctagaaatccacttaactatcactgttcaaattaaatgcatcaatttgtaagcactggccagaataaagaatctgtagcaaaagttatcagaggtgccaccatttcccctctgttacgggattaaacacaaaggaatgatcttcctctcttagaactctgctaacatattagttaacaaaggatgggggtgggagggctttctaacattcttgcttgaatgattataatttgaatatatgctacttatgaatttttctttgaaaaataagaagtaatgtcttattttatatagagctgtaactggagatatttctttttttttgagacggagtctctctcttttgcccaggccggagtgcagtggtgcgatctcggctcactgcaagctccgcctcccgggttcatgccattctcctgcctcagcctcctgagtagctgggactacaggcgccagccaccgtgcctggctaattttttgtatttttagtagagacggggtttcaccgtgttagccaggatggtctcgatctcctgacctcgagatccgcctgccttggcctcccaaagtgctgggattacaggcatgagccaaactggagatatttctctcctggatctattagtagaagttgtacaaaagaatatacagcatggatttattcaagttttcttttgtaatgtgaaggctaaacttgtgttgtctatgttacaaatggtagagaaagcaagcaaatgttaccatagtaaagctaaatgaaagataggatagtagcctgattagtcaaaaagtcaactaatctaagtggtaactatccagtgctgaaagaactatcactacgtttagcagaatttgtaagacaataatataaattgcaatgacatgttggtgttttattggctattattgcaatgattgacaagtttcagtctatgaccacattggacgaaggggaatgggtgccaatagtaaaacctgttggatttagatttgttatctcaaaatctgttatcatctggagaattagtttttgagaagagttgctagtgggagagaagacagcatgttgccagtgtagctgcagatgtggtacagacagacattcaagtagtcagaaagactggagtttgcttttataaagcaaacggcatattcctttttttttttttttttaagacggagtcttgctgtgtcgccaggctggagtgcagtagcgcagacttggctcactgcaacatccgcctcctgggttcaagcaattatcctgcctcagcctcccgagtagctgggactacaggtgctggacacaatgcccggctagtttttgtattttcagtagagacggggtttcaccatgttggccaggttggtctccatctcttgacctcatggtccgcctgcctcagcctcccaaagtgctgggattacaggcgtgagtcaccgctccaggccacaaatggcatattctaatagaagcaagtcttgtccaaatcccatttgataagattgctacttaaccaggctactcatccatggtaccaggatcttgactgaagttgtatttgggtccctctagtttagacatcattctcgatctccgtttctttttcttttaatgaatacctgaaaatttctcacaagaaaagatttcttttacccctgccctaccccaggaagatttttcatccataagaactgaactcattctgaggaataaataccatacactttaaatagttgagcaaaatagaaatttatttctttattcattttgaggcagagtcttgctctgtcacccaggctggagtgcagtgtggcatgatcgtggctcactgcaacctccacctcccaggttgaagggattctcccacctcagcctcccaagtagctggaattataggcatgtgccaccatgcctggctaattttcgtatttttagtaaagatggggtttcaccatgttggccagtctggtctgaaactcctggcctcaggtgatctgcccgcctcagcctcccaaagtgctgggattacaggtgtaagcctctccacccagccagcaaaatagaaatatatttaaacacatcaataaacccctacaaatattctagagttcttctcttaatgccagttccttctcactaaggaatttgtgaattttctaggtggatataactacagaaaatgcttgtttctatcttctcctttaggattcccaattacggagcagtcattgacttttttcctttgggtataagttgtttcccaccccacattgccttacataaccatgatgtctttgtatctaaatgaaagtattattttttctgctccacttcgttaatcagagaaatgcaaattaaaaccgcgatgagataccatctcacgactgggcatggtggctcacacctgtaatcctagcactttgggaggccaaggtgggtggatcacaaggtcaggagatcgagaccatcctggccaacatgtgaaatgccgactctactaaaaatacaaaaattagccgggtgtgatggcgcgtgcctgtaatccaaagctactagggaggctgaggcaggagaatcacttgaaccagggaggcagagattgccgtgagccgagtctgcgccactgcactccagcctggcaaaacagcaagactctgtctcaaaaaaaaaaaaaaaaaaaaaagagagataccatctcacaccagtcagaatggccattattaaaaaggcaaaataacagatgttggtgaggatgcagagaaaagggaacagttatacactgttggtagcaatgtaaattagttcaacccctatggaaaacagtaaggagatttctcaaagaacaaaactactgtttgacccagcaatggatatctacccaaaggaaaataaatcgtcttatcaaaaagacactcacactcatgttttctgtagcactattcacagtaggaaaatcatgaaattaacctaagtgttcatcagcggtagactggataaagaaaatgtggcatatatacaccatggaatactacatagtcatataaataatgaaatcatgtcctttgtagcaacatggatgcagaaggaggccattatcctgcaagaattaatgcagaaacagaaaatcaaatactgcatgttctcccttataggtgggaactactacacatgggcataaagatggaaacagtagagactggggactctaaaagaaggggcaatagagaaaggagaaagggttgtaaaactacctattggatactatgttcactgtttgggtgatgggttcagtagaagtccaaatcccagcattacgtaatataccttgtatcaagcctgttcatgaaccccctgaatctataataaaaaaattaaaattaaataaaaagaattattttttttctctctgtatataactgcctggagctcattaagcacagactccccctcttacatttagctatagctattcctacttctaatagctactttatatatccttgcaatatcagctattcctgccttttgcctgagaaaacaaaatattctgttaataaaacctgatacactgacacttttcaagggaaatatcagcagaaattacaaagatagttgggtttcttccatattgctcttcttgtgataaaggtgtctattttagtatttataaattttctttctgaaaaaggaatacaatgttttgaaggtgcttgctttctctttgccttccatttcccttgccatgattgtaagtttcccgaggcctcccagtcatgcttcctgttaagcttgtggaactgtgagtcaattaaacctctcttctggctgagcatggtggctaatgcctgtaatcctagcactgtgggaggccgaggtgggtggatcacctgaggtcaggagttcaagaccagcctggccaacatgatgaaaccccatctctactaaaaatataaaaattacccgggcgtggtgatgcatgcctgtaatcccagttacttgggaggctgaggaaagagaattgcttaaacccaggaggtggaggttgcagtaagctgagatcacgccactgcactccagcctgcatgaccagagtgagactccatctcaaaacaaaaaacaaaaaaaccctctcttcttcataaattacccagtctcaggtaactctttacagcagtgtgaaaatggactaataaacctgtgaatgtgacttatttggaaaaaaagtctttgcagatacaattaacaatcttggctgggcacgttggctcatgcctgtaatccaagcactgggaggctgaggtgggtagatcacttgaggcctggagttcaagaccaacctggccaacatggtgaaaccctgtctctactaaaaatacaaaaaaattaggcatggtggcacacgcctgtaatcccagctactccggaggctgaagcacgagaatcatttgaattcaggaggcagatgttgcagtgagctgagatcacaccactgcactccagcctgggtgacagagtgagactctgtctcagaaaataatactaataatcttgagatgagagcatcctggatttaccagatgggccctaaatccaatgacacatgtccttataagagacaaaagaggatactcatatacacagaaggccatgtaaggggactgaggcagaggttgaagttatgcagcccaagtcaagaaacacgtggatccaccagtagctagaagaggcaaggaaggagtcttctctagagcctttggagggagaggagtgcagccctcctgacaccttgaattggaacttttggcctccagaattgtgagaaaataaatttccgttgttttaagccaccaagtgtgtggtagtttgttatggcaaccctgggaaatgaatgcactcagattctgccaagaatcacacctatgcttcttgagtgcaaatgccatagaggctgataaaccaatattacgaagatccacataattttcttattttactctacttacccttataaattgttttttacctgttcttgttttgggagaaccactaacttttttcagcctatatttatcatccttcactggaagaaaagggtagctgtatctcagaatagcttctattttatatcctattctgttttgttgcttgtccagacattgaatttaaaaaaaaaaaaaaacaggtatggatcagtatttcttgaaatgcctgaccctgagaatcacctgcagcaatgtagaaaacaacaataacacagcttgccagacatctttcagaattcagattcagaagacctgggcttgagaattagcatttttaataagtgctccaagtaactttcatgattagtttcagaaaatcttgtcttagcacaccactaatgcagtctgggggtggcaatgtgagccctactattgctcttggctctccagttgtccaaccaatctgaggcaggatttggatacttccctattcagtgccctttgattacttcccatttcaacactgaataagcctcaggcttcccctgccttctagactttcttactcttaacttcagtttcatttttagcattgtctttcactgtgtctctctctgtacccattcttgccctctttatccggtctacttgtagcctggatactgtagctttctttttaaaaagctgagttgagctttgcacggtggtgggaagattgcttgagcccaggatttcaaccctagcctgggcaacatactgagactccatctctaaaaaaataaatgaaaagatcaagctgataatatccctctgctaaggccctgctggccttcccatggctcctggaacaaagaccaactcttgcaggcactgtgttttttaaaagcccctggctttcattcacttctcccttgatcttcctgctctccctctctctttatattcacatctttggctcaaatattccctcctccagtggcacattcttttctttttttttctttatttttattttattttattttattattattatactttaagttttagggtacatgtgcacaatgtgcaggtttgttacttatgtatacatgtgccatgtttgtgtgctgcacacattaacttgtcatttagcattaggtgtatctcctaatgctatccctcccctctccccccaccccacaacagtccccggagtgtgatgttccccttcctgtgtccatgtgttctcattgttcagttcccacctatgagtgagaacatgtggtgtttggttttttgtccttgcaatagtttgctgagaatgatggtttccagtttcatccatgtccctacaaaggacatgaactcttcattttttatggctgcatagtattccatggtgtatatgtgccacattttcttaatccagcctatcgttgttggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttttttcctgactttttaatgatccccattctaactggtgtgagatggtatctcattgtggtttcttttttttttttttttttttttttttgagatggagtttcgctcttgtcacccaggctggagtgcaatgacgccatctcagctcaccacaacctctacctcctgggttcaagcaattctcctgctaagcctcctgagtagatgggattaacaggcctgtgccaccacgcccggataattttgtatttttagtagagacggggtttctccatgttggtcaggcttgtcttgaactcaccacctcaaatgatccacccgcctcggcctcacaaagtgctgggattacaggcgtgagccacagcacccagctccagtggcactttctaacaagcattgcttgtttcacattctcataggacctaacagctctccttcatagccactcacatcaataaccatagatgtcgggcaggtgtggtggctcacacctgtaatcccagcactttgggaggccaaggtgggtggatcgcttgagaccaggagttcgagaccagcctgagcaacatgacaaaacccagtctctacgaaatacaaaaaaattagctgagtgtggtagcatgtgcctgtagttctggctacttgggaggcaagagatgggaagatcgcttgagcccagggagattgaggctgcagtgagctgtgataaaacaaaaaataaaataaaaataaaaataaccataattttcattgcataatatccagttgcccttgctacaatatcatttccgtaagggtcatttttctgtttcattttttacttgttagaggctctaaattgtagttctttttttaaataacacaactttattaaggataaaatttgcatgccatatggttcccccaggtaggtatatgattcaataatgtttcataaatttactaaccatcacacaatccagttttagaacacacacagttttaaataatttccatcattccaataagatccctcatgccctcctatagttaatctccattctaccccatccccaaacaaccactcattcctttctgtttctataaatttgcctgttctggacatttcatataaatggagtcatacaacatgcagtgttttgtatctggcttaggatgatgatgattttttttttttgaggtttatccacattgtagcctcaatcactatccctttcactctttttaatgctgaataatatttcatttaattgatatgccaggctgggcatggtggcttacgcctgtgatcccagcactttggaaggccaaagtgggtagatcactagagcccaggagttggagaccagcctggacaacatggtgaaactgtgtatctacaaaaaatacaaaaattagctggatgtggtggcatgcatctgtagtcccagctacatgggaggctgaggtgggaggctcacctgagtctaggaggtagagagtgcagtgagctgtgattgtgtcactgcactctatcctgggtgatgacagagtatgaccctgtcttaaaaaaaaaaaaagatatgccagtgtcttgggttttttgttttttttttttaacagcccagaggtcttttatttatttattttttaaacacctattatgccatgaattcatagggaataggttccagcagttcaggctccttcccattggttctcacaaagtgtgcttctctgggtggagcaggctggcacttcagttgaacccaggtacctttctctttggcttctttctttttctgatcattttccttcacacatttcaggaagctatctcggctcagagtgcttaatgtgctcaatatgcacattaattctcttggcaagaatcttgcccttaacttgtttgtttacaataccaacagcatgctgggtaacattgtagactcttccagttttgccatggtaacacttgtggggcattcctttttgaacagtacccattcccttgatgtctacaatatcacctttcttatagattcgcatatacgtggccaaaggaacaactccatgttttctaaaaggcctagagaacatatgtcgggagcctctcctctttccctttgtgttcgtcattttggcgaattactggaagatggaggttccgcccgaaaggctttttttttttttgttccttcacaagttgatggattttgaggttgtttctaccttctggcagtaagtattcttgctatgaatagttgctgctttggatagtcacatgtaagcctttgtgtggacgtaggtcttcctttgtcttgggattgtacctaggagtagaattgctgggtcatatggtaaatctgggtttaactttttaaaaagctgtcagactcttttccaaagcatctacaccactttacacctcaccaacaatgaatgaggcttccaagttttctacatcctagccaacacttactactgtccatcttttgattataaccatcctagtgggtgtggagtcgtatgtcattgtggttttggtttgcattctcctggtggctaacgacactgagttattttcatgtgcttattggctatttgtatgcagttaatttttaatggcttgatttccttttttgccatagtttgttcaattattaaattgaagcactctctcattgcagctgcccagtcagtgttttctgagtgagggaccctcttcttgactgtggcaggagggtgcactcaactcacacttcccctttaagatcactgccctctccaccactacgtccctctgcaggggttgcatcaatctctcttctttctatttcttttctttctctcactcttttatttatttctttctttcttttagacagggtctcgctatgtcacccaggctggagcacagtgtgatcatggcttactgcagcctcaacctcccaggcccaagcaatcctcctaccttagcctcctgtgtagctgggactataggcgtgcagcaccacacttggctaaatttttattttttgtagagaaggaggactccctatgttgcccaggccaatcttaaactcctgtgctcaagtgatcctcgttcctcagcctcccaaagtgtgagattacaggtgtaagccatcacacccagcgattatctctcttttctattttcccttcacatcttagccttttttctttaatttttttattagcctaatcaatgctattttttattgtggtaaaacagatataacatttaccattttaagcacttttaaagggtacccgtctgtggcgttaggtacattcaaagtgttctgtaaccatcatcgtcatccatccttctccagaactttttcaacatcttcttcaaccaaaactctctacccattaaataccagccccccattctctcctactccagctcctgtcaaccacctaaatgttgcattttacacctaaaatgtattactatttaattgccttctcaaagggatttttaatacattatgttaatagtaaaaagccagtaaggccaggcgtggtggctcactactgtaatcccagcactttgggaggccaaggcaggtggatcacttgaggtcaggaattcaagaccagccttgccaaatggtgaaaccccgtctctactaaaaatacaaaaattagctgggtgtggtggcacacacctgtaatctcagccactctggaggctgaggcacgagaatcgcttgaacccaggaggtagaggttgcagtgagccgagatcgcgccactgcactccagcctgggtaatagagcgagatgcagtctcaaaaacaaaaacaaaaacagaaaagccagtaagatggctacccctcagaaataaagtaggaagctgctacaagctagatttttaaagatattgctggttacaaaagttcctttcttctgtggcgtgaactgtccaggaccctcatactggaaatgtcttggccttatccagctggtgccttgctgcaagtcccaaatcacacctgcttggctgtgcatcattttcttgaattttgtttatccaacgactggataaaatgacatcaagtaatccatgttaaagaagtatctctaggataaaaattttgtgatttggctgtcatttccatcaaatacaccaactaaatcgtagatgctctctttatcttgccctcttgtccatatatactaagactaaaaactaagtgtttgcaaaaaagaatacaaaaaattttagcacagcagaattttcctcagaatgaagtctggtattcttatttacatgttcaatatttctcatttatgcttgaacaagaaacaaggttggtagcccttaggcaaactagagattctggctgtaaaaccgtttgaaaagggtacatttctattcaaggacatgggaaagccacatttaaaaaaggatgttgcttctctacacgtaaaacttgttggaagacagattatcctcctagaagagcagatgttctctattacaaaagaggaaaagcatttagactcttccggtggtgaatagaggccacaggttacagctttctttggcctttgcttttaaaaaaacattctgctgaaggccttttgttgccagtggtgtccagccggttgccctttgtatttgatgatgacgacattgaaaggattgttttgtgcagggactctggacaaaaaagagacatttgggacagaaaacctttctacattgtgtatatacataaagatcgctctaaatttggttccttgccaaaggaaatattttcgaagattttttaaaaatccttgaaactattcagggtagtggatctcagagggggtttggcattggtgagtaggaggcatatcggtactatatgggtcagtttttataatacatgtctttgagaatcattgtcttgaattttctttaaaatgaatatgaagagctctgttgtaaactgtaataaactatattattaatggttatttattgttcctgtgtgctactccctatttgtcaaataaaataaatgtgaaagaaatgaagtcacaaccattgacagctttcaataatctatgtgtagataaggaatattcgtggcaagtgaataatctcaggtaccttcttctttgccgttttatttcttcgctgtgttctcttgccaacaataatagctaacatgggttgaacgtttgctttgagctgagtactgtgctacacatacaccatctcgtgtaatcctccagatgactctgctaaggagaaactgttattaatcccattctacagatgtggtggctgtggcacagtaaagtaacttacccaagatctcaaagtgagtgtgtggtggagccaagctttgaacccagatggaaggacactttgtagcctctctgtttgggttttaataagtgcaggtttatttttttttaattagctaaagcaggggagctccaatgacagggcaagggtagcttagccagataaaatattagatgtccagttcgatttgaattaaattgcatgggacatacttatattaaaaaattatttgttgtttacctaaaattcagattttactgggtgttctgtatttttatttgccaagtccagtggccctaggcaagaggagtgttgcaaaggaaatgaagggaaccgcgtaatgtgttttgattattgtcctttgggattatttgtggttttgggttctttttgaaaaaaaaaaaaaaagacttttttcattttaaacatgacaatgtattttattaagctttaaaccagacagatgtatattttaaggacttgtaatatgctgataacctatcaagggacatcccttgatatgcttctttgctaggaatccaaatctgatccatgccaagatttgtacctcattggtttctctatgaagtgaaactatgagaaacactaccctctatttgtttgtttgattgttttttcttttgaacaacagcaacaacaaaaaccctttacctcaatctgggtatatcatgactttttggaagccttattctaggatcttctttttagttgggatatcagtgttagcctaatttcattttctgcagatagcttcatcatcccaatttttaaaatgttgatgaaatactcttgtgcttttatcaactcctacttggtaaaatcccctatctctgagtggtcaccctaaaatacatgacatgggcatggatattcccagcaaaagttctgacacattcacaaatgcttcctgaggacatctgtctgtttccttctatgcacattttgaacattccagcagtgagaatgactaatgatgctaaagctctagaaactgtcacgtgttgctgttcagtatgtcagagcctgtctgcagataagcctcatttcttaagaataatctgtcccaatcaagctagttttgcaacaaggctcatttgcaagtaccaaagtctatgacttgtgaaagaaccaagccacgcaaaccaaacacagaacccagtgacagaaactattggtctttagtgcgactggaaggtagccaacctggttcccatttaggcagggaaccagtttgtctctccagttaatgtctgaataaattaccattcatgtccctgagggtttggaatgattgcaaattatttctgaaatcctgggtagaactcatgtggccacttacgataagccttgtccttctgcaactggtcaggtatcagagaggtctcataaatcaagattgtagttatcaggaaaagttgttggattcatagagtaggggccaagggaaaactttccctttgccctctgaaatttcgttgaaaaatcaattgacactagacagattaacgggagaaatggcatagaagtttactaatgtgcaaagagagaaaattacacacaatggggtacagatggttatatacccttcttcttagaggaaacggagataggaagtgtggagataggaagtggggggaagggcagtaaatgatttttacttgaagaaccaacagtgacctgggacaaagtctgttgggcccacagaacagacaacaatttgtgacagaagtctgttcagatgtgttgacagacttcattcagtctttcttcctgctatatgagttgctaatggcaactcaaggaagagaccagaagtaattgttttcttctctggagggtaagattttaggtagataagggaacttcacagaaccatttcatcctgtgcgtaggggagagacagaagattgagagacaggagtgaggggaggtcagagagaccttgagccttcttcaggttcagaatatcaaagcatcatatttggggatataggtttctgagccctaacaatgggaagaatgatctttctgtatcatatgaatactgaagattgttgaagtgagcatctagtgctcctatctcgataaattatccaatgcctttcccatctctttctcctacccattctctagtggcctgcccccttgccctttttattgtagtgaaaacttagtagtaaaaaatacacttggtaaaaatcatgacatcatgtaaattgtatgtaaaaagatgacatgctcatacaagatgcttgattcattgcctagcagagcaggccactggtaggtctgcataccacgagctggtctgtttcgaggtcacttatgcttactatcattgcaacaactacttcttcctcagaaattagtcagtggagatgtgacatttattttatctcagaatttttatgtctgtttctgaaaagaaaaaggtaccagcagctgcagttcccactccgtctcccaaagggatctgggctagagggtagggtattggatttgtcatcatattttccatctgctcacagattgtgaggtttattattgtttctgttattgttttttgagacagggtctcaccttgttgcccaggctggagtgcagtggcgccatcttggctcactgcaacctccacctcccaggttcaagtatttcttgtgccttagcctctagcctccctggtagctgggattacaggtgtgcgccaccaggcctggctaatttttgtatttttagtagagacagggtttcaccatgttggccaggctggtctcgaactcctgacctcaactgatccgcccacctcagcttcccaatgtgctgggattacaggtgtgagccactgcaccccaccagagtgtgagttttgatctccaacagtatgcattttctagtgaaattcggtttaataaaatgaataatgagataatagctaacatatattgagaacttcccatgtgtcaggtagtgctctgggtgtttagggtattctattatttaattcttaccacaaccctatgaggtgggtactaggatatctccagtttacagagaaaacaaggtgcagagagattaagtaacttgtctaaggtcacacagacaaggagtgctggagcctaggtctaagccagacagcactagatcttcatgactttgtcacagtgcttcaccttggagaataatgagatgatgctggtatgtagacatgctaaggaggtcttccttgcctcacagtcctgatcaatatggaggcttttatgtagttctgtttgcgttcattcttccaatgcaaagctggagtttacctagtgggataagatttgattttcatccttgagaatgagttgttcttcaggctggcccatgagtcttcatcctgtcagcattctgattacatttctcattatcattctcctgcagtgattcatgagtatgataaaaccgaacagccttctcagtaaataagcaaagcttagcttacggggaaaaaaaaaaaaaaaaaaaagtagagctttccttgaatctggagaaattaagcacacaggtgtcctgcaatattagttaagagactactgcacccatcatactgtagcttaagacagtttcttcttttagttttttctaaaatgtctccatgtctgtgttatgccacaaataacacagccttggttaacttttggactaaaaaaaatcaacttattggccaagcatggtggcttacacctatgattgtagcactttgggaggctgaggcaggaggattgcttgaactcaggagtttgagaccagcctgggcaacttggccagacatcatctctacttaaagaaaaaaaaccgccgggtgcggtggcttacgcctgtaatcccagcactttgggaggctgaggcgggcagatcacgaggtcaggagtttgagactatcctggccaatatggtgaaaccccatctctactaaaaatacaaaaattagctgggcatggtggcgcgtgcctgtagtcccagccactcgggaggctgaggcagaagaatcgcttgaccccaggaggaggcggctgcagtgagctgagattgtgccactgcactccagcctgggtgacagagtgagattctgtctcaaaataaataaataaataaataaataaataaataaataaataaataaataaaataaaaaataaaaaaacaaaaaaaataaaaaaataaaaaaacaaacaaactagccaggtgtggtgtgcgcatgtcgtctcagctactcaggagacaggtgggagaatcacttgagcctgggaggatgaggctgcagtaagccacaatcctaccactgcactgtagcctgggtgacagaaggagaccctatttctattataaataaataaatttattgaatgtcgtattatatgtagcataccatatttaagcagggtcaaatttttggtctgacttttcaaattaatgtgaataagtcactttgaaattttggagacaaaaccttatttaagttgagaaatagacaaacattcatccactaagaattattctttttattatttttagtgtgtttgagttggttcttgcaaagaaaatataaacaaatcccaaatatgaaaaagtttctaagtttatattaagtgtatcccatgagtgacacaggaaaatcccttttaagagaaatggtattgcaaaagacacagcaaatctttttctcttttaaataaaaatatgcattctgtgtctaagcattttccaaacctttctcctttgtgtggcttttactaaaccttcaatcctataacagtcattgacttcttcctactttcttttcctctctttccttctctcccttcactccctttctttttcccagtgtttactgtgggctaggcactgtgttaaacactttacctgcatttctctctttaacactcaaaatgacaccatgagataggtaccattttttgtcccattgtgcagatgaagaaatcaacactttgagaaggtaaagactttataaggtcacaaattctggaagagcagagtcagaattcaattccaggtttgtcatatttcagagcccacagtttattgctttctgtgtaatgagtaaatatttcttttagaatcaaaaaatattttaattaaaatgtaatgacaggaaaatagttttgatcctgggagcaagaattagtcaagaatggacctgatctaagaccactgtagttttttggacaggctatgagccagtggactggcacagatgaatacaaataacacatagctaatactaattgagaatctaaaaggtgtattctgtggcctttataagcatgaacttatccaatgagttccatgaactcatgatatagatactatacacttgttcttattttaaagactaggaatctgaggcacagggagataaagtaacctatggaaggtcctgctcagaatcagtggaagaatgaggattctgccttcattcctagcattcttcatgtggttagcatagtcccctaaccacagtgccagggcacctcttgcctgtgatccctaagtgctcttctgcaggtttctttctttcctttttttctattgtttttttgagatggagtttcactcctgttgcccaggctggagtgcaacggcgtgatcttggctcaccacaacctctgcctcctgggctcaagcaattctcctgcctcagtctcctaagtagctgggatttacaggcatgtgccaccacgcccggctaattttgtatttttagtagagacagggtttctccatgttgttcaggctggcctcaaactcccgacctcaggtgacctgctcgcctcggcctcccaaagttctgggattacaggcgtgaaccaccacacccagcctcttttgcatgtttcttggggaatgcagagccagttaactttacaactagccattcacttggaattcacatccacagcatagaaaagaccatagcgtatgctttccctatggagagaatccaataactatcaagccatatattcccctttttttttttttttttttttttgagacacagtttcgttgcccaggctggagtgcagtggtgcaatctcagctcactgcaacctctgcttcccaggctcaagcgattctcctgcctcagcctcctgaatagctgggattacaggtgcccaccaccatgcctggctaatttttgtatttttagtagagacggggtttcaccatgttggccagtctggtctcaaactcctgacctcgtgaactgccctcctccgcctcccaaagtgctgggattacaggtgtgagccaccacgcccggctgccatatattctttgtataagtgacaggtctgaaaatagctgtgtttatgattacggagttaaagggaaaagaatgccatagctaatgggagagaaaaatgaaaggtcaattgaattcgcccatggtaaatgttagaaatttaagggtcaatgtgatcctttcatatgaaatactaagttcttggaatcaacttacgggaaaatctagtatgtttagtgttttacaagtgcttttttttctgcctaaaatttaagaaatactttacccaatgtactaaatatatatgtgtgcatgtgtgtgtgtgtgtatatatataaaaaatatatataatataatatataattatattatatacacacatatataatatataatatacatattgtacatatgtataatacatattacatacatatgtattatatgtataatacatattatatatattatatgtataatacatattatatacatatattatatgtataatacatatacgtatataatatgtataatacatattatatacgtatattatgcgtataatacagatatatgtatatatatgatatgttgtgtgttatatataacatatatatgatatgttgtgtgttatatataacatatataggatatgttgtgtgttatatataacatatataggatatgttgtgttatatataacatatataggatatgttgtgtgttatatataacatatataggatatgttgtgtgttatatataacatatataggatatgttgtgtgttatatataacatatataggatatgttgtgtgttatatataacatatataggatatgttgtgtgttatatataacatatataggatatgttgtatgttatatgtaacatatataggatatgttgtgtgttatatgtaacatatatatgatatgttgtgtgttatatataatatatatgatatgttgtgtgttatatataacatatatgatatgttgtgtgttatatataacatatatatgatatatatattgttttggtgagttggtacttttttttgttattgttgagatggagtcttgctctgtcgcccaggctcaagtgcagtggcgtgatctcagctcactgcaagctccacctcccgggttcatgccattctcctgcctgagcctcccgagagtacaggcacccaccaccacgcccggctagtttttttggtatttttagtagatactgggtttcaccgtgttagctaggatggtctcaatctcctgacctcgtgatccacccgccttggcctcccaaagtgctgggattacaggcgtgagccactgcaccaggccctgtgctttgtttttttaaaagaaacttcctagaaaccctgatcaagtgggagtttttttgaacccgttaataagaacactttattgtaatgaaaataagaagtatttgggcatgcatctgataattatgtgttgaatgccttctgagggcaatgctttgtgccatgtgtcatgtgcctggtgcagcttccacttccaattatgtctggaatctgatttcaccattgatgtcaccactccaccattaccattctgctttcagccattatcatctcttgcccagattattacaatagcttctaagtgctctcccggccactcctttccctttctgtaacacagactccacccagaaacagccacagtgatgttataaaaatctaaaccaaatcaagtcatttttctgcttgaaataatgcagtggcttctcatcttattcaggaaaataggtaatccaaagtgcttatcaaggtttgcaaggaccttaggatctggctcactgccagtcttctctcacccctcctttctcagctctgaagtcctcctggctgctccaaacatgattgctcagtgtccccacacctgctgttccctatgctcgaatgcttttccccttgatgtctccctggctcacttccttccattctccaggtctctgctcaaatatcacctcagtaaagagtctgttcttgaccattacataaaatagtactcacctcctactgccatcaatatctatccctttaccctgttttatttttctttataacaattaccgcctcctgacacaaaatacatttcatgtatctgcatgagtgaattcaattggccttttattttctttcctgttatctatgacattcttctcttgcttattgtttttcttacctcattgtccatgccatattaggttgtaagctacatgaacatggggactttcctttttttttttccaacaaatattttttgttgtttgtttttttgaaacagagtttcactcttgttgcccaggctggagtgcaatggcacgatctcagctcaccgcaaccacaacctctgcctcctgggttcaagcaattctcctgcctcagcctcccgagtagctgggattacagacatgcgccaccacgcccagctaattttgtatttttagtagggacggggttactccacgttggttaggctggtctcgaactcccgacctcaggtaatccacccaccttggcctaccaaagtgctgggattacaggcgtgagccaccgcacccggcttcaacaacaaatatttaatgagcacctactctatgccaagctctaggcatctagaaattaacaaaagagaccaggtcttgtacttatgtagattacacttcagtagggtgagatagacaagaaacaagcaagtaaatactatcatatgaaagatggtgattaatgctctggagaaaaatcagaatgctgtagaatatgggatgatttggttagggctaaaaggatgacctgtctttaacaaggtaggcaagactataggaggagcaggttttgagaggaaattaagaatttgcaatatacttgttaatttaaaaatgccttctaggcatcccgtggagaggttaagtatgagtctggagttccatggagaaaataagctgacatataaatttgggattcacctgtgcacagccattgactggatgagatcacagagagaatggcctgagggatagaagggatcaagcccaagtcattgctcatcccaaattaaagatttgtaaaatgagaacgaaccttaaaagaggactaagaaagaatggtcagtgagactgggcacagtcgctcatgcctataatcctagcactttggaaggccctcaaggtggcaggatcgcttgagcccaggtgtttgagactggcctgggcagcatagcaagacctccctctctacaaagaacaaaaaaattagccaggtgaggcagcacacacctgtcatccaaggctgaggtgggaggattgcttgagcccggcaggtcaaggctgcagtaagctgtcattataccattgcactccagcctgggtgacagagtgaccctgtctcaaaaacaaacaaacaaacaaacaaacaaacaaaaaacaaaaaggtcagagagcactgaggagaatcaagaaacagttgtgaaagccaaatgaagaaagcagtttaaatgtgactgactgactgatggcctgtgttaaatcctggtgaaagatcaggtcgggtgagtttggagaaatgaccactgggtttggcaacctcaaggtcactgatgactttgacaagtgctgtcttggtgaaaaaaacatctcttttaagaacttttgctttgaggggaaacagggaattgaggtggtaggatcaagagaatttctcttaaaaaaattattgtaggctgggcatggcggctcatacctgtaatcctaggactttgggaggctgaggtgggcagatcacctgaggtcaggagttcgagactggcctgtccaacatggtgaaaccccgtctctactaaaaatacaaaaaaattacctgggcctggtggagggcgcttgtaatcccagctacttgggaggctgaggcaggagaattgcttgaacgtgggaggcagaggttgcagtgagccgcgattgtgccactccagcctggcaacaagagcaaaactcggtctcaaaaaaaaaaaaaaaaattattgtcctagaaaacactaataacgttggcctggtgtggtaaaccagcaatttgagaagccaaggcggggaattgcttgagcccaggagttcaagaccagcctgtgcaacatggggaaagcttgtctctacaaaagatacaaaaattagccaggcatgctggcacatgcctatagacccagctacgcaggaggctgaggtgggaggatcactcgagcccaggaagttgaggctgcagtgagccatgatcatgctactgcactccagccatagtgacagagtgagaccctctctcaataaataaataattttaaaaagaaaattcataatatacaatctatcctcttaaagtgttcatttagtacagtattattaactgtgagcacaagaaaaattttttttgatagaagaaatcacagcatatttgataaagtgaaagaaaattcatgttttgggaaggataaaattgctggaacaatgtcctagaggagataagaagggagggatggcgaggctgagcgattttcctaaggtcacatagccagtaagtgacaggtcaggattccaatccaggtcttctggctctctgttttttactgacattttgctataccgtaaaatgagaaaaatggcttgggcaacatgtaactttcctcctagttctaactttcatgtctctaacattttgatatgccttcacccatcccaagcatgtaaagaaaattccgaagtcaaacatagtagcagcagcagcagcagcagcacctatctgaacccacagttctcgtctaggtgctcacctatctcatctcaaccactctatgaattgcttagcagtcagcacttggactcatcaacgcctgagccctctgtgggaatcacaaactgtttctgatacctggcagctttactcatttatgttatctgtctggcttcctaaggtatttgagtttgcaatgcttgctcctaaaattaactaggcagtggtctaacaagaaaaggaaggaagggagggagggaaggaaggaatgaaggaaggagagaaggaaggaagacaggagaatacaaagaaaggaagtacaaatgaaggaaggaaggagaggagaagagaggagagggagagggagctataaagaaggtatttacttaatgagttggaaaatcttcaaaaacaatatgggtataggtactttagttgattgtattataagctattgtggtttctaaagtgattttatgttggccatggtcccaatccaacagaggcttttaatatgctatagaagctattattattctccgtatttaaatgatcttaacaccttataatcgtaatagttacttagagaagtaattaatttattctgtgtatataaacataatatgccttcataatattgtcccatcatcttcagtgaagtttacgttaatgctaggaaagccatttaatatgttcagtatactagaaggaaaaagcccatttctcagtggatagttctcaatactaaaacatttgacaagcaaatcaagactaccgcaaagactatctctgagagaatcagaattcttaaaacttaaaatctcaagatttggtctttttccccctaatatgactggaaaatcttatggttcttcccttaaattaacagcctgtgcttaaaagttctgagggaaacacttgcaaattactaggaaaatgttacagtcgtattttttttaacaaaaactaagaaataatttcctgttttatccaaaattgaaaagaagttaagcaccactggaaaagaaaaatacatttgcatctaaaacacaggtccctaatgagaagaaattcgcttggttgactcagtaagagctgtcttctgggactccacactattggcactgttttccagcattctatctgtgaacaagctgtgtacattccaagtatattaggcatattttatgttttcagtgccatgcttaaagagtaccttgttgtatgctgtctctctattacagcatgaactctggagtgtttactagattttttaaatgcttcagttgctaaatgagataaaagtctcagccaagaaccaaagaacttggacctcataggactttgctcctgtttattatcaaagtgatacatggctacattcatgtcattattccacaagatttgaggcctctggaatcaaggtgccatcttgctttcttcaccaggggactctgtcctctgggctctttctcatttcccaactctgtgtttctcctacatagatacccacttttcactctttccaacacaggtcttcccatgctgcttttttgttgttgaagattttagttttgaatagtgttttttttttttattagtatactggtgccatttacatgtatattacaatgggcaatttgggtggtacaatgttatgtcaatgtcgagaaggcacagcccagctacagtctggaacacagtgtaaacaattccatggggaaatgttgcttgggttttggaatgtttcttatgggtgttttaaaatgtcttttaaagaggctcaagcagctgcggtgaatataatcaggtcaccatttccttatgtttaagggtttggcggaggagaggccaagtgcgaggatgcagggaaaggaaataaatgtggaacaggcaggaaagaaacttacttgggcacaggaagccagagaccctggagaggaaataaaggaaaagcaggaaccacaaactaggctaagaaccacagtaaacacagtctgagagccaagtgttctcttatgacaccatccctgtttctgtgtttggttctctgtcctttcttcaagtaagggcgactgtgtccacctccggtggttcccaaatcaggctgtcacagaatcagatggaaagcttaagcaaacacagattcctgtgctctggatcacctagagaaaggaacctggaaattttcttttcttgttttccagctactcccaatgtaagccaacttggaaacaactaatttataacatcttaaaagctgaccaccttatcttagggagaggtcaaccccttggagaagagatggtttagaagggtgtttttaattgtataaaacacaactataagtcaatgcaaacaagaccatagactaacatatgccagtcttggatgtgcattccgaaagttgatggttaaaatagtctatgggggccggatgcggtggctcaggcctgtaatctcagcactttgggaggccgaagcttgcagatcacctgaggttgggagtttgagaccagcctgatcaacatggagaaacccggtctctactaagaatgcaaaattagctgggcatggtggtgtgtgcctataatcccagctacttgggaggctgagggaggagaattgcttgaatccaggaggtggaggttttggtgagccgagattgtgccattgcactccagcctggcagtaagtctatggatggatcatgcctgctacagaaaagccaatgatgcttaatccagagatgacctttttgccattaagtaagaaccagagatcagtgagaaatgtcttactttggaaatccgtaaacatacaaatcatccatatggatggtgtaaaaccactagttgagctagagtaagcaaatgatctttgtggattctaggaattaattgactaaatatcccatgtcctcctgcttacactcctaccaacatagtattggaggttgtctgatgctcaccccactatttttatggatttttatcttgaggcacaatgggttggggttagttctcctagactcttgttgttctgatttcctatttcttctgaattatttttttaaaattcttttttaatttttgtgggtacatagtaggtggcatgtaatgtataaataattacatcagagtaaattgggcatccatcacctccccagtatttttcttttgtgttacaaacaacccaattatagatttagttatttttaaatgtacaattaaattatttttgactgtggtcaccctgttgtcctagcaaatactaggtcttattcattctttctattttttggtatccattaatcatccctactcctctgcctccctgctacctttcccagcctctgataaccacccttctaccctctatcttcgtgagttcatcctctgaattcttacttgttacatccattttgcctcctatgcctggtcttcaccccacaccaactcacacataaaccccttccttccctttggtgtcccagttttcaaatgctgttatcagaagtatagggggttacaagaagtgtttacatcacaacataacactcaaacaactttaaaagtgtatattaaatattttcttttggccctctctgtgatctggaatttcttgtttactgactcctccccaccactctggtctttcatccaatttgagagattttgtaaacttctgaattccaaaaatgaattgcaggtgcaagtgtataaacattttctatctctagagttatcaccaaattatctttcagatttaccaatttattatcaatctgtatgcccatcaataaagtataatcacttgattttcatcattcccttgccaaaaatacatatttgtattttatatatttactcatattgtaggcaaaaaaaaattagtccaatattttacttgcacttttttaattatgaagagtttgagtatctcttcacaagttcaagggtcatttttacttatttatctgtaaactacgttttttttggtgttttttttttttttttttttttggagacagtctctcactctgtcaccctgctggagtgcagtggcacgatcatggctaactgtagccttgacctcctgggtccaagcaatcctcccatctcagcctcccaagcagctgggatcacaagcatgtcaccacaccccgctcattttttaattttttgtagagatggggtctcaccatgttgcccaggctggtctcaaatttctgggctcaagtcatcctcccaccttggcttcccaaagtgttgggattacaggtgtgagccaccacatccagcccaggtttgttttttctattaaggagttggtagttttcttcaattttcttattgatttgcaaaaactcttcacatatgaggagtagtaactcattgtcatatatgttgcaaatatttcccccagtttgtttcttctctgaaattttcagtggtgcatctgatcccatgaggatccccctgggcttgggattactgctagcttttcagtgaggtcacccactgtttggtgggaaagccccagggacatagagctatttgtttagtgtgagcgagtctttttgtttctgttgttgtttgcttttcctgctttttctttttctttctttctttttttttttttttttttttttttgagatgaagtctccctctgtcgcccaggctgaagtgtagtggcctgatctcagctcactacaacttctgcctccagggttcaagtgattctcctgcctcagcctcccaagtagctgggattacaggcacctgtcaccacacccagctaatttttgtatttttagtagagacggggttgcaccatgttggccaggctggtctcaaactactgacctcaggtgatccacccgcttcggcctcccaaagtgttgggattacaggcgtgccaccacacccggccttccctctttttcttacttttttttttttttaaattttcagccaacttttattttctgtaggacatatttagcacttgtgaattactcccagctgatactttttggtctttcgccttgctaggaggaggaaatagtaaattcccttttatgatgcactgtcttgcccccaccttctggttttcagatcagttctctgagacacttctaagtctatttttcagcttctactgttctctaagtttgggggcatgtgtctactgctagaccattattatttgctggatttagttcattttgctcagtttggggagagagggagaagagcttctctcaacctgtatctaggctaacttcctccccagaaagctgttctttactttgtgtgtttttctagaaagaacattctacttcttgggtcccctggctcaggggtgtagtttaaagtgggccagcagcatgggagaggcaaagtgagtaaaaatgtacacttaggccacagtgaaagaaatcttcatctcctctccccctaaaaaaatttccatggaagattttgtgcccttgatggtatagggcctgtgggaacatgtaacatttacacgttcgagttatatttctctcacataattaatagccatttattttattcaaatatgctcctaaaatacatctaggagagtaaatatgcttcttttattataaaatattctcagctctaataatcattattatgttaacacacgtatgatgtgatgaaccacaagcaggcagtgggtgataaagctaaccttgcccattgccagtgtttcccaaactttcatgtttttaagaatcatctgggagctgttaacgcagtttccttggccctgccccacacattctgattcaataaaggtggagcccaggaatctgcctttcttttttctttctctttttttttgatgcagtctctctctgtcgcccaggctggagtgcagtggtgcaatctcggctcactgcaatctctgccgcccgtgttcaagcgattctcctgcctcagcctcctgagtagctgggattacaggcttctgccaccacgtctggctaatttttgtaggtttttagttgagatggggtttcaccatcttggccaggctggtcttgaactcctgacctcgtgatccacccacctcggactcccaaagtgctgggattacaggcatgagctaccacaccctgccggaatctgcctttttaacaagcactatctgtggtctttagtactggcttcgaaaaattctggggcaagatatctcaacctcagcattactgacatttagggctcaataattctttgttggtggggcgctgtcctgtagatgccagtagcaacccccctaatcgtgacaataagaaatgtctctagacattgccaaaatgtcccctggggagttcaatcaccctcaattgggaaccactggcctaggagaaaataaatgagaaaatgttaattaaaaacagtgtttacttttgcatgcagccattcatactcttgcatggatttcattgaacaaattaaacaactatttctgagcatctggtatgtaccaagccttttatattaaaaatgtttaatcatggctacctctttaataatttggaaggtggaagaaaatgttcttataaattaatatctattaagcatatatttttcctaaattaatattcctaatagttttctgaagaatattctagaactttaaaattaatattaacaaagcattgacgttgttttagtaaagaagcaattcagaataaagttggtatgattgctttactttttttttttttttttttttgagacggagtttcgctcttgttgcccaggctggagtgcaatggcacgatctcggctcactgcaacctctgcctcccacgttcaaacaattctcctgtctcaccctcctgagtagctgggattgaaggcatgcgccaccacgcttggctaattttgtatttttagtagagacgaggtttctctatgttggtcaggctggtctcaaactcccgacctcagatgatccgcccacctcggcctcccaaagtgctgggattacaggcgtgagccacttcacccggccttgctttactgtttctaataatgaaactaattttgtttgtaaattttacacttattctaatttaggaaaatatgagaagggagtgatgaagtacctgccatgatattgtttataacatctcacatctgatgtaattctaaaattcttccttagagagtctatggtccatataaataaataagtgatatccaagcacactcattttaatgtgagtttttcacatgatattaaaatgttaaaaatagatcagtatgtagggcatccaagcatttaattccttaaatcggagacatgaggagaaaaaaatgaaaaggaagaaagaaaagaaggaaaaggaaggaaggaagaaaaagttgagtcaaggctgaagctctggcatctctaaccactggtcagtaaattctattgaaattcaatagtataagagacaaacaggcaaaaaggatcgtgaaaccatttccaaataccaagataaaggaggctattgacattcaggaaccctgagaacagctgatgtcccattgtagacttcatcctcttccttgggtgaaagtgtgaatagcgctcaaggcagggaagaagtcttttctctgaaggtgctatttatggtgcccttggcctggatgggctttctgggtagttcccaagggtatcatttctttgtattggaaatcagggacctttgtgggttaggaaagtagaatcaggccatggctattgtctttccctgctgtgtttcacatgtaaaattgactcccagaagagcatcccagggccttgtcaaggagtggggaaaatagcagactgccctagggtggaaacctaactgagagtgcaagggcgacttgcaaagctggggagagagaattactgggaaaatcgtgcctagggcaaagctgaattcaagaaatctgacttttgtgatcttcctctgctgagaatgaatgcggccacctacagcagagtaagaccacagcttgcttttgaaagtgttgctctctaggtggggtgtttgtttgtgtgtgcctgtcctctctcaggatttctagacggttcattttcaaagggtcattaacattatttaaatattcatggtggaggaggggatgagagactgaaatttcagacatctcaagagtgagggatggctggccacccgcctaatacagccccagtctgcggatcagctgcctccttcccctccgctggctttgttagcacacgcgctctgacaccgggccaccggctgccactacacggagggcagcaggaaggctctggcgagccagtgagctggaagcatctctgtccacacctcagcctctgaaccccatcgggggagtcctcaaacacgcggagacaccattactgccacaaagacgcacttcgcaaccagttccgggagtcgctctgaccctgaggacagtcgtggtgctaggtaagggacgaggggctgtttccccgcctgagtgggaactcagcggctcctggcatttgagcgcacacaggcactcacacacttccacatacgctcatgcgcacatatgtgtacaccaacacacacgtccacatgcacacacagcgacacgccaccccgctccaaagccccgtgcgctaacaagtatccatatacccagacacagcgctcccctgagttaggaaacactcagctttgcccgccccatccatccctccgtctttccctctctccagtctctgcattcattcatttcttcgtttgtgcatcgattccgccgaagccactgagaggagaaggtgtgggtagatggggaggggaggggagggaggggcggtccgtgggcgctgggctactggaggggaagcgaggaggcggggaaggggcgggccccaggagcaggcgggcggggctccccgccctccagcgcgcccggaggctaccactccctgcagatgcgctggccccagcccggggctgccgctcgccttcccccggagtctcctggacccccggagtctcctggacccccggagcgggaggcagcggccgcgcggcgctggactggagcagaaccccaggactgcgcccccgggagcgggcgcccagaggtgggtgtccaagctggggaggggaggggctggagtgtcctcgagtgtgaggaaggggtggccgaggaaggggttgccgaggaagggctggaaatctgggagtcctcggaagcaccgcgggcttttaaagggctttttgtggtccttgtcgagcggagcgtgtgctgggagagggcccgggtggaggggctgtggccatgtggatttgaattcctaggtttgtgggagggccaagcctttggctgctttgttcaatgcttatcatttatatatgctttaaaaactaaacgcaggactccgcttctccctgtatacacacagagctgggctgtgtgtccttttcaggaaaagcagtgaaatcaaatgtggtcgtggccgcatctcctgccccgggagcaccgggaggtgcagccgttccttctagctcgcgaggaaggcgcgggtcctgccttttgggtggcagagccgggggcattttcgcaagtcctgaacttttcagagagactgaagtcagggagggccgggccccggccccggtcccggccccagccagagtctttcgggatagggtccagggagctgaactcaggagatgatgcaggaggagccagcagcctcttctgccctgggagggagaacgcggtccgggtccgagctgagccagaagtttggcctgaggctgggacctcagcagttagaatgtggtatcttatccgagataaagccggagtttgcgtctctgtgggcccttcttggggacactctggggtatgggaagagcagaccgtgggggagagcactgggcaagccgtacctgtaatgtccgtggaggcgacgcgcctgcaagaaccagagcaaggagacactggtggccccaagaaatcccagagaaacggagtggataggaggggagtaaaacggagcccgggagagccggaagcccgcagcagggagctgtggcgctggtggccgggtgaggactgaaggcaaagggcgaggcggcgtgcagccgggctgccgagctctccaacgcggatgccaggcgctcgccagcctgagggatccctcctgacccacaaagagggcgtctgggaggtgactcgtttagagagatggtggattccctttccagacccaggaaagcccgtttcccgtgtggggtagcatgggtttggctctgataggctgcgtggtcagatcagactttgacatatcactacccttccccgtagcagttttaaatgcagcacaggtgatttgggaagacttcctaaatgtataatatttctttttgaaaagaaacttcacctactcatacgtctatacacctctctctgtattgcatcttggaatctgtgaacaagcccatgtctcccgggaagcgctcttctatcccaactcccgtttcacaggctcctggagactgcatgaatacaaactcctctcaccattgggatcccagggaatttgcttccttgtcttttgttctgattagagttcatttaagcatcacacttttctttctggaaatgttcttaatttaaatttaactaagcttccctttcttccagtctggcagcttccccaacattcatgaatacaatttcataataatatgtctagaaatgaggagtatccagcaaggagttttactctgtttctttaaacataaagacttggcctaaagagtgttttaagcaatgctccgctgccggttgtctcctccccagttttgacccttggccctttctctgtttttcttttcttttctttttttttcttttcttttctttcgaagttttgctcttgttgcccaggctggagtgcaatggcatgatcttggctcactacaacctctacctcatgggttcaagcaattctcctgcatcagcctcccgaatacctgggattacaggcacccaccaccacacccggctaatttttatatttttagtagagatggggttttgccatgttggccaggctggtcttgaactcctgaccttaggtgattcacctgcctcggcctcccaaagtgctgggattacaggcatgagccaccacacccggcctggccctttccttaaagggcatcttctcctttgagtggaggcacaccaagtttcctgcaattatcttggacagcaccaacaaaattagtcctgagccagggacaacaaaagtaaggctgcctgtctcccagtctttacttaaccaactctgctggagagttcatttcactttctttctgggatgctgagatgctaggatgagaggaatagctgggctttgagatgggacaaacattttgaaatactcattatctcatagttctggcatgacagttggcaccacttcctgcctgcagagtctgaagttatttcactttcataagtggcttattctgactcagtagcctcaggacctctggctaataaagtgaagtaggttgtcttaacttcgttgtcaaatgaagggagaatgaatccactggctttatttctgaaagtttgaatattttcttatagaactaacattaaatattacttccaaaaatgcaaacactttggtctttctagtcattgtaattattgtctagataattacaataatccaaacaataaccattacggatttggtgagctcttaaaatacccatgtcccagatttctgtcacggttattaccagtctctgcttattaaggtaatgagaaatgtttcaaatgaagatgaaattgaatttggatggaggttgtgttgagggattttaacagttgaaacaggagcatgctaaaaagttacttctgaagaccaaggatagactgtttagttccagtctttagctttatacatgactcaacgccagtagaattgatgctgtatcttgaatcagcttttggaatgattgttttttgatcttaagaaacatagtactcactgcttagattgttgatcagggattctgtgtcagctattggaagtttgaagtaattgattagtatcttgatgagcttcaacaatttcagtaagtttgggtagcaaattgcacccttttttttttttttgaaatggagtctttctctgttgcttgggctggaatgcagtggcgcgatctcggctcactgcaagctccgcttccccggttcacatcattctcctgcctcagcctcccaaatagctgagactacaggtgcccaccaccacgcccagctaattttttgtatttttagtagagacagggtttcaccatgttagctaggatgatctcgatctcctgacctcgtgatctgcccgcctcggcctcccaaaatgctgggattacaggcatgagccatcatgcccggcccaccattttctttatactgtgcaaactcaacacccagaggcagaatttctgtaaagctaaaaataaaggaacaacttcaacttcagtttctctcattggcatgagcctcacccagcagcacttcgggtagcttgggcctcagggaagaatgttaccatggaccatgatgggagttaaggtaatccatatacatgtatatcttactttgtaaaataatcccctctatgaacatgtaagactactgttcacaatttggacattttcctttcaaacacatttttcatgaatatattataggaaagttaaaaccatctctattctaaaaggaaaatctaccatttggctcagagagaaagttactgagtttgtctatgtgattttaagtagtatttgattagagtattaaagaaatggggtacttcaagtaacataacacctgatatttaaatctaagttttaaaaatgtatttcacccattgttaatgaaagtgtttctaagatgtaacccctggttagctattccgtcttcttgccttgatgggttgactggtggtgaatgtgctgttgtcattccattgacagttcgggattttgtggtggtctcagcatattagcatagatgtgagttgtaattttataggattatggaactgtaattgtggaactcctgcagggcagactctggaggctagctttttagaaaactgaaacctccagtataaacttaatttctgtcatttgccccattttcttgaaagttaagtgccagaaaagaaaaggatcgagtctctcttttctttctacaataaaacagaatatactttctccagggtttggtggtgggttcctttttcctgttgaggtggattctgagattgaggaggggctggagaagacagagcatgagggaaagagactgagaacatactcaggctgccctcgcctccttttccctttcgtgctcctgtctcccatctaggaggaccagggctaccagtccttgtggggacaagtttgagtaggatcaagagacatgtaactgcgccaggcgcggtggcttacacctgtaatcctggcactttgggaggctgaggcaggtgaatcacttgaggtcaggatttggagaccagcctggccaacatggtgaaaccctgcctctactaaaagaatacaaaaattagccaggtgtggtggcaggtgcctgtaatcccagctactcgagaggctgaggtaggagaattgattgagcctgggaggcagaggttgcagtgagccgagatggagccactgcactccagcctggtgacagagcaagaactctgtctcaaaaaaaaaaaaaaaaaaaaagaaaaaaagaaagaaagaaagaaaaagaaaaaaagagacatgtaacgggaatttgttcccatcttggtgacagtttcagagtgccccgcataggccgtgcaactggagaaggtgccctgtggaggcagaatgctgctgctggggtccttaaccaggcagaggttggatatgaagatgagatgatgtagcttcttttgagtaggtttgaggggttgggttttttgtttgttttttcttctaagccttggaaggatgcatgaactcgttgaagggggtgtgacatgaatgccagggaaggagagagacctgtggaacttactggggaaggccactatgctttgaacccttcttttttcttagatatgggcaggggctttgtggttgtttttgatgcctgattggagcagatggggtggcaaggccaaatacgcagatattgtggtgcgccctttatccagaaccagggcatggccaaagcaccctagtgcctcagccaagttctctgtgagatcttggtctgtcacataaacaaaatcttagttcattcatctataaaaatggagataccaggctgggcatggtggctcacgcctataatcccagcactttgggaggccgaggtgggtgaatcacctgaggtcgggagttcgagaccaacctgaccaacatggagaaacccggtctctactaaaaatataaaattagccgggtgtggtggcgcatgcctgtaatctcagctactcaggaggctgaggcaggaggatcgcttgaacccaggaggcagaggttgcggtgggccgacatggtgccattgcactccagcctgggcaacaagagtgaaactctgtttcaaaaaaaaaaaataccaaaacctacctgttcaaaacttgtgtaaaatcagatggttatggaagcaccttgtacatgtattcctcctaaagttggttgttcttaaattaaccaaagccttctttcatcttcattacagatgcaaatgataagtaaatagtttttaaattaattatttttattattattttttgaaacagggtctcactctgtcacccaggctggagtgcagttgtgtgatcatagctcactgcagtctcgaacttctgggctcaagtgatcctcttgtctcagcctcttgagtagctgggactacaggtgcatgccaccatgcctggctgtttttctattgtttgtagagacagggtctcactacatcgaccaagctggtcttgaacttcggggctcaagcagtcctcccacctcggcctcccaagcagttccacaattacattcccaaagtgctgggataacaggcatgagccgccatgtgctggcctaaagttaacacttaaaatgctagcaattgtgcagcagatcaattgttcatccttcacactgattaagtagctttgaacatggaaattctctaagcctgactgccccccgcccctacccgccagctgccattctcacccctgaagcacttgcactattgagaattcttctatttttcattagttgatccttctttaagctttgagtaattcaggaattggtcttcattgggacaatggaccgcaattttcagaaccataatcctagttttttagtttttttttttaaatttttatttatttatttatttattttttgagacagagttttgctcttgttgcccaggctggagtgcagtggcgcaatctcagctcacagcaacctccacctcctgggtttaagccattctcctgcctcagcctcctgagtagctgggattacaggcgtgtgccactgtgcccggctaatttttgtatttttagtagaggtgaggtttcacatgttgtccaggctggtctcaaattcctgacctcaggtgatctgcccaccttgggcaatcccaaaatgttgggattacaggcatgagccaccacgcctggggaaggggcctcttttggtgaaaaggcaagggcactactcctattcattagtgttctacgcttacgacctaatcacctcccagaggacccacctcctcattccattgtattgggaattagtcttcaaaatatgaattttagggagacacaaacattcagaccctagcagggaccctggaaaggattctcattgtgcagagtatggataaacagtgatgctagggcagtttttccagggttgtcagaaagggctgaactagaagtttccccactgtgcctggagtgccctgggttggttgagtgtagggtttcgaagataattttgtcaggactctttagtttttagtcttttatgagttagaagagtgtgcatatgtaactgccaccataccacagcaagttccagcaagagagaggattcctcaggtggccatcctatccaaactccatggctctttccagggcgtttgtgggaaacctgtggggctaggactgagctagactttttcagtagctgagactggtcctgcagacccatgaaaggtgccatgccgtcacccagtagggggcagggagggaccctcatttgcccctcttcccgcccaacagttgcctgacttcagccttaatgcatagctcatccagagtcctcctgagctcccacctggtgaggtgtgtgtagaaggtgtgaggaaggccaaaccacattttcctggcagtggttaactgaccgttttcagcccgcctcccagtgcagctgactgcgtcagcttacattaccgtgatgtcattcccatggtgggataatatagcatcttactttgtctggagtggtgcctcccataagttttttgataccgcctacaaatggagaaagacatcattgtttagccatttttatttgggtgggttggaggaatgactttcccaaaggaataaatcttagttaatattccagaaaattcaagtacttttcaaccctaattgaaaggcactctgtgtgcgtgaattaaaatcaaggtggagtccatgtgccatgtgctgtgtgattctaaagccatattttagcttggcctattagtattttgcatcagaacattttatacttgcaaaggttagcaagaattttcctcagacacattacagatgagcagaatttattcattttgggggaaaaaatgaacagactgtatttggaaacttagatcatatccaaagcacttgatgattcctgtttggaatcatttttccttcaaagaatagttcagatcagtgttaaatgcagggcagagatggactcaagagtgggaggcattgcttttgaatggaatcacaatgtgtatatcattttaagtattatttttatggtatgtttcattatcaaaaccatctatagcctccaaaggatgacaggtgttatagtgtgagtggcgtagagggtgttgagatagaggaatgaaaagagaagagatcgttccctttccactcaccattcatagaggaactaagttttaccttctagggaattccctgtaattcccagggacgccttgtccttgcggttcccaggcaggatggtaggaggagctaagtgggagggaattaatatttcttgagtgtcggctggtaagttggttgctttacctccacttttttagagacagggtctctccgtgtcacccagatggagtgcagtggtgtgatcatagcttactgcaaccttgaactcctacctacactattttacttaatctttatagtcaccagcatttttcaaatggagatactgagacatttggaagtcacataaccatccaggggtcccacagctacataatgtcaggtcagttttcctacccagctccttctctgttttttttttttttgtttttttgtttttttttttgcaacagagactcgctctgccatgctggagtgcagtggcgccatctcagctcactgcaacctctgcctccccggttcaagcgattttcctgcctcaacttcctgagtagctgtgtctacaggcgcgtgccaccacgcccggctaatttcttgtatttttagtagagacggggtttcactgtgttagccagggtggtctccatctcctgacctcatgatccgcctgcctcggcctcccaaagtgctgggattacaggtgtgagccaccacgcccagccctctccttttcttactaaaccagtgctgtaggggcttgctactccaagtgtggtctggggacctgcagcattcctgtcatccaggagcgtgttaaaactagagtatcctgagccccatcccagacctacttaatcagaatctgcattttagcaaaatccctaatgagtcctgagcatgttactgtgtgaggaagctctgcttagaggaggaaagtctgacaattacaactatgcatcctggccaagactcaggacttgaatccatggactggacccgaaacattggtctatctcagtgagggaggaagggtgctactagaatctgatgggtagagaccagggatgcagctaaacgctctataacacacaggacacccccttccaccaacaaagaattatcctgcacaaaatatcaatggtgccaatgttgaaaaaccctggtctaattgtctagatgtagaattcacatcctgtagatatgtttcgtagcctcagatgtatgcaaatctctaggaagtagatcttaaaggagttgatacaaattgcagtgtgctatgcaaatgggaatatttttattgggacttgaaaagagaaaaagagcttaaactgaagcatgaaagatttccattagagttttgagagtgtcagactctcaaacaataatatcagggatgcagtggaaaagtttctaagcatgtactgagtacccaccattgagggtgctacaaggcaacattccctcccattcccaatcctgcctggcaacagtgccttctgtttcttcattttattcctaagacttgccctggcctttgtcctacctttccgttctcaagcaggatatgctgggtcagttgtgccacctggaggctgggggaggaacgcaaataatgaataattggtaaagggaaccaaagcgctgtttctaccatcttttcctccctgcctgcgtggatccacacctcactgtttcttactcaactccttcaatgccacgacactgtagccacttccactggtggacacatatcctctctccctccttccttcccattctctttagatcctggcccagaacatctgaaaagatctgtcctccctcccctgtctctctccctttttttcttctctttcttccttttctgagctgaacagcaacctgtatcaatactgggaagtaaaatgagtatgcttattgtatactgatggaaagttttttggttttttttttttttttttttgagatggagtcttactctgttgccctgctggagtgcagtggtgcaatctcggctcactgcaacctccgccccctgggttcaagcgattctgctgcctcagcctccctagtagcagggattacaggcatgtgccaccacgcccacgtaatttttgtattttgggtagagacagggtttcaccatgtttgccaggctggtctcaaactcctgacctcaagtgatccgtctgcctcggcctcccaaagtgctgggattacaggtgtgagccaccgcgcccagccgatggaaaatgttttgaagtgaaattatatccaataaagagctcctgtcattcatccagttgtgagagtccctttgagagttgccagaaatgtctgctgtcttgtttttactcttaaattaacttgctctttctcgaagtacagaattctaaaacagagttggtgtttttgttgttgttctattatgtcctcctgctttctttagttgttggtactagaatagtcattttctactactttttcatggacattatccttgaaataggttattctagacaagttttggaacccaaactggatttaagaccaaggcattccaagaaaaataaaatctttttgcaatttctatgcatcatctttttataactttcattctcctttgcaaaggaaatgtggggctgtggatgtgaaaggaggtgggggcagtgaccggccagctgcagaacattcaagcctggcctttggactcagagactagggcagaagaagccagagtgctaggcttctggccagagtggaatgtgtcttcccaggagtgggaagcctgtgtttttccaccttaccatctgatctgctccagagggctctgcattagaaaaatagggagctatggggaatgactagggggtggagatcatgagagcagtgtctatggaggattatcagttatgctcagaaagggaagatttggcacctggtcatcgatttttagtacagtaattgtcttgagaaaagtatttgagaatcaatattagaaacaatttttaaaatatatcagtcttaaaggtacataaatgagaggaagaaaatcagagatcagggtgtctgcaagatggtctactaggctttttattattgtaatttgtgattgaatgccctctgtggggccaggtattttgtttttgtttttgtttttgtttttgtttttgttttagatgagtcttgctgtgttgcccaggctggaatgcaatggtgcgatttcggctcactgcaacctccgcctcctgtgtttaagcgattctgttggcttggcctcccaagtagctgagacaacaggtgcgcaccacaacatccggcaaatttttgtatttctaatattcaccatgttggccaggctggtctcgaactcctgacctcaagtgatctgcccaccttggcctcccaaagtgctgggatgggccaggtaattttattttagcctgacaactactctttggggtccttggatagtttttaattccattttgaagatggaaaagtgagatgaattggtcaaggtcaggcccacaggccctatttttttccccttgcattgttactgtgctgggtgacaactggtgctgagacagctgctgtctccatcactctcatgaggaaagagggtcaacaggtccaggagtttttgtttgtttgtttgttttagatggaatctcactctgttgcccaggctggagtgcagtggcgcgatctcggctcactgcaacctccgcctcctgggttcaagccattctcctgcctcagcctcccgagtagctgagactacaggtacatgccaccagggctagctaatttttgtatttttggtagagacgggatttcgccatgttggccaggatggtctccatctactgaccttgtgatccacccgcctcagcctcccaaagtgctgggattacagcaggagtttttactctaaatattaagttaagcttacaagttaagctacttgtaagctgtctgaaggtctatttccctgactttgcagttccttaattttgaaggcaatctctgcctgtatgtcttcttccttagagacctttgtcccgttaaggtaacctcctctcccagcccacaccttctaaagtaccttgtcacgtctcatgaactccacaagggtcctcttgggcatgataatgtgtgtcacctcttgcaagatccactaaaccctctttgccacaagttatgcttttcaaagtccgcctgaaaatatgctaacaagaatcattgtacaactgacttgcaaatacttgaacaaatacaaattaacaattactgcagctttatgaagaatgcatccaaaccaaggacagagtggaggaagacataatacaatgtatgggtacaatttaataaaaccttgaacctttaacatgggcccattttcatgcatgcattgtgatcaagttttgttcagaagggtgtaacttaactttgaaaaaaactatacatttttatgtgttttcagtgagtttaaccttccataagcacagatactctgttataaaagtgagtttaagctgcttcttgataatgaatgttgactgaaagtcaggccctatttccagtgtcatatgtggattgtcatatttaacccccgtaacaacctttgatagagataccattattttatatatatatataaaatatatatatttatttatatatatatgtgtgtgtgtacatatatatatgtgtacaacaggtacacaccaccacgcctggctaatttttgtatttttagtatagatggggtttcaccatgttggccaggctggtctcgaactcttgagctccagtaatctgcctgcctcggcctcccaaagtgctgggattataggcataagccaacatgccagacaaatattattataattttttgttacagatgaagaaacagacacaagggtttagggcaagggtacacagctagtggcaaagccaagcttggaatccctataggctagtggttagagacagtctcttaatcattcctgtttttactatgctgccttcttagtgcttaatacaaactaagcttgttgtctccttttactatggttgggggtataaatctcagtccataaacaaaggcttacaaaaaaatagcattaaaaaaattttattttaagttccaggatacatgtgcaggacctacaggtttgttacataggtaaacgtgtgccatggtgctttgctgcacctatcaacccatcacctacatattaagccctacatgcattagctagttatcctgatgctctccctccccaccccctccaagaggccccagtgtgtgttgttcccttccctgtgtccatgtatactcattgttcagctctcacttgtaagtgagaacatgtggtgtttggttttctgttgctgcattagtttgctgaggataatggctttgagctccattcatgtctctgcaaagtacatgatctcattcctttttatggctgcatagtattccatggtgtatatgtaccacataaaaaatagcattttaaaacttatgtaaattaattttatctccaagccttcaatctgtccaactataagaaaatgtaccccattatttttagacacacccaccctaggattacctgcaggacctaaggttttagaatgtgctaggttgtgggaagtggtccatccaacacctatctacaatggtttcaacagtgatttctagcacatgtgttatattagtttgctaaggctgccatagcaaagtaccacagcctgggtagtttaaacaacagaaatctattttctcatatagttgtaaaaggaagttaaattttgggaccccaaactcatttagccaaagggaaaagtcaagctgagaactgggtcacgcaaacctgcctcccctctttggttcctaaataagatggctacaagatgaaaaaatacctgccttccctatattttgcccacagggaaattcctggtgagctgttaaaacttcaccatggcaatgcaaattgatagtttatcttatacaggcgcagtcacccaggccctgccagactcaaaagcatatctgattgttcccctaccccattttgtctgtgctatcttatgtaaaatgcagattctccacattttttcctctgccccttttgtttatgtgaaaactgtgtgcttctcaatatcccaccttttctcctttaaatttggaatcctcaaaatcatctctggagaaaggcatacatctgtctcccaggcatgttcttaactttggcaaataaatctaaaatgattgagatttgtcttgtcattttcttccattgacagaggctagaagaccaagatccaggtgtttgcagggttggttgcttctgagggctgtgaggagaggttctgttctaggtcttggcttgtagatgggtgtcttctcccagtgtcttcacatggtctctcctctgtgtatgtatctgtgtccaaatttctatttttttttttttttttgagacagagtttcactcttgtcacccaggctggagtgcaatggcacgatctcagctcactgcaaactctgcctcccaggttcaagtgattctcctgcctcagcctcccaagtagctgggattacaggtgcccaccaccacgcccagctaatttttttttgtatttttagtagagacaaaatttcaccacgttggccaggctggtcttaaactcctgacctcaagtgatccacccacgttagcctcccaaactgctgggattacaggcgtgagccaccacgcttggctcaaatttcctcttctgtaagaacaccagtcatattagactcatccactctaaagacttcattttaatttaattacctctttaaagaccctgtatccaaataccatcacactcagaagtattgggggttagggcttcaacataggaagtggagcaagggttggggtaggggtgcacacagttcatcccatttgaggctctttaccagttcatgcaggcatgggacaggtcagggaaatccttggtaagtctgggaacctggagcccctcttctctgaagccttgccagttcccttaggagcttccacggaccaaagtgaaacacccaggggtggagggggtaaggagcttttctagaacaccttgcaaatcttgttgatggcttagatgtttacaaaactctagaaaaatcttatctccttgatatgagatcctggaagcaaggagttaaaagcctggctgcctacctaaggaggaggaggaaggagtggaagtaaacgaagacattgattatgatagaaaaaatgttaatagaaggcgatttttggaagccaaagagaaaattcagcttgaatcccctagtagtgtgtatgctcatcttcccaagacggaagtgcctctcctgtccgacctcctagcccagcctcggtctggaacacattgggtcctaggcacccagcagtgaattggctcagaaagtgtttgagggctcaagtgagtccaggaacgatggctcacgcctgtaatcccagaacattggaaggctgagatgcgaagattgcttgaagccaggagttcaagcctgtgtagttagtggtatgtcctcagcagaagccacaggactgtgatttgaagagaaggatatggggttgaactgcttcttactgccacggcagctctctggccccggaactggggcagttccttcattgtcccacctctgtcatcgcaggaatcccaagctgtcacacttctcagtattgtttcctttgcaatttgatgtggacttggcacatttccaaggtggaaacgacccctcattcattatttttgggacctcggtggccccgtgataagggaaatgatggatgcctggacttgtcttctggcattgcgcaccagatatcagggccctccacaggaccagcctatgagacaggaagaggctgaggtcttaaagacatactttcttgggagtttgatgtttcctcttgcttccacagctgtcagaaagggcttgttctgagggtgacctgcaggttgcaaggctgtggaaacatagcagtgacagcgttgaatggcttgtccccatcagtaagctttggtgtcacaccagccggatgactttctggtggagggccagcttcctgcacttccgtgacagcagcctgacagccccatggaggcatggctgtagacattaagacatttctgtagacatttgttctagttgttgtccttttttgtctgttatttattatttatttatttatcattatttatttagagacaaggtctcactctgtcaccaggctagagtgcagtggtgcaatcatggcttattacaaccttgatctcctgggcccaagcgatactcccacctcagcctcctgagaggctgggaccacaggtgtgcaccacaatgcctggctaatttttaaattttctgtagacagggtcacaccatgttgtccaggctggtctcaaactcctgagctccagcgatcctcccaccttggtgtcccagagtgtggggtcttaggtgtgagccatcgtgcctgccctgtttttcattttaattgtgtgacataaaatgtaaaatgtaccctctaaaccattttttagtgtccagttttgtggtattaagtacattcacattattgtgcaaccgtccccaccatccattcacagaactctttcaacttgcaaaactgaaactgtatgcattaagcaataactatcccttccttctttcctcttccccagctcttggcaaccaccattctactttctgtctctatgaagttgtctactctagtaacctcatataagtgaaatcacgtatttgtctttctgtgactggcttatttcacttagcataatgtcctcaatgtttatccatgttatagcatgtgtcacaatttccttcctttaaaaaaattgaataatgtcccattgtgtttatatgccacattttgtatatccattcattcattcgatacttgggttgcttccaccttttgtcttgcccttgtttttgagaggttaatccatctatgaggtcctccaggcatcaaaagagttccccagttccctactttggagaagttcactatccctagcaaagatgcaaagaacagatacatgaaaaagtaaatcatggtgcaaaagttgtatgagacaacactttaagatgtatcctatgagcgtaggtgtagatttgcaaaatggctggtgtggagtttctggaagaggatggcttagagagagtatggacttaaagcagagttaaggagcccaagctgaaatcctggctttgtgacttcctgtccttgtcactttgggtgaattattgaacctttgtaagctttagtttcctcatctgtaaaacgcagataatagtacttacctcatagagttgttgagaggattaagtgagtaaatgtaagtaaaagatgggcgtggtgattcatgcctgtaatcccagcactttgggaggctaaggcaggaggattacttgaacccagaagttctagaccagcctgggcagcatagtgagaccttgtctctaaaaacaatttaaaaacttagctggtcatggtggtgcacacctgtagtcctggctgcttgggaggctgaagtgggaagatcccttgagcccaggagttctaaggtggcagtgagctatgatcacaacactgcactctagcctggggaacagaccaagacattgtctcttaaaaaaaaaaaaaagtaggtaaagattgaaacaggctggcacacggttagaactcagtactaaaatataaaggagataacatattgcccactaacattttggctatttttaatatattgttcttgtctttttaatgaccacagatactctttagtatctgtttgctgcagtttttgcaggtattcatgatgcctgttatgcctttcctattttacctccttttcagattatgatagttttagcaaagaagtattcagttctagagactcattatcaaggaaagagagagctcttcatttggttttatcagataatagataataataaatatggcctggctttctttgcactgggaagatagagaatgaggaaggagaatgactattagtcattctaacgttagtctgttttatcgaactgaggagggagttagctttctccaactctgggcagattaccgagagtaggatgccaggttacattctcttgggagaacagtgctatcatggctgatctctcaattaaggacttcatatttagattatttaaatctcaaatattgaaatactctcatttttctaacaatgataattaagaaaactttgtaaagttacaaataaagtgaaattgaaaaggtttgctgaatgaagtattttactattgaaaggtcttctagaatgtaagtttcaaacacatcgtctggttggtgcattacttaatctattcctgtttggctgctgcttggtatttcccacgcaggagttcattgacttcaaggcaattgaatgcattattagccagaagaagaaaacatgtgagtctccttcacccaacaatagattttttaaaatacattgtgcacagtcctcttaaaaaaggcatcaatggcaggtgggtgtgaacagaggaatttcctcctccaccctggctgttgctgagctgtaagctgtaaacattgtgagagacaaaaagtatcaaggtctcaactttctttcggatattgctttgtatttctgtttactagtatgaatgaaaattttcctgaaaatgctggctaaaactgaattttggtgttgtctttctaatggaatttctgatcaacaatttcctttatgttggcaattgcttaatctgctgaagtaggtaaggtagttgtgctgccttaaaatttatttttatatttgtcattaaaaacaaacatgaaacttggaggttaattttgtctgtttaaattttgatgctttcattttgacaaaatcttttaagaataatgacgaggctgcagtgattgaaatacaatttgtgtggcttttaggcaagtgagcatttagcaagtaagaatttcccagattgggtttagagttgtatttgcttatgttccaaactctttttttttttttttttggtaagataattttgaatatcagtagaacttggggcagatagaatgacagaacatggaatgtgtaatccttttgggatttgtatcttagttaagtaaactttcatgatggattaaggaggacaaagtctccagcagatttcacttggctgattttgtttttctgttctttttctgttttcctgatgaggcttctgtacttctccctttaaggaggcaactgaatagcatgaaaataaggggtatgggtggtggtagttgctgaggggaatgacaatggatttggtaacacagcatgctaatatcatgcaaataatgagatgatataggaatctctgctctagtggtgggtctgaggtttgctctagtggtgggtctgaggttttctctactgagggcaaaattggagcttttttaaaaaaaaaaaaaaatttaatttttttttgagacagggtctccttctgttgcccaggctggagtgtagtggtgccatcacagctcactgcagcctccatctcccccaggctcaagcgatcctcccacctcagcctcccgagtagctgagaccacaggtgtgcgccaccatgcctggctaatttttaaattattttgtagagagagagtcttgccttgttgcccagactggtctcgaactcctggcctcaagtgatcctcctgccttggcctcccaaagtgttgggattataggcatgagctgccacacccagcctggaactttcttaaaagagaacttctttcttggtttgccacacctctgggttaacaaggtgccagagataattagcccttgattgggagaatgtgggactgttcactatggaaggatcttacagtatagaaatgaaaccctagtgtaggaagggagctgacatttttcagtgttaccttgacttaatttgcaaaatgttttattttctgaagccacagtgtaattcacagatgcaccaagatcaaaggtctctaagaagaagaggttgtggggaaagagcccagtagaggtagggaggccacaatgaacccattgagttattccacctgtcaaaaccttggttttgtaaactgcaaaataggaccagtaatacctatgattagctgctgctgttacgaattaagttcagtaacaagtccgacatggctggcgcatgctgttttcaataaatataaattctgctcccaaccattcaacatcaaatgagttgatctgcaaaaagtgttttgaaaactacagatactaattttcatttgtgtatgcctgttagttgacttcaaaacatttgtttgtcccaggaacagaagagaaatatcctttgatcatgagacaggttcatttttagtatgttaaggccactccatgtcattcttgtggcttgttaatgtggttaattgaaacccttccatattcttgatggggcagaaccttcagctgttttcatgttcatgttcaggggtgtaaatttctagacgatcttgtgggcctctgtcagctctgagattaaatgacgtgtgcatttgcttatcggattcttaactctaaaaccctgggatgaggactaggaaggagaaccaggaggcgctgagggaacaacagcttccacatggcccatctgctttgcagaacctgtgtctttggggtacaagtgagctggaggtggagctgcaacagagtgagtccccgtggtcagtcacatgcaccggcttccgcctggtatgatttatcagcagtgatgcaaacatgattcagagatagttttataagaatttttacttcggttaaatcataatcaggcggctatttccgtttttctaatgtcacttgattagctcaagatgcccaacccttattgtcctgactcatggagggaggctgcttgctaagtaatcgtgagacccaggagaggaagagggttggcggccatccccactggaggggcatcctggaaaactccagagagggaagcttgtgaccatgactcctagcagagcggtactgacaacctagtacaaaacccatagtggaaacactttcacctactctcatacattcatcttcccctgagaggaagcagagctgacattgtccagtcccattctgcactcaaagaaatgcagtctcagagaagctacgggaatggttcaaggtcacatgcttgcatatggcaaaattccaaatgcagacagaccactgaaattaggggagaggggagatcttctctttctactttaaactattttatattgtttgggtagtttccaaagaacaatgactattttaaaaagaattttaaaaagtaaatttaaaaactaaaaagttttagaaactaaattttaaaatctctgtttatttgtgattattcaaattttagaaaatgaaaaaagagcctcaccaattctttcagtcgatcctctcatttttacagaccagaggactgagaaaagtataagttggtcaattgtgataagctgggtattggcagaaaatctgttttaaaacttagtaggctcactgggatgattgaagctctgtgttctgcttaatacatgtttagctgcctgaactaactcagatgactccatgctgtaccatagagagaggagcctgacctttggctttgggatctatgcgaccccagtcagaacatggcacttttgatgtcttcatgacctttggcgtgctactcttcctctttgcatttctgtttttttcgtctgtaactgggaataatacccatccggcaagtttcgaattagaaattagaggccaggtgtggtagctcatgcctgtaatcccagcactttgggaggctgacgtgggtggatcacttgaagtcaggagttcaagaccagcctggccaacgtggtgaaaccccgcctctactaaaaacatacaaaaattagccagacatggtggtacgtgcctgtagtctcagctatgtgggaggctgaggcaggagaattgcttgaactcgagaggcggaggctgcagggagcccagatcatgccactgcactccagcctgggcaacagagcgagactctgtttcaaaaaaaaaaaaaagaattggtagaacccatctgaaattgccacttttataggtcaaatggtcgaatattagaaatttcatgtagttgaactcaacatttagagagtctgataggtactcagtaaatagttactattagagatgtaatagaggatacaaataaaattcttatggttgctttagcgaggtcccaaatgttattttcttctcccaaggaaatgactaacaggaatatagcttttcacttttttacattggtaaagatcttctctgactttggaaagcctgccacttactgagggccacctctactcatggctcccaggatgtagtctatcttattgacgtctttgacagttcataactcagttcactttctccctgtctatgcttggtcacttggatggatacatgtcctctgtaactcctccttctttcagttctctttcaatgaagatcaattatttttcatttaagaatcttcctgtgcaatgattgctctatgccctgatacatagaaaatgggcatattttccaattagcactaccattgtttcttgtgggtaaatttcggctaaaattatgtctataaaattcccttagacttaagtagtattattgagtgataggagcctgagggtgatttgggagatacttgtgttctgcccatcactgtgttattaactaaccttatatagtcttcgtaggacttgttcatatatgtacaaggtcagtaagatcattctaagtcaaacacttggctatctgtgattttctcaccattttgtgtttatagatagttcagacagtgagtgttagggaaacagtgaaaggtgagttagtagtagttcatattattaactcattttattggaatttccaatttttccttcccaaaatttttctctgaaccagtataaccctaaacctattggtaaaatatagaatcttaagcctattggtaaaatatagaatcttaactacattccaatataaagcaaactgttgatgtgggcaaaaatgagggggaggagagggagaaagaagtggaagagaaaatgagaaattctaagtcttcatcactttccacaggactcggccataacccaaactcaagctgcccactgttgcttgggatggcgggctctctctggaccagctctgtggctaagggtggcaaggggcccatcagaatggagcagtccctgatctatcagaggtctcaaaaaactgcctgctactaagcttggatctttccagaatcatgtggatgatagaatttgcctatagtgtcatgcatggaaaaggaagagaaactaaaggcagactttaaaggaattacttatctgtgccctctagcatctctgagaattgtgctaaggatttgttgcaaggatggcggtagatgaagaagccattggtttgagtgagatttggagttaggcgtagtaatccttgggtgctggagtagtgtcttgtttgagggagcagtgttcatagggcataaatgctatagaggtgtctgaaccacctggagccacaatctgtcctcatgatcttgcccttcaaatgcagccgcatgcccacataacccaccttggggagtagccaatactcaggctactctgtgggctggcattcttggtctcctgacttctgccccagctctaccttggttgataccccaaatgccccttttcctctggcctacctagcctgctttctccccttcttccttggttaactttgcacgtgaccattttgattctctaaagagaatcattcaattaggaaatggaaatctgaggcaatgagagagaggagacatgcatcactatttatttttagaaacttcacacaacaccaagcccaaactgttaagcattgccttaggagaggtttctaccattgtgcttgccaggtataagaaaagaaaattacaattgattctgtaatttcttttgtaataatcatcatagattccaaaacacagaatgagtctttagtgcgaagccctgaagcctctgtctgcaagtccattttaatgacagtttttgttctgagcaagaatgcgtcattgctggtcttgtgttttcagacaaacacaaagcttttaggaaataagaagcttaagtaaaaagactacaggttgttctctcctgggagttcctggacaccctctcaactgggacacttgaagtgagcctcatgacctgagctgagaattgccatggctgaaacagcttttatagggtgttttacatggacacttgacactctttggatcacattgtgtgtgatccagactcaagccagggttagcctagcttgttgttttatctcagttaaaagccttttgttaagagaacaaacaagaaagttcagataggtcaagaaagccagctctgaggatatatctagagggcaagtcatatttatttttcaaagtttccccaggaattaaaggttgcacatctaaatgtcaccacttctgtgacttttgcagataaacattagatttacctttggcaaactgcagtgtctacattatgggatttccctccccagagtcttttctctggggaagttctgaaaaattgtttcagggatactatagttcttaaatataactaacaaacatattatgaaatgctgttagtttttttctggaggctgaatattgattgctacttagtataccttttttaatgattatattgtcccaccaggatatttacacagcttcatgtgtcttcccacaaaatacacatgaattgcaaagggaatatagtaacttggcagtagagaaacttggcagataccaccctaatcaaataatcaaatctaacaccattagtaattggacaaattggcagtgtgcaccatttgatgagatgcacagaggaaaacacagcatcgcttctgtgatattcctgcacaaatgcatgagttagatctaatcatgaggaaatatcaggtaacctcaaattgcgggatgttcaacaaaataacttgtctataatctttagaagtcccaaattagctgggcatgatagctcacacctataatcctagctacttgggaagctgaagcgggaggatcccttgaggccaggagtttgaggccagtctaggcaatatggtgagagcccatctcaaataaataagtaagtaaaagtcatgaaagacaaggaaagactaagaaagtaccccaaattgaaggagactagagacatgagacatgggagcctagattggatcattttattagtaagaacatcattgggaccaagattgaaatttgcatgaggtctatggtttacatgtagaattccatcaatgttaattacaagattttgaggctggactgtggttaggtggaaaaagtccttgtttttcaaaaatgtaccttgaagtattaggaataacgaggcattatgtctgcaaaaagactccaatagttcacaaaaaaattataaacacacacacgcacatacacataccatgtagcattctaatttttagaaccagaaatgagcttttaaaaagtcaccataggctgggtgtggtggttcacgcccgtaatcccagcacattgggaggctgaggcaggtggatcacctgaggtcaagagttcgagaccagcctggccaacatggtgaaaccccgtctctactagaaatacaaaaactagctgggtgtggtggcgtgtgcctgtaatcccagctacttgggaggctgagacaggagaatctcttgaacccaggaggcagatgttgcagtgagccaagattgtgccactgcactccagcctgagcgacagagtgagactccatctcaagaaaaaaaagaaaaagaaaaagaaaaaaaaaagtcactgtaagagatgaattagaagaatgtgtcttgaatgcgggcacaatttatttttgttgtcaattgacaatcttgaaaaaattctggccgaatgtcggtgtgccagctgtttcatgcaccagacctgtagttcacccctactcttttacctgtagttcatccctactcttctaaggcttgaatggaaaataatttctaatttgttgtaaaatttaccaatttggtattgctgctgtaaacaggattttatctagggtttagatgccttatcttcaaattccactatcaagctagtacataaaattgtttgaaaactgaatcagatgtttatgtaattcataaaaacatataatttccctctaatatttcatttttcctaattataaaaataatgcatgcttattatagaaatgtagacataaaaaactataaaaagaagaaaagaaaactcaatccaaatcttaccactcagaaatgacgtgccactggtaacatttagacttatttcctcctaatatgtatattttaaactgccctcattctctttttttctttctttctttttttttaacctctatagtcgctcctgtaaaagctgcccctatgcttgtaacattattctacaatggacttttggatcctaatgtttttactcactttagcataagcattttcccatgtagcaaaatttcagatattttacctttttattttaaaataattttaaacttagaaaagagttgcaagagtagtacaaagaatttttgttttctcttcactaattgttaacatttctcatatttgacatgttatataatttatatatgtctatattatatacagatgcataatttttaatatttttttctgaaccttctaaaaataagttgcagatatcatgcccctttatattactttatatagtctcaaaagtgttaaaaaaattcaggaaatttgacattgatacaatactattacctaatataaacttggtttttcaaaatttgccagtttttgcaaagtgacctctagcatttttttaccccaacaccaggatccaatcctggatcacactttgtattttgatattgtctctttatcaccctctaatctgataaagctcatcagtcctttttctttgtctttcatgacattgacatttgtaaagaatatttttccttccatgtgaattagtctggtttctacacgtggtccttaatagctataaaatattccaccgaattttacctagataaatgctttatgttggtgatttgatggtttctagtgtttatcttcataaataaggctgcagtgaacatccttgtatttatgttttataaacatccctggttattttctctctgatagaatcctggaaataaaatactgggtaaactagcataggtatataggctcctgaggatatataggtatatcatatatattctacatatatatatatatatataggtatatatacctccaaaaggatgcttttcaaaaggatgaaactggcaagaataaaatctcactagttgccaaatgaaacttcatttttgaaacacaggagtataaaataaaaacttacagaatatatcctatgttattatttttcagttatctgtaatattttggtcagatgtgctttattaagtaaaaatatagggtcccaaatcatgcacacatgatgtttagatgcatatggaagaccagctagacaaggccacctccgagttttgtgtgttgagccactttttatgggttacttattcatttgaaattgatcctggcatctgtcaaggtaacattacagtatcactgcttggggctccctttcacttgcctgtatggatagagctttaatgtttatttcgtgggcaattcataacctgtagcacatgaaggaggctgtcacgcaatgtataccacccctgtggtaggcccaggaccggcgtttgtctcaaacaattccagtaggccttttattcagtgaagtggatagatttggtggataccactcagtgagtcagagttttggaatcaatgttctccatagctcatagcataagctctggagcctgacaatcctgggtgtgattctcagcttaactacttgctgtgtgacaacaagcaaatcccttaacctctctgagccttggttcctttatctgtaaaaggaagactgtagtcgtactcctctaatagggcgataccctattagatgtggatgaaatacaataacaaataggaagcctttagcatgttacttggcacattgcaagtacacattcagtgatagctttcataattactataatagtacattcatttcgaggttgtacattgacagtgagcaaaacactttaacatcttgtgacgtgggcaagttctcccatttgacagatgagaaaccttagacagaaagcgggttatatgaactaacaaagccatgtgtcaggtaaacggtgaggctgggcattaatctcacgtctctgactcatgggtcagcgggtcagggctctctcttcaggatatccagtgactgttccataactcgttacctggaagtccaatgctgtttgggcaaattttgaataaacccagtggttctcctacagatacatcttgatttagaataggcattagcaaatgttttctgcaaagggccagacagaaaatattgtaggtcttagccgagtgcagtggctcacgcctgtaatcccagcactttgggaggccgaggtggtcggatcacgaggtcaggagttcgagaccagcctgaccaacatggtgaaacgctgtctctactaaaaatacaaaaattagctgggcgtggtggtgtacgcctgtaatcctagctactcaggaggctgagacaggagaatcgcttgaacccaggaggcagaggtttcagtgagccgagatcgcgctactgcactccagcctgggtgacagagtgagactcagtctcaaaaaaaaaaaaaaagaaagaaagaaaatactgtaggccttgcaggccatatggtctctgttataactacatttctcaactttgctgctcaaacttgaaaacagccttagacaatatgtaaatgaataggcgtggctgtgttataataaaactatttactagaaccagcggcgaccagatttggcacatgggctgtctttatcaacccctgatttagacagggtgtattctggcagggggcacatgcatttcattatattagttacatgacaaccttcttttgagttcttagacatagtgaagaacactccagaaccttgagtctggcatgtagtaggtatttggtcactgtttgctgaatacaggaaagcttctctgtctatattttcctatggtgaatttttctgaatttatgtattcttatctatttttaaataactgttttattttagcacttatgaatttttaagttttgtttttgtttcacattgttctgaaaggacattaaaagcagatcgggaaaagagcatttagccccaaatgtaggtttaaacatattttcagatattcttagtgtttgtcgtgtatcagtttgttattttattttcattctcttgcactgagggtaatttccaataaaaactctggagaatttagacagcttttgttttaattaggaagctatttcacttgcactcttgtactactgttgactcaaataattaacagtaatggctgaataatttgttctttaaaagtaaacaacctccctttgtaatctagaaaagaatcagctggtgatacacatggagtgtttgctccaagaacatttctcatggtgtggaaaatggcagtggtggcctcctggctttcaggctgaaatacatttagctgatctttgtcggcaaaggtgtccaacaatagcaactgcttatgacaactaattttaggaaacgtgtgtagttaatttgaaatatcgccctgggccgttcaaccttggctgaataaggatgttttcttttaaaatcagtactttgcttccctcagtgattattccctattagcctgccaagaaatattatttcccttttgtatgatttgatgaagtacctcaaaaatctcctggttatggtcaacatttcatctgataggaagcgagtgtatctttctggtatacagtgaggcatgaggacacacagcttattttaatcttcaagctcgcctgtaatcctagcactttgggaggccgaggtgggtagatcacctgaggtcaggggattgagaccagcctggccaacgtggcgaaacctccactctactaaaaataaaaaaattagccaagcatggcggtgcatgcctgtaatcccagctactcgggaggctgaggcaggagaatcgcttgaactcaggaggcggatgttgcagtgagccgagatcgtgccactggactccagcctgggcgacagagtgagactccatctccaaaaagaaaaaaaaatcttcaagttgagatgttaggttaatcttcagtctccctgtgttttcccacaaggaatagtgtggaaaagacttggggaaaaaaaaatcatcatgattcagccaatgaccagggcagaggtataaatggagcatgattctatgtatctgtctagaaggcatatatggagcatgattctatgtatctgtctagaaggtatatatggagcatgattctatgtatctgtctttctgtacttgttgcctactgagaaaatacagatttttattagaaggttgctgggcacggtggctcacgcctgtaatctcaccactttgggaggccaaggcgtgcagaaaacctgaggtcaggagttcgagaccagcctggccaagctggtgaaacctcgtctctactgaaaatacaaaaatttgctgggcgtggtggcaggatcctgtaatccaagctacttgggagactgaggcaggagaatcacttgaaccggggaggtggaggttgcagtgagctgagattgcgccattgcacttcagcttgggtgacagagcgagactctgtctcaaaaaaaaaaaaaaaaaaaaaaaaaatagaagattaaggatccctatctgaaaaatcaactttgttctttctcttcatcagttttgtcagtgtacattcagcagctactacacgctaggcatagtgccaggcagccctggggatataaacatgtaatctatcaccgctgttaacctactggtgatttgaagactgcatcccaggagaccaatgatagtgatggaaattggtagggaaggttgctttaaggtctttagtatcttctatttgcctaagagaaagagaacttttgggagaagaaaccatacattttatctcttttcatctttatgccttatgttatcaggaaaatatttaataggagttgccaataaggttgataattctagaccatcaaaaccatagaggtgtgatgtcaggtgtaggaagagatgggaaacacgatgtaaaatgtctgcgtggctcacataggaaatctgtgcttagagtgctgtggcagaagtagaaattgctgtcagccaactgattttctgattcttctgtctataaaagctgtgcccattgttaacttaggtgataagttgaatttttagtttttttaggttttttgtttgtttgtttgtttttgaggtggagtctcactccgttgcccacgctggagtgcagtggtgcgatcttggctcaccacaacctccgcctcccgggttcaagcgattctcctgcctcagcctcccaagtagctgggattacaggcacccgccaccatgaccagctaatattttgtatttttagtagagatgaggtttcatcatgttggcaaggctggtctcaaactcccaacctcaggtgatccacccgccttgggcctcccaaagtgctgggattacagacgtgaggcactgcgcccagccaaatgttaaaagtatttttgagcttctcagaggaaaccaatgaactgaagttcaataatctgtggtttgtgttacaatattttgaatccttccggagactgaatgaaagatacatatttaaagtgaatgcagtaagtaggaagaggcactgcttcagcctggtaacatgcagttattgctttgagggtcttgcagaaagaatatgcacattgagtaagtaggagaaggtgtgtattttggaaaaatcaatcaacttagttcaacttgaaggttttcctatctgaaaagggatgtatcaaaagatattttttcttaggaggaaaaaatccacaactcgcaccagagcatttcattgagaattactgttatttacgttttggaatttacattgttaaaaagagagattttggaaaggcaggggtgggactagaattgtggcttgcatgttgcctataaacatagattcctttttttagatgtctgtgtttcttagtggattatgttcttaaaatagaacataccacattactctctggtttggcagggtgtggtgttttgtttactgcttgggtcaatgttctatgaacatgaatcttttcacagagaatcccagggctaaaagaattcttagaggtgagccagtcgaggccccagcacccgcttcccaaaggctcttcctgccagccaccaggcctcatgctccagtggcagtccagcccaagcgacaggaaactctcccttcttttaactggaatctcacatccagtggcttctctgcttgtgctgggtccctgctggggcttcccagaattctgtgcaactcctctttcctgtgagagccctcacgatgttagagatttggggtggggttctcatgctcactccaaagcccctacctctccaaaccttcctcaccatgctaaatagccccagttcccccatatgtgttcttatttgatagttaaagccctttgccactgatttcaaccttttaatgtgtgcagtcaagagagaaacctgtgttctggtctagaacatcacctatctggttctttggttcatacttttctgaatatatcccaaggtagtgcaagcagtggctttttgttttgttttgtttttttgagacagagtctcgctcttgttgcccaggctggagtgcagtggtgtgatcttggctcactgcaacctctgcctcctggatttaagcagattacagtagtgtgccaccacacccgactaattttgtatttttagtagacacagggtttcaccatgttggccaggctggtctcaaactcctgacctcaggtgatccacccacctcagcctcccaaagtgctgggatttacaggcttgagccactgcacccagccaagcagtggcgtcttaacataagagggtcaggctctaaaacaccgtaggaagtgaaatctgatatggtataaaaatcacccttgagatcacctataaaataaagtatataaaaacaaccagtagttttgtgtcagaaccctttgtaataattcttacgtacaataaagtttagaactgctgatctggcctaaagagtagaaataaggggaaaaatctcatctacaaaagacttctgcataaagatagtggattgaacacaggcatctacttgcgcccaccaccaaacaaaacatcatttaaatgatacaaagagaatttttggttttggttttgtggtaaaatgtatgcaacataaaactttaccattttaaccatgttaaggtatacagttcagtagtgttaagtactgaacatattgtgcaactgttgccaacatttttgtccagaactttttcattttcccaaactgaaactctgtacccattaaacaatgactctgtagggctgggcgtggtgactcacgcctgtaatcccagcacgttgggaggctgaggtgggcggatcacctgaggtcgggagttcgagatcaccctgaccaacatggagaaaccccgtctctactaaaaatacaaaattagccaggtgtggtggcgcgtgcctgtaatcccagctacttgggaggctgaggcaggagaatcacttgaacctgggaggcggaggttgtggtgagtcaagatcacgccattgcactccagcctgggcaacaagagtgaaacttggtctcaaaaaaagcaaaaaaacaaaaaacaaaaacaatgactttatattcctcacttcccccagcccctagcagccacccttctactttctgtctctacggtttggctactctaggtaccttgtatcagtggaatcatatagtatttgtccttctgtactaacttatttcacttaggggagttttttttaaaaaggcataagtctataaacacaagcataacagaaaacgaggcaacaacagcgtggtttttggcattaggatacaggggtgtgtgtggctaaaataaggaggcctagtctgttttaataatgttgaaacatttctgagcctttgcacttctttagatgaatcagttggttctcagccttccccattgacagcctaggatactgttttgtttttgtttttaagtctgcaaagttttttgttttttggtttggtttgttttttttcctacttatctgtctgctttctatcttgccaagttttgttgaaaaattccattggtagcaaagagaagatcctacctataagcttccagggggataaaatagatcacatacaaagagtcaagaataaaaatgggcttgacttcttaacaccaacactggcagctagaagacaatgggaacaaggcctttgatagcatggaagagcatgattttaaaactagaattgtatattccatcacactcttgtgagggtagaataatgcatttcacacataacaagttttcagaaagtaactggagaagatggtccactgagatgagggagtaaaccaggaaagaaaactaccagcggtagagcaaatgggatatccaacctgagagaggcagaggaaatttctagatgcctagggcgggaactcccagctgaccgctgtgctcctgaagcatgccagaggctcaggaagtgacttcctttgtaaggtggagttgatagaatatgtgaggcatcttggtgtcatgagaagagatttagagatatgatggaaaagtttaggcttgaattagcaagagctatataaaacactaagcaaaggtggggaaatactgttactaatgctgaaaacagtaagatgttcaggaaaggaaaactgaccatcattcaccatgtggcttagctgaaagtaatgttatgttattataatactgatcttcaaaagtttccatataattatattgggaagagtaccctcatatggtgagggcatagataggaaaaaccattaaattatcattctccatattgagaagttaataaataatgccaacaatggaaaaatcacaaagaagcaatgtaaattgttaccaaaaattacctaaaagaggttaaagtaccaaggatatccttggtaactatgggggggttggttccaggagcttcctcagatacccaaatctacagatggtccttaatatagaatggtgtagtatttgtgtataacctctgaagatctctagattacttatgatagctaatgccatgtaaatgctgtgtaaatagtttttatactgtattatttagggaatcatgataaaaaaaagtctgtgggtgttcactacacgtgctaccatactttgtttgtttgtttgtttttctttttttttttgagacggagtctcgctctgttgcccaggctggagtacagtggcacgatctcggctcactgcaacctccacctcccgggttcaagcgattctcctgcctcaacctcccgagtagctgggactacaggcatgtgccaccacgcccagctgatttttttttttgtatttttagtagagatgggatttcactgtgttagtcaggatggtcttgatctcctgaccttatgatctgcctgcctcggcctctcaaagtgctgggattacaggcgtgagccaccgcgcccggcctagatgcaaccatactttaaaaaatatattttccatcgtggttggttgagtctacagtgtgtaaccacagacgcagagggccaattgtacttactcttgggaggaaaaatcggagggaagcaggccgaagtggtgacccgtaggaattgttgttttctgtactattaggcgctttaaactatgtaactgtatgtctttaataaaaaatagtaattaaagttaaagagaatgtgtacaaaggaaagggaaaggtactggaggatatggtccagcaaggtgaaggggtaagttgaaaaagtataagaggtgggatacaggaaaccagggatatagaaactcaagaaaatataaagtctagcagtcaactaagcaagactggagcaggaagacccatggctgtgggacacaatggaacaggtggatttcttgatgtatggatgtagaaaatactactgtgatgtttcaccgatctggaactttgggccgagttagcaatatgtaagtagaaaactaagtaattgaggaatatagttaacttcagaggaaaaaacctcagaaaattagacaagaaaacatagtatactctgtaagtcttcagtgcacaaaatttatatgaacctaataataaacactgaataataaatttgtgaagtaaataaaaatattgggaggacaagttgagggggatgccaatggataatgcctaaaactgataaatagaaagcaagatagcctaaacatcatatttagaaaagtgtggcaagtaccaaaaagaaataactacagcccatgcgaagtggctcacacctgtaatcctagcactttgggaggccgaggcgggcggatcacctgaggtcaggagtttgaggccagactggccaaaatgttgaaaccccatctctactaaaaatacaaaaattacctgggcatggtggtgtgtgcctgtaatcctggctactcgggaggttgaggcaggagaatcgcttgaacccgggaggcagtggttgcagtgagctgagattgcactactgcactccacctgggcaataagagtgagactccatctcaaaaaaaaaaaaaaaaagaaataactacaaagagttgcaagtggtataagactgagaagtgggagggtgtggggcacttgtttgacaatttaactcttaaactctgtttgatttttaaaaactatgtgcttgctatttgcattttaatctaatgaaggtaaaaatggattaaaatataaaaaagaaaagccatctatatgcagatgtctgggcagtataaaaggtctgagagatgtgcttaatactatgattattaaagaagttaatgtctatgagagcacccagcacatagtaggcactaaataaatgtttgctggatttgaatctaaagcatgcttgatcagacctacatagaggcaattccttgaaaagctgcagagaatgacttgtaccatttgctgactttccaagatggcatttcttgctggggctccactgattattactgttgtacctgtgggcattgggctcatgaccccataggtgcgtgtgtgtacatgcacatgcattaagttgcaaagtcagtctaaatgacttgactatcaacctgtctttggcagccatatcacttttggcccagttggcaccatcaggtttctggacacagaggcagtattttccatccctgtcctacagagtgtatttgtctcaagtgttatgtacttttccagtttctttgcccccagtaaatctctagggtcatgaagatcattacaaaacagatagtcatttcatctctcttcttaaagcctctcacccattgccctaggaagaagaccccaaatccttggcattcaaagcctaggtggtcaatgatttgaccccctacccattgctctggctttatttcttgccactccagacttcactgtttacactcaagtaaaaccaaagtaattgcaattctctgtaaacactacgccattccatacctcaggtgactttgctcttgctatccttcctgcctggactaactatctcacatctccctgtcacacccaactcccaattctctccaccatgctggtccttctctctaacatggctaactctaccccactttaagactcagctttatcagcccttgctatgagaagcctttgttgatcaccccaggaggagaaaggtgtccccttttgtgctctccatcaagagcatcacagaactaatgcatcatcttaatactattaatgtgtctgatgtgtcggagaggccccaaaggtttgaggaccatgtttgtcttgatcactgcacagtacctgacccagctcattcccagtagggctgggactaatcttgcaggtcttcacagttgcaatcatttgttcagaggtggctcttccccagtctattacagaagcctcatgtctattcttggagagtcccaagaccatggcctctaaggttccagccttatcgtggtttggaggctccttcagttccttgtcatttgaatgcagaactggatgctgtgaatgagttctagaacatggttccatggggcagagttctgactttaaaaaagccatttactaaccaagctgcatggatttctcttttcccatttcatcaaggaagcaccccggctaggtgagctggttcatttcattcattgactcaacaaatatttactaagtgtctgccataggccagttactgttctaggcatgtaggagacagtagtgaggaagatggatgaggtttctgtcctcagggacctgagatcgtagaggagggaagcaaacacagagccatttggagtggtaataagtgctgagaagggaagaaagggaatgtgggatgagggggctgcttagatgtgctgatcaagggaggaggtctctgagacaacagcatttgtattgtatggttctgaattgcaaaaaagagctgttcaaattgttatcagtggagggtgtccaggttcttggcatcttgaacaaagaattggacaaaatgcacaaacaaaggaaggaaagaatgaagcaacaaaagcagagatttattgaaaatgaaagcacacaccacaaggtgtgccttcacaagcagcaagcagctcaagggactggttacagaattgtctggggtttaaataccctttagagatttcccattggttacttggtgtatgccctatgtaatgaagtagtggctcatgattagtctgattggttgcaggaggggaccaatcagaggctgaagttacaaagctacaccctatgcaaacatctgattgtggaaagcaaccaatcagaggctgcagtgaagttacaaagttatacttctatgcaaatgaagatttggcccaaggccaacctgattggttgtgggaagggagcaatcagacataatttcaatttttcatctgccacacaagaaaagggtgggggatttgcaaagggagtagttctggtccttttgttactttggtgtggaaagttgaggttttccttttgattcagttctaggtagtcagcgtgaattggctttaggttccctgcctctagaccctattctcctgcctcaaaataaagagctatatagctgcactctccagccactggccacaagtagctattaaagtttgcatttacgtgttttttttttttttttttttttttttttttttctgagacagagtgtcactctgtcgcccaggctggagtgcagtgatgcgatctcagttcactgcaacctccgcctcccgggttcaagaaattctcctgtctcagcctcccaagtagctgggaatacagcttcaagccaccacgcccagctaatttttgtatttttagtagagctagggtttcaccttattgatcaggctggtctggaactcctgacctcaggtgatccacctgcgttggcctcccaaagtgctggcatttcaggcatgagccaccgcgccggcctacagtttgcatttaagttaactaaatacaatttaaaaaatcagatcctcagtcacactggccacatttcaagtagtcagtaaccagcctatggctaggagcaccataatgggcagtgcagagcaatagggagaaagggcactggggaggcggatgggagaagcagtaagaaagggaaactagatcacttgttggagagcacatgtatgcatttcaaagaactgcctcctttaatttcacttgttgaaaatggggctgaagccaagactagttatgtctgatagaatgttttaaagtggaattaaaatgatctctagagataatataaagcaggtaaaaaccagccatgaaaagatctttattaaggaatatggcatggctacagcaagtcctgagatggagataagtactagttgattccaggggccagtggatgaggtcacagttaccccttggccttagaaggaggaagccagacatcctaactctgacaccaggagcatactttacctaaaatcttaaagacaggacaatgtttaaaaaaatcccttcttaacacaattcttaacaaaaataggattttgacttttgtgtcttaggaggctagaattgtattctcatgccattaccaggaacggctgtgccttgacttcattttgtatcgtgtttcacaagatgctcatccctttttgcacctgcctctttgctaaacaggttttcttcctctctgtaaaggtgcctttgtttgaaccaatagtgttacttctctttactgtaaacagtgtccagtgactcttccttatcgtggagagccagcagccttttacaggaggagaaaagtcttgaaggtcactttctgatgtttacattataagtcatcatgactttaaaagatgaaaactaaaacaacaacaacaaaaaaccacaactgcctactgcttacccagggcatgttatcctattacatttgaattcaagtaacagctagtatttgtcaaatcataattgatctgataaaatgtaatctgatcattagtagctgtgtaaacgtaaatacactcgactcctgtttcatttgcccttgaaggctgtaacatggttccaaagtgtacctttgaaccggagaagtcgggccggttcacattgcagcctgtgtgcttcctggggcagcgtccaccaggtgtgtgcgggcaggtacaggatgcgagctcagtcctgcttcccctgaaatcctgtgacctggcagagggctgtgttcctgtgtccttacatcggatgtcctactgaagaaagggaaactgggacgaagctgtaggcacagtgggttctgaagatcagatataactgagggaaagttaggtcatgattgccacctggatgctgttctctctcttcacggtaggtctcagttacttttactgtggacttttgcttgctgcagagggaacttacacctttcatgcctcaagctcattaaggcacatttctcttttattcttcagggacattgcatttatgaactcaaggcattgagtcacccagagagaaaaagcatatcccaaacatttcagtttctgggagttctaaaaagctaatgttgtgttcccatggccaacatttctttaagagaggtaaagcagaataactctaggtctataaaaatgctgatctgcttcaagttctaaatttattgtgaattatttatttttccctagtaattactgtaataccttagtaccttcaacttatatagcatttttcaaggaggcaaagcatcagtagaaatgttctctgggatttttttacctgatgttttaatgctgtgatgatttctcagccccttagtaataatgttagatgcactgtggaaaaactaggcacgtagctgttaagctgggaatgtatgaacggtatacatgctatgctttaaaatctagctcaatttttttttttttgcattgaccttgaacatgctgacaacataggtcggcatgggtaaagctaaagaatggccttagggtttgaaaacaactacatgagctctgtttcagacctgctgctagtcgggcacttggcactttgcagggatttggggcaggttttatgtttgtgtgcttctcttagaagtcaaagagttggtgaggtaactgcaatcctgtctatatcagtgtagtgataatgcagtagtgtaatgaagaatggagctgcacgtgtgaggtttttcaagtccacaaagatcaggtattgtctacggtcaataaagatttttttaaaaaaccctcttaactaaagagaggtaacttccttttcaaaactctgaaatttacatgtgctgacttataatgtgtgtgatcctcgttgcttttctgatccttggtggttggggtgtgtgtgtgtgtgtgtgtctgtgtgatgggctttttaatctttgagatttattctttttttttttttttttttttgagacagagtcttgctctgtcgcccaggctggggtgcagtagcacgatctccgctcactgcaatctctacctcccgggttcatgccattctcctgcctcagcctcccgagtagctgggactataggcgcctgcctccacacccggctaattttttgtatttttagtagagatggggtttcaccgtgttagccaggatggtcttgatctcctgacctcatgatctgcccgccttggcctcccaaagtgccgggattacaggtgtgagccaccgcgcccagccaagatttatttattttttacttacacatagtgaaattcattctttttgctgtacatctctatgagtttagataaatgcttacagttgaggaaacatcaccacaatcaagataaagaacagttccatgatcccctaaatatattttgcttcaaatttctattggcatgtttgagtatcaagtttactaccacttctgaagatggagccaagcccttttgtaacaaatagcacagctgtgtctgacacttttcatgtgaaaggttgcctgagatgtcagaagtaagatctggccagttgcagtggctcatacctgtaatctcagcactttgtgaagccgaggcgggaggaccacctgaggtcaggagttcaagatcagcctggccaacatagtgaaactccgtatctactaaaaatacaaaaattagccaggtgtggtggtgcattcctgtagtcccagctacttgggaggctgaggcaggagaattacatgaacccgggaggtggaggctgtagtgagctgagattgtgccaccgcattccagtctgagtgacagagtgagactccgcctcaaaaaaaaagaagtaagatctgattgacttatccttttctcaaagttataaatgggaaaattgtacaatctgaatattgtttccttgtattttaattaatgaatgtagaactgtgtaatgtattatatgcttttttaaacccaaagaaatttgtaataaatactttagttagtaaaaagaatatactgaaagtgaaaaaagtcaattttttgcactttagatttttttttaagtgagcttagttctgtgtggttttaagggcagtgaaatgctgtagaaggactgtaatctgcataactcaaactggcttaataagtggaatttattggctaatatcactgaaaggtaaaggtacagggatagacttgaggcattgtgggatctagaaattcaaacgatgttatccgcctctctttccccactcagctgtgtttccctctgtgttggttctattctctagtagactcttgcttgctgtatcaaggtgactgacagcagcttccggcttttattctactttctcaattccgtacagttccaacaagtctcagaatggggtctcatgggctctgattgcttctcctgctccttatgacccccagggatggggtgggggtgagcggcagtgctctgattggtcagacttaggtcacctgctcactcctagagctgaaggagtgagagctccccctagaccacggtgcagaatgaaggtagagagtggcagaagaggtggttctttaagggaaattgagggacatgtatgtcagatcaagaaaacacatgtcctctgcagggacgttcaggccatgtagccagttgttgtctttgtttttaaataatttttataaacacctaccctaggctaaccttccaaataagcaaaagtttcagaattgatagttgattgattgattgttttatggcttatgagatgacaactgtttactggatgtgagatgtaatattttgggaggaaaatagtggaaattgagtgactgcgggactcggctaagatgggtagatggggcatgaggagaactggtcctgtgtctgtcaagggatcaatgagtaaggaaaaatgggcttcaaggacaaaaagccaggagaaaagaaaaagaagataccagagattggcaattgaccaaaaatttagcaagattaccattgctgaaatagcagaaatattgtcttggatagaaatgctatcagggacatttaatgagaatttatgaagattcaaggctggcatagctactctaatcatgtgaagagtgattgcatctagaataaagcccagattcccaaacctgacatttgtgatctggggcccatctccctctccaggctcatctcccctgctgctgccttgcaccttacaacgagctgtttgtagtctggaaggcatcacactaccctgtttccttcactattcatgctctctcctctgcctggaatccctctcccgttgaccagactcatcttttaagactcagttcagatgacagtttctctgagaagcattctttgattatgcctctctggcttaagaattcctcttctatactctcgtgataccttgtgcgtctttcccagtggtctcaactgagggctgttttgtctccaaggggacatttggcaatgttgggatacatttttgattgtcatgacaggtgagcgctactagttggtggaagccagggatgctgcttaatatccttcatacagcacacaggacagccccaacaaagaggcacctggccccaaatgtcaatagcaccgctgttgagaaccctgcttaccattgcactggcaacattgttggatacatctgtttttagtcttatcttcaccactaggctgaggcccatgtgtgtgatctgcatctttgtatgtctaataccacaatgcaccactgtagggtagttcctcaggagagaatagtttaaagatgattgtatacattttcttaggatagtgaccaatgaacaaggcaactggaggccgtactcgtctttgcgctaggtagccttaaacttgaggctctctgtattagttagttctcacattgctatgaagaaatacctgaaactgggtaatttataaagacaagaggtttaactggctcatgattccacaggctgtataggaggcatggttctggtatccgctcagcttctggggaggtctcaggaaacttacaaacatgatggaaggcaaagggggagtgagcacttcatatagccagggcaggaagaaagggagtggggaggtgctacatacttttaaacaacaagatcttgtgagaactctattatcggaatagcaccacggggcgggggggcgggtaatctgcccccatgatccaatcacttctcaccaggccccacctccaacattggggattacaattcgacatgagatttgggtggagacacagatccaaaccatatcactcctttatcttgccatgcctttgtcttctcactcttctgcaaaaagagctttggggtttactgtagcaaataatggaaaacattaaagaagtattgttagcatagttcttttgctttcaatttttacctaagttattgtccaattttacattctgaatggtgaactgggtggcctggccacactatttggctgcctctggcaaaaacttctgccctcacttctgaccattacattttccccctaccgtatgtgtagtactctggattggtaacgtttgatgggaaagaaaacaaaatcagaaagcaacgattctgagagcaggaataaggaatgttaagtcccctttttgacggctgggctttttttcttatgccaagtttaagtgcaaagcagcagttcccttgtgccctgggacttttgcctaggaacaagggactgccagaaaacctcagaaaatccccatggagatgtctctgaaaaccatgtaaacagggacattgtctaagtgggtcatcctgaatatatgatgcaggatggaaacctatttagttattgaatatttcagattaagaggacaccgcagccttgctttgcacaatcttgctagctttgtgagtttcactggggattggaggggaggcccgccttcaacttgagctgcttgtgttttggttggtggtaatgccttagaaacagaaaggagccagctccccttcagccactcaggcttctgcctgggtttccttttaaccctggaatttcatgtggaccctcagctatgaaaacagatcacatatggcctgctgtcaagcataagaattgcctttttgttcttggggaattgcacaaagcaagtaggagacggggaagaagaccgttctaagcaggaaaatatattgcattaattcttcccttccattgcctcctccccatcttgtgctatattctggtactaggacttttgcttttttctaggctgaatcacatttggccatagcagaggaaaagtgatagctgttaggggtcttggaaggagtattgagttcctagagtgggaccatcttggccaggccgcttcttgtcctcttttggggctgggactggtatgatgttgaagtagcccatctctaagtcttcccctcctccctgccagcttaattgtgcaacattgttcaatcaagtcactgaatcatcagccctgtgatatctacaagcgcatgcatgtgtctgagtgaagtgagctgggcagttccatgatacccttttctatgtatggagggtgaggtgtttctccttggtttaccctgaccaatttattattactgttccaaaaaggaaactgcatgattaatgtcagaatcaggtccaaaggcctctggctctggtgatggctaatgtgatttggatctagattctgtttaataacctgccaaaggcacctagctctttctctttttttgctgttttttgtttgttttgatttttgtctttataagacagggtcttgctctgttgcccaggttggagtacagtagcaggttcatatgtcactgtagcttcaacctcctgggctcaagcgatccttccatctcagcctcccaagtagctgggactacaggaatgcaccattatgcctgaatttatttatttatttatttattaagatgggggtcttcccatgtttcccaggctggtcttaaactcctaggctcaagtgatcttcccacctcagcctcccaaaatgttgggatgacaggcatgagccatcacgcctggccttggctctttcttctgtccccttggtggggacgttggggtgacccatatgtggtacatggcaggtaatgttcttttcatactagccagtcttctgttgtgattccactgtgtgtaagatgtgtccaaaatgaggagatgcatccccgcacctagaggtgtacagtctagtggtctttctgctcttcctgcttttttctgggaaagagactttttgtggggggttgggggggggtgagtccaggacagcaagttcatcataaatgcaaatgggaaggctattgatatttttattcatagcatgaatgatgtaataaatgagtcacgatgtcagcctcttttaacagaatcacagaattttctttttatttatttatttatttatttatttatttattattttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaccagcatgctgccttcaagcgtctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacctctttctacacagacatggcaaccatccgatttctcaatcttttccccacctttcccccctttctattccacaaaactgccattgtcatcatggcccgttctcaatgagctgttgggtacacctcccagacggggtggtggccgggcagagacgctcctcacatcccggacggggcgacagggcagaggcgctccccacatctcaggcgatgggtggccgggcagagacgctcctcacttcctagatgggatggcggccgggaagaggcgctcctcacttcctagatgggatggcggctgggcagagatgctcctcactttccagactgggcagccaggcagaggggctcctcacatcccagacgatgggcggccaggcagagacgctcctcacttcccagacggggtggcggccgggcagaggctgcaatctcggcactttgggaggccaaggcaggctgctgggaggtggatgttgtagcgagctgagatcatgccactgcactccagcctgggcaccattgagcactgagtgaaggagactccgtctgcaatcccggcacctcgggaggccaaggctggcggatcactcgtggtaaggagctggagaccagcccggccaacacagcgaaaccccgtctccacccaaaaaatacgaaaaccagtcaggcgtggcggcgcgtgcctgcaatcgcaggcactcggcaggctgaggcaggagaatcaggcagggaggttgcagtgagccgagatggcagcagtacagtccagcttcggctcggcatcagagggagacagtggaaagaggggagaggggagaggggagagggaatcacagaattttcaaactggtttagcatgctggctctgcagccagactgcctgagctcaaatgtcagttgacttttctgtaaaatgggataataatagtaccagtttcatagatttgcaggagatgtgagattacatgaattcacttataaaaagtgcgtgatacttaaagccatgttacctttaaacttccaatccattcattcatttattcaacaaaaactacatactgtgatggttgcacaagcctgtgaaaatactgaaaactaatgtattgtatactttaaaagggtgaattcaatggtatgtaaattaagtatatctcaatgaagctgttttaaaaaaattaattgattacctattatgtgctggacacagctcttttaaactgaggcctagagcaggtgacttgctcaaggtgagtgaatggcagagatagttctagaactcaagtcctctgacacatcagccaagctctttgcaaactgtcagggatccaaatgaagatcgcaatccagattggaaactaaagtcactttctgtcctggtatagaaccaaagtttaacttaagaaagaatcgtgacgtgacctaaggaccttggcattctacttcaccacctctctctgcaggtattctcatttccacgcacctccacattttcgaagacttcagacaaatatatcacaaataacctatataaattcactatatgaaaagcaggccaacatttccaccccatccttcctctttcccccagctctggatataaaacacatatttttcagttagattttttcagttaagtgattactttcaattcccctgtttttggcatttaaaaatgttcacttcttattgcaagacagggacagtctttaaagatttttctgctcaccaccactaccaaaaactaataacaaattttgtcttcatggggaagaaaatcttactcattcttgagatttcacagccatgtctaaagatctaggctatataagaagagaggaatgccttagaaatgtaatgctgtttttcctacggaatcaatttctgtagaaatagaaaccatggtgcatccagagttaccctgcagccttctgctcctggcagcttgctgtgtgttctctgccacatgctttcttctgggatttcttccttctactgacatctggtacttaggataagggaaaaggctttccctgaaccagtgaaattgctatcaggaaaaaatgactcaagtttccaggcagctatgaatgaggtgtttttctgggcggtctgagcaactatcttttggaaggatacataagaaggtacaagctgccagcccatccatttccctaagatgaacttgaagcacgttttctttcagcagcccagacagcacaggcttttcctagcagatgggtggcattacctcactgacatttaatgaataggttgcccccagggggtggaattgtagcaaagtctattatgaaatctcatttgctttgcatgaatcagtttaggagtcccgagaaaacaaaatttgaaaaatgaaaagtggccacatagcttgccctgtaactgcttggacatggcaggtaataatcatagtcagtttgcgcttttatgatggagagggctttcaattgatttgtatttcttgtgagtaggaacaaagccagttgtaagtaccttttagctttgttccctcctttctcattttctaggactgtagcatctggggcatataattgagctctgagagccgagagctggagggggagggggtggtcagaggaaaattattcaattcacacatataacatgcatatatatatgtgtgtgtgtgtcttaaacatatatgcatatgtatgtgtgtctatatatatatatatatatatatatatatagaaacataaatattttatcaagttgagaatgggagaatagatttctttcagcaaacaacctcaagcctattatacatctgatttatgaagggtaagaaattcaaccttaacccaagcaaaggtttaaaaaggcagcatgggtattattgggcttaggaaaaggtgaaggctgccttgctgccgtcctggaagattgagacagtggtaacaacacgtgcagcaaccccctgcacttctagaaggaagctgatatctgtctacatgtttcagcgtttgtctctgaacctagtcttttcttggtcacataggggaagcaacagaggtggcttatcatagcaatgcaaaagcctttaatgaaaaatgggctcaggttttggttcctataagatggtgattcccttcccccacaaaggcctttgtgtacatggggtgaggtaggggtctgagaaaggccactggaaatggaaggcttaacggccagtcctctgctatgtcccagatggaaagctccttgtatctaagaaaggcaggaaaccatgtcacctggcttctgatatgtaacaaccccaaattattctccgaccccttgaaggccagctgggctcttttgcatcagggggattgtgtttagaatttgtgtcaactgtctttgtagagatccttctggataactactacaattcctgggatattcttacagtgggcacatgacaaagacatgtgacattggcccaaacccccctcaacttggaaaaggggtggattcccccagctgacttgaagattctggtctgtggattcagcaagagtctgaggcctctgctgagtgagccaagggtggcttccggggaggtgagtgcctggaggagaatgttcccagagccaagatgggatgcctcctggtatcaaagtgatgttcagattttttctggaaatctagaataggataaatgtgaatagagattagagtgaacatcttctaggatttgaagcccttgagagcttctaggatttgaagctcttggtcttgagaccaagcctctgcaatgcatctggggtccgttgcacaagtgtgtgtctttttaccaggtcttatccccgcttcagccttttctctcctgttagggatcaaaacttgccaaaacagaaattttaaaaagacacgcaggatgtggggctgctcctgggaggtttgctgtgtgtgtttggggtcctgcaccctccactccactcctgagtgtccaagggtggatgtccagaaatttagccacctactcccatcagtgtagccagaacctttgctgggagttaatctctctccctcattactttctgatctgcttgaaagacaaatagaggttagggaaatatattaatatcagtaagtctccatggatggcccaggtcaaggcagacaaaggtagtcacacgctttcaggggctgaaagacaagtagaggttagggaaatgtatcagcgcatctccatggataacccaggccaaggcagacaaagaaagccacgtgctttcaggtgcaaacagcggccgccttttttcactggacatcattgggcagctgttgctgtcatttcccacggcctctctggaggggaaacacagctggcttctgtgggccagcctgaaaccatctgcagctgcttgcatgctttcaaatgtaagtaagggaatttcagctgaggttaatctgggaaatcctctgtatgaaacattttccttttcactgttccctttccttttggatataacatatgacccacttacgaggcagcctgttggatcactggtccccaaggagctgtggatgtcttcccagattactcctgccaccaccaatgcgtctaccaccatgagagctgctgctgatgggcactgcactgtgcatgttgcatatgtgatctcatttagcactgtgacactccaaggaccacactcttgtctcattttcggataaggaagctgaggctccaagaggtccagcagcttgtcttaacagtgaacaggtgcaaaaccaagatttgaaaccagtttttgatcttggtttgatcttgatgccacatcccagcctctttctacctctgtaggacggctttgtgtctcctctgcattttcagcctccattgctaatctgacaccatctaaagcaggaatatccttattaatggaatagtgcttaatgggattaggcttacttctgtattctagacaatatttactgagctgttagatgtaatgtgttcagaaataatacagggatttatgaatatgtattaaatattagagtataaactttatcaagcagagaatatatttgtcctccagtgttgttgaccttgtatgttttttgtttgtgttacctccagagctggattttgaaagattaagccaagaaaaaaagatgagacattcaaaagtaaataaattagtttaggcctggcttttctggggccatggagttgttatcccaaagtccttgcttggacctctcctcctctccactcctcccctcccctcccctccccattgggcactgccagggcccagtacaagtgaaacagatgctcaactcctagacttgtggaggcttaggtagaccagcaagtcactattaggacagaaaaacaagaccacgtcattccccagcccaatcccttatgctttctttcaatgacacttaaaatttaagacccaaacctacatgatctggccccatctgccttttcagactcttcttcctcctcgagccccttaccccatcctagccaccgaagccagtgatgccacatcccagcctctttctgcctctgcaggacagttttgtgtgtgctctgcattttcagcttcaattgctaattgtcctctcttgtcctcacttctttcactcccatctcagggtttctgcatgctggttctcctgcctggaacagccttctacccaccctttgtgacttagttcacttcccagatttcagagggcagctcagctttcccttcctcatggaaacctcccctgacctccctgagtagcccaaactctcctattgtaggcactctcagagcgcttctcatagatgcaattttacgtttgttcgtaattctgttttgttttttcacaacaataaattttgagagggcagctctatgcctagtctccaccctgtgtccccgatgcccagcacagtgcctgaagcacagtaggtattcagttgccttggtgaatgaatgaataaagccaagccaagcacagtactcagatctcaagctcatagtcactgcatagcttgtgctaaccttgcagcaagtgagacactaagcaagtgaacagcttacatttcttagtggtggtgttaaatttacaaggagagcatgtcacctctcacttcaagtttccacacttttaggccattcttagtgttaatagcctgtggaggactctttgaggagagaagaggggaattccaaagattcagcttgataaatccttcatctttgacctcatgtgtattctacttaggaattaaaacgtagagtatggctgctgctacaaatcttctttgcagtttttcctctggctgatttttctactttacctggaatttttatcctgaatttttgtccttttttgaatccatgtggcacacatacattgccctaccaggtttatttgtgtttgagatttgagatgctatctgaggccaagacctccagaattagatgggcctttgttcccagagcctctttgaacagagagaaattctttgctatgttggcaaaagatccttcatatctatctgtctttctttcttgttcagacttctcttttggccacgtgaacgtggatccacctgccccgtcttctggcctatgctgtgatccctggaacatttcaggtttgagtgtcagccacatcttctttaggaccagtcaagggtttgcctccaggaacagtggaatctattgagtgccccccagggagttccccatatgctggtttgtttgtcacttggccacacagttctactttttcctctttgtctgcaactgaacagcctaggaaacttacaagatttctgcttttttttgggggggcgggggggtaaggtatcgtattttgagttcaatctggtcgcaaactggattctgtccagatttttgttgggatttcagatgtttagccccaaacaaattgaaagttaaattgaaactggtccagatgaggtcatgcttaagatttctcccacagcacaaatcgtaccttactggaagctactgtaagggcagttcttgaatctctgcattcccaatacatactcatggtaaaaacagttaacagttaattcgcttgtgttccagtgacttgaaaaataagcattagcaccctggagacctcgtcttatcaagttctgaaggatggtttttatagctagtataaacccttagtttatcagcttcactggcctagaaacccctcagacctgaatatttgggatcagcagaatgggccaagcttaggaattccaagaaggcagactcaagatagagggctgccaaagctcacagatgtggaatgaaaccagtttcaaaacctgattcttcgctcagttggaatgtgttttaaaacctggactcacttgagatgtttgcacctggtaagaatgtttcaaaccttgaattctactttgtgtaattatctgtgaaacgtaatgatgatagctccaagctatctcataaagctgctgaagtcttcaaagcattcattctatcttcctggagttacagaaacacaaaatggtaacaggtgtgtcatatgcatccagagactacctcgaacttttctctctagaactcaagctccagacttgagatattagttaatagattgataaattgactcaggttaagtggtattatttcttagattatatagtgtcatcctacagagtaaccccattttacaggagaaacaaagttggccagaggacgaggctagaacccctttctagactgttaattcaggcagagctctgtatatgttttaatggttagttttctaaagagttttacctagaggccaaataaatcagaagctcaaacgcatatgttctctgtcttctttttagactggcttgcaagaaagcccttgggttactttttgccagaaaagagcatgcagagtgaacttgtgacataatacattccttgaagctcccacgttatagtttcctggtaacatagagttgtttatattattgctacttaaaacttggttgctttgtagatcctacttgggaattgaattaacttcagtgaacttgatagaagctgcatctttctgtaaagttttgggcaggttttgtcactgacattaggtggtgatgattttaaaggactcccattacttatccaacatgtgcacgcatactgtatatatgtcattagaaataattaggagttaattttcaataaggtccatttggtggctacaaattaatccatttaaaacccctgatatttgaccctattaattatatcctgctgttcattggtgcttaacccacagagctaatgagatgcctaagtaccactatttttcattgctctttactgtagggaagtaggtctctctttttctttttaatgtgagtggacataaaatttatcagcaggcatatccacagaaaactgactttattacaagtatccttttagacttgcaagctccctcagctagttaattttgcgtttaagtctatgtgattttcattctaatgtcttttggaattaaatgtaatgttgtaagaaaagaagcgtctgaccaataaagcaaggcagtctaggctgttttatatatatatacgcactttatcctgtctaatgtagtgctcctattttctttttcatattctttctgttagagccaaattcactactctgactttgcataatataaatacagatatccttactcattaagaggctgtgttgttttagaaattagtaagtggctacatctgcataattttgcattggtaagagttggcttctttagcgaacatgattttgtatttttggagaggaaaaccttgggcccatcaggttagccttttctgagatggagactcaagtgggaccacccaggatggtcacagcttcaactcccacacaatgagaacttgtgactatagcctgggagagctgactatgcaggagacaagaaatcagagagttgggtccagaggtagctggcagaaagaagattctattaatattttaacctcagaagagcagcgtctaaatatgtgaaatgagtgctggcctagaggggaagggccatactcttaaccacctcaagctggtcttatcattgttgctgggggggatgtgtaaggctacaaccttcccttttaggtagagggaagagaggactcccttgtgggtgtgcacaaaggagtatgatgagaagagggtggtgatgggtgcttagcttgatgcttacattgtcccagtgcagctccatgattgcaggtaccttgagaggacccatgtgcagtaaggtgggaggttaggaaaagcagagaatgccagccagccatgagtggatttgagaggtctgaaggacaaaggcaatgttgctttgtatgggtgcacaaggggatatgtgcatttaaatccgtcaacagtccagaaattggattgccatttcagttcccaaacaaatggcttgtttattaaactaaaagcccctatctccattaggaaatattcaattccagcaattagccccagggtgaaagaggtctccctctctccagtctgtttttgctctgttcccaaacaatgctttgatgtgcaaggcactcctaatggaagataagtcatcaattagcccgatggaaggttaagctgaaaacagacttttcagggaagggattatcactgagctgttaatcactgattgacattatctattggggatatattcttatgggagacttactctccacccaggcagaaggtaacaaagatgcaaaaatattctagttgtttggtttttttaaaaaatgagttttagtgtcctatagcaccatagaataactgtagttaacaataatatacagtttcaaatagctggaagatgggcactgaatgttccccacacaaagaaatggcaaatgttcaagatgatgaatatgttaattgccctgatctgatcagtatgcattgtatgtacggaaacatcactatgtaccccataaatatgtacaagtaatatataataagtaaattttagaaataagagaaaagaaaaaatgtgagtttagaaataggatcttagatcaattgagtcggggtggagatgataatagttttctttctaaacaagtatcttttactttctttaagaattgttggtcataatatgattacattgctaatttatgaaataaaaagtaaggagaacctctaatttttttttagagtggggagacagtgtctcactctgttgcccaggcaggagtgcagttgtgccatctcagctcactgcaacttcctcctcccgggttcaagcgattctcctgcctcagcctcccgagtagctgggactgcaggtgtctgccaccatgcccagctaatttttgtatttttagtagagacgaggtttcaccatgttagccaggctggtcttgaactcctggcctcaggcaatctgcttgcctcggcctcccaaagtgctaaggattacaagcatgagccaccatgccctaccagaacctctatttttataagagtaagttgatatgaacaatattgtgaatgtaagcacagtgcacatgaggcaaatttgtaattctgtgcttgagttttacaagtgaaataagtttattttttaaactccaagtagtggcagatgagtgttaatttacctacaacttttcaggaaaatatcaattgcatacattaagctattttgctgttattttttttttttgctttgtgccttttgtttttctttttttcttttttttttttttgagatggagttttgctcttgtctcccaggctggagtgcaatggcgcaatcttggctcactgcaacctctgcctcccgggttcaagtgattctgtctcatcctcctgagtagctgggattaaggtgcctgccaccacgcccagctaatttttgtattttttagtagagacaggttttcaccatgttggccaggctggtcctgaactcctgacctcaggtgatccacctgcctcggtctcccaaagtgctgggattacaggcgtgagccaccccgcctggctgccttttgtttttctagtacgctgatgagaccaaaaagaagatataataaaattaattgccaaaaatttagaaaatggaatagggtagttattctactaccctaatataatcaataactattgtactgcctaccactcttttttctcctgtttgctacaggggtgcaatccatttacctagattctgtttcctaattagcctcatagaatgtttcaaaaatcgtgacccatatagcttaatgagtacagagtttctgtctaaggggtgatgaaaaaatcttcaaaatagtggtaatggttacacaacattgtgaatataattaatgccactgcattgtacacttaaaatggttaaaatggcaaaatttaagttatatattgcacgacaataaaagaaagtgtatcaaaattatgcccctgcatttaaaaaaaaatttttttttggtagggggaagtaaaggattgacagatttcagagtctgtggtgctaggagaaaattttagggtggagttattctccatggggctcaaaacccaaaacttttcaatactattgaatattagcaataataagcttgtaattcaaagcagcagggtggtacgttgttaaaacttcagaaaccggtccggcgcggtggctcatgcctgtaatcccagcactttgggaggccgaggcaggtggatcacctgaggtcaggagttcgagaccaaccttaccgacatggagaaaccctgtctctactgaaaatagaaaattagctgggcatggtggcacatacctgtaatcccagctagtcagaaggctgaggcaggagaattgcttgaacccgggaagtggaggttgcggtgagccgagatctcgccattgtactccagcctgggcaacaagagggaatctttgtctccaaaaaaaaaaaaaaaaaaccagaaagaaagaaacatttaaaaaaaaaaaaaagaaaaacttcagaagccttctgaggttcagaggtcatgtttcggaggtcatgtttcagggtgcggtatttggagccctcccggaaacacaaaagcctccctggtgacattcttagcccctaggaagggcagtaatgacagcccacaactgacaagtactgatgaatagttcttgaaggcaaaccctgccctcagggagctctgccatagcttgacatgtcttctagaactacgtgcaaggggtcgcagagcagctaattctgccgcggtatgggcagtcaccaggaaacttcaagggggagcaggtttaacctgaatccttgctgaaaatagatgaatttgcctgggagtgagagaggaaagggcatgcctatgtggaggtaccagcaaggggacagatacaggaaaagggtgccaggccccttaattccaggtttaggagtttcttttaaaaaaaaagttcagtctcaaaaaactaaaaatagaagtaccatatgacctagcaatcccacttctgggtatagatccaaaggaaatgagatcagtatgttggagagagggactggctggaggggagggggattggggagatattggtcaatggatataaaatttcaattatgcagcaggactaaattcaagagctctattgtacaacatggtgactatagttaataatgatgtattatatattgtacttgaaagttgctaagagggtagattttaagtgttctcctcacacatatgtgaggtaacatatagtaattagcttgatttagtcattccacaaagcatatgtatttcaaaatatcaagttgcataccataaatgtatacacttcttttttcttaatcagaataaataaatagtccgagggacatttattgagggcctagttgttgggcagcatcttaggcttcttttggtttctaaatggtgccctagtcagggcttggtgagtttcagatccccagaaaaagtctgttcttagctttgatgggggaaggaagacccagagcaaaccacagtggcactgctgatctagagcaccctttagggtggctgggggtcagattacagactggaccacactcctaactttctttacccctgagacctctggagtcctagatgtggacgtggtgtttatggtgcattcatgtttctgaactcttttttttttttttttttttttttgagatggagtctcactatcatccaacctggagtgcagtggtacgatcttggctcactgcaacctctgcctcccgggttcaagcgattctcctgcctcagcctcctgagtagctgggattacaggcacctgccaccatccctggctaatttttgtatttttagtagagtcagggtttcacaatgttggcaaggctagtctcaaactcccgccctcaaatgatccacctgccccagcctcccaaagtgctgggattacaggcgtgagccaccatgcctggcctatgctcctgaattcttaaatactccaaatgatgcgatccaggcttacaagagaggaaggagagttagatctatgaatctaattaggctaaatgttttaaacagctcttctctcaggatattgtttttgttcatatcccaattctgaaattcattagccttatagaaatttattaagcctgaattacagagtgaaatcaagaagcatttttttttccttttttcttttctttctttcttctttttttttttttttttttttttgagacggagtcttgctctgtcacccaggctggagtacagtggcaagattacggctcactgcagtctcaatggctcaggctccagtgatcctctgacctcagcctcgtgaatagctggggtcacaggcatgcaccaccaaacccgggtatttcttttaattatttgtagagatggggtctcattacgttgcctaggctggtcttgagctcctggcctcaagtaatcctcctgctttggcctcccaaagtgctggaaatataggcataagccactacacctggcctcaagaagtaatttttaaataatatttttcataagaagttgagccatgttactgaaatgatgacatgctgaatggtgcattgcagcattgcatagtgaaattgaggggacttgactaagttgggagctggcaaaccccttgccaccaccacagcctttgcagataaagtctttgccttgctttcccatcccctaacggcaaaatgaattgctaagatgagaaaaaggaattttgcaccatctgcaccaattctgaggttttgcaagtgatcaccaatgtggagagtatggttcagggctacatgtttatttttatttttatttttatttttattttgcatccagcgtgctcagaaaaactaaaggaaaaaaaatggaaggatgaacattttaaaatacaacaaagctgcatcatcctccagtcaacgttttggttccagctgccttctagcattgcacagcttgagatgtttgttgcttgtgttcctgcagcattgaagcccccactcccacacccagcccctgtcatttcctgttttcagatccccaccttctgccctgcatgttggggaggggtccatggccagaacggaatggcagctctctgctattgtaggatccctgctgttgtgctcgaacctgtatataagacaaacagtcattcttgggagtggccagacattatctagagaattccaaccactcagctgaagagaaagtcactcacctggagtatttagagaactccaggcatctttaagcaggtacaggtgggagacacagcccttgaagattaccatccgagatacagctaagagctcaaagtgaattcttagattcagtgagccatgacacatcatgtgttttggaagagcaaaaaggatgtcaagatgtgcttctttatagtgggctttggagagctggacaggccagggcttggctctcaactgtgcccctccttgttttgtgtctttgggcaaattacttaagctctgagcttcaatgtgttcatccacaaaatacggattagccctatttcacagagttgccatgaggatttattgagataatgtatgtaaatgtctacacattgtaggtattcaattaataattgttaccatcatcatccatatcatctatatttcctgtcaaggaaactggcataccagctaagccagcaagcacatgcaaatagttctaggacccatttagagtatatgataaagtagaaaaagaatcttgaagccggtcttccttgttaagtttctagtcgagattgtcccagtttccacctttgtatctacaagaggcaagatagtggttaaaggccctgagacagattttcctccagttcaatcccagctttagcacttatggctggagcccttgggcaagtcacttaaaactctctgaaccttggtttcctgatatgtaaactacagctatcaagagtactgacctcctacgcttgttttgaggaataaatgtaattatgcataaaaatcgcatggtctaatgcccagcatatcataaatgctcaacaaaggttatgagcacctcatcatcaactaaagttgctaatgcctttgaggactctcgggctctttgttccttctccagtttgacagggtacattaccattgccagctctgtgacaggctttgtaacctggcttctgtgtacaacagcatacatgtatgcttctgctccagctgggcagtcgataagcctgcagcctttgctggttgatatgcccttattccacaggtattctttgctgtttctgttttatctacaggtttttatttttgttgttgttgtttgtctttttgtttttgtttttgtttttttcttttttttttttttgagatggaatctcactctgtcaccaggctggagtgcagtggtgcgatctcagctcactgcaacctccacctcccaggttcaagagattctcctgattcagcctcccgggtagctggaactacaggcgtgcaccaccatgcccagctaatttttgtaattttagtagagatggggtttcaccatgttgaccaggatggtctcgatttcttgaccttgtggaccttgtgatctgcccaacttggcctcccaaagtgagccactgcacctggactttttttttttttagacagagttttgctcttgttgcccaggctggagtgtagtggcacaatctcggctcactgcaacttctgcctcccggattcaagcaattctcctgcctcagcctcccaagtagctgggagtatgggattacaggcgcctgccaccacaacaggctaattttttgtatttttagtagagatgggttttcatcatgttggccaggctggtctcgaacttctgacctcaggtgatccacctgcctcggcctcccaaagtgctgggattacagacgtgagccaccatacccggccctgtctacaagttttaaaaagcatgaatatgttggggcaacccacctctgagaaggctcgaaaaatgctataattagcctgtggccagagtagagggcaacagtgaactacctggcattgaagtcctaccatgttcccattgtggggccagctgccttcacattctgtcctcttggaaatcctcataacagcctcagaaggtaggtgtattgatttcctagggcagctataacaaattctcacaaattacgtggttgaaaacaatagcaatttgttctctcacagttcaggagtcctgaagtctgaaattacagatggcagggttggttccttctggaggctttgagggagaatccgttccatgcctttctcctagcttctcgtggttgctagcaatgtgtaacatttcttgacttgtaaatgaatcattccaaattctgcctccagattcacatggagtttcctctgtgtgtatatctgcatgccctctctttcccttataaagacaccagtcactggatttggggcccactctcacccagtatgatctcatcttaacaaattatatccgcaaagatcctatttccaagtgttacattctgaggttccgggtggacatgaattttggggcggggcactatttgactcacttcagtacttattatacccatttaacagatgatgacccagagtctcagggaggagaaaatcccttgcataagcatcacacaatcagtttatgatacccaaggattcacaaaccctgacctgcttttctctagatttgtgtacttcccaccgtatcactttaccacatataaacaaacgtagaacaaagagtctaaaacctatggcagcaaaacggtcaacagcaggcagccctgggatcaaagagggtctctggagggtaaacaggatgaagcagaggctttgcaagcaaatggcgatcccttccttgtttctggttctcagacttcatcctgtttccataatcagtattacttattggctctcaaccatccggctgtgctcctgggattccacagtcgggcagagagattcttcataaatgagagaaggtagtagtcggtttcgtttgcattaagagaaggagcacatttctttgcacaaagtaaaataccctcccacgactccccactgctccccgtatccctgctggcttatgcttatcatgcatcccagtggtgaatggagaaattccatgctttccttctcctgcagaggttccttcctggcattcagagccgtaaaagcagtggacggaaacagctgaccagccctcagctgctcccagagtctggctgcctaaacttttcccagaggatggtccagcagtgctggtccagggtgggcttgggagagcagagctataggcaagagaggtgtgaatccatgtggtccccctggttctgggtaaaggccagggctggggcagaatcacagtcagaaccagggtcaggtcgtcagtgtcaagggcaaatatctttttctttaaaccacaagtgcacctctggtaccatgctcagaatcccttgtagagagtggcatccgtttgctgcatgagatgggagaaaaattagcggccctggctcgagtcttcattgccccttggctgcctgccgtgtcctatttctcatcaggccagtgtccccagtgcctgtcctgatccagaattaccacttaaccctagtggagcaggactctcagactgaccatctggactttcctcgagttctcttttcctgccagagtgtgtcagagtgaattggattagagttctgtttgctgcacagcctggcttcacatgaggctttgtgcttttgaagaaacttgagacaagactattcatgagttcccagagtgggtggcaattcacagtgatgctgatatccacgatcgtgggggtggttctgtgcagggatctctaaaccttttagaaccttccaccagtttccctgcaatcaataggtagctgattccatcagatcaaaccattttcctgttggaaagtggtaggtccttttgttaagtgttcttagaactcaccaatgatttcatcgaaaaagcatctctgatggtttttctttctcctctggcattgtgaacattgtcttggagaagtgaaggtttgccatgtaacacctgcctttgagcagggaagaacatggtgggtaaatctacgagagagacctgttctgttccctggactcagctcccatagagtccaccactgaccttagaccctcaggctccaccggatggataggaattgagtaacagaagggtaggaatcccatacataatcagtatggaatttgggattgcctaagtgcagagttacattctgttccaagccccagcattcactttaaacattaataagagatatggtgctttttgcctatggaagactagattgaacaaacccaaaatattatttttaaaactactcaaaattttaaaatactaaaagaaaaaatgggactcaaatttaatgagcccgtgtgtgcgtgtgtgtgtgcgtgtgtgtgtgtgcgcatgtgtgtgcgtgtgcgtgtgcgcgtgcacgcgcaccttgtaggtaggtgaggagattactagattgactctcctgtacatttaagttaaatggaacaaaaaaaaatgactattgcttagaataatggataagccggcctcctattttttgttctctacttgactgatcagtccttgggaaattcttcaatgggattttcctatgacatattctgtctgtgacatagttcatgaaattctacgacatttgattcccaagggggaatctggttactcacagcgtgtttcacaacttttctgggaacaggcagctcttggaaggaaaatgtctatgtatagcagtgagccaataactcatcttcagtgaaaacggaaggtgatattgtcatacagctgtgtagagtgagagtactcctaaacagataataaattacagccagaaagcaaaacctcctcaagagatggccaagttttggtacacatttgttcactgtggctctatgaaagacctcactttttaatatgtggatggaaaatggagatcagaggtgctgtaaaacctaacaagtagatgagccctggccgtttaaaagtctaaatgtatttaaagcttgaatttgtaactttttaatttatgtatgatactctcaatccttgcttttccaattacaatactaatacatgctcagtcatatgcatctttgtttgtttttgttttgtttttgtttcttgtttgtttgccttttgagacagggtctcattctgttgcccagactggagtgcagtgatgtgatcacagctcactgcagcctcaacctcccaggctcatgtgttcctccggcctcagcctcccaagtagctgggactataggttcatgccaccatgcccggttcattttttaaaattattttttgtagagatggggtcccactatgttgcccaggctggtctcgaactcctgggctcaagttatcttcccacctcagcctccccaagtgctgggattacagacacgagccactgtaccctgccaataatccacatctctatgaaataaaaaccatggactccacttcagcttttcatcacccctttagcactgagtttccccattcctattctccagggttaaccactgtctttgtctaatttctgctgctgaaagagtatacctgagtctgagtaatttataaagaatagagatttggttcttacatttctggaggctgtctcatcccatagaagaaggtcagagggcaaaagagcatacagcctgtgagagacaagagagagccagtcttactttgataatgaatccattcctgggttgaccattcgtgaggtcagagccctcatgaccttatcgcctcttcaaggtcccatctctcaacactgttgtatttgggattaagtttccaacacatgaatttttgggagacacattgaaaccacagcagccacagataagctatatatatatagagagagagagagagagaactatagagagagggcaaactatgtatatagaataaagtgtatatatatagtgtaagatacatatatatatatatgtcgttttgtgtgtgtgtgtgtgtgtgtgtgtgtgtgtgtgtgtatgtagttctacttccaagaatttctactacagccatggaggcacatgtagaaaatgatctatattcaaggatctccaatgccacaatgtttgcaacaataaaagactagaaataacctaaattaatagggaactgatctttttataaaatggaatatatattatatatatatattccatgtatatatacagaaatatacacacacacacacaaattatatccttattttattatttaatttaattttggtttttgagatggagtcttgcctatcacccaggctggagtgcagtagcacaatctcggctcactgcaacctctacctcccaggttcaagtgattctcctgcctctgcctcctaagtagctgggactacaggagcccaccaccacgcccggctaattttttgtatttttagtagagacaggatttcgcaacgttggccaggctggtctcaagctcctgtccttaagtgatctgctcgcctcggcctcccaaagtgctgggattacaggtatcagccactgctcccagccttcttgacttgtagagagtgaatttatctcctccaggtgcctaatcacccatcaggagtgccatatttccttttagtgctttcccacctgtctctctgtattttttaaatgcttacttccttttttcagaagttaatatatgcacatattctaacattggaaaggtgtagaaaagaacacagtgaatagaagcttacctacacctgatgtccagtgactcccttccccattccagagaaaatctctgtgatcggtttcttatgtgtccttccagggatagcttatgaatatgcaaatatagatacacacatacctacatatatacaaataaaaatatgtacatataagattattcatattcatgtttgttaacatcaaaggtaacgtgctctttataaaatgttccatagcatttattagtagattttgaagattgctacatataaattatcatagagctgggagttcttctgttcttttaaagttgtatgatattccatttaatgaaaacatcaggccaggcacagtggttcacgcctgtaatcccagcactttgggaggccgaagtgggcaaatcatgaggtcaagagatcgagaccatcctggccaacatggtaaaaatccgtctctactaaaaatacaaaaattagctgggtgtggtggtgggcgcctgtaggcccagctgctcgggaggctgaagcaggagatttgcttgaacccgggaggcagaggttgcagtgagtcaagatcatgccactgcactccagcctggtgacagagcgagactccatctcaaaaaaaaaaaaaaaaaaagaaaagaaaaagaagataacagttccctattaatttaggttatttctagtcttttattattgcaaagattgcggcattggagatccttgtgtatagatcattttctacgtgtgcttctatggttgtagtataaattcttggaagtataaccactgggtcaaaagcattgtgtattttaaagtggggtccacgttgccaaattgccatccaactttatggagttggatgagggtacctctctcattacatgctgataactaatatataggtggaaaacttgtagtttttgtgtttcttttttataaatgggattgagagtcattctgtatgtctaagaatagtttatatttctttttgtgaaccgtctatccatatcttttgtctagttttatgtttgggttgttgaccttttttatcgattgcaagggtcctttatattttaacaccatcaagccattataataacgtgagttgtgaatattttcctagtttatttctatttgagccaccattggttgaatcattttaccgtatggcaagccctgtggtgagcatgtcatgttttacaactgctccctaagttagcagtggtattatgccattttacagagaagggccccaggtctgtcggatgccaaagttgattcttaacttgaactctacaccccttttgcacatacctatttatatagcatcatttcaggttgtcatgcaattatgataaatatccttttcacaggttgcatagcattctattagttatacaaatcaaaattttcagatgctgatacttagactacacattttcatcacctataggttttcactgttataaataagattgtgatacatttcttctaaaactctgtcctccccaatgcaacaagatggtgccattgctcctgcaggagatgagataccatgcctgaggcagacagcagagtcatcttttgagtctaagatccttgacaagggaactcaacagattcggggtagaaatggggtgcatgtcaggggatggggacattttattggcctgctagacttctcagtgcctttcccttaaatgtcaccagtagcttcacctggttctggaatgaaatacaacacacattagggcttcagaccctcttctctctgaaagcctgccctttgtttttgagacagagtcttgctctgttgcccaggctggagtgcagtggtgcgatctcggctcactgcaacctctgcctcctggattcaagtgattctcctgccctcagcctcccgagtagctgggattacaggcatgtgccactacacccggctaatttttgtatttttgagtagagacaaggtttcaccatgttggccaggctggtcttgaactcctgacctcaggtgatttgcctggcttggcctcccaaagtgccgggattacaggcataagccactgcgcccgggccaaaagcctgctttttgatcagcaatattggagacagttgtaggaaacactgaaagactgcaggatgcagtggggagggcgaaggccgggagttgacaactatttttttttttataaaatagtatttcaaataatatttctaacaggaataaatgagatcatagtgcatgacatagctgaggggtccatatgtttgtatgttcttgtggattcttctcaaccctctgctctgtagctttctatgccctgagcaccagagaagcattaccaggtctgggtgttctttaagcctttctaaagagagttgctgtttctgtttgccttttctcatcattttccccttaataaattaagggctaagtgtgtcttagtttcccacactttactccaatcagggattcctttgggtaaacaaactcctgtcttaaattgtaagtattcccatctgattcacatgtaagggcaaattgttttaaagacctggctccatgctgagatgtagggtcttttggtgacggggcttggaggaggaacctacctgaaaggtaaggagggagaggacaagactgggcatgtgaggaggaagggcggttgtgaggcccaggcttccttctctgtgtgccttgaattgggccttggagcagcttgaaaagctgccccagcttcgctaagcaccaggaagcagggaggggaaccttcctagtgccaccctttcccctgcacctgctactttgcaattccaggcaatgggctggctcttaactgtgtttgaagccagcctctctaccctgaggacctcattccttcctgaccccttcaaacctgtttttggaactttctgtcacactaaggtgactggtgactgtcacaaatgggaaagttacatttagcagaataaaatccttccgttaaagagataaagttctgacaaggggattgtctacaagctgcgcctccttctaggaactcttaaaatccctctcagcaaaagtatcacctggtttccaaggcagctgctgctcctatcctctcacaggctttcttgagactctgcccactcaaaatgagttcacctttgcccaaagttcatgctaaaagcacagaacttacagagattaggagaagtgaattgtgagggtttatgtacctgggatctcattttaccgaccagaaaactaagacctagaagagaaatgaggccttcccaaagctcctagcagctggcctacgctttcaaagtcgtctcttgctgccttacattacagacacttcttaaggttttttcttttttgatcatggctcactgtagccttgacctcccaggctcaagttcctcctgcctcagcctcccaagtagctgtactataggtgcatgccaccgaacctggctacttttcaaattttgtagagacaaggtctcactacgttgcccaggctggtctcaaactcctggacccaagtgatcgattctcccgcttcagcctcccagcactgggattttacaggtgtgagccactggtcctggccttcagatttttttcttttatttgcattagcccaaacgcttcttgggtctgctccttcctgagctgcctggtgcggcttctatgagcactgctgcattttggggattcatggcttctagccagagctctgttcctaaccagcgggatgaccctagggggtaggtggctgccattggctggggtctgcccctctgcagagtgcatgataatccccactttgccattaatgggaggattaaatagaaggtatagaagggtatgtggcacagacaaggcacacagtaggagcaccatagatattggctgcgtgatgatcataatggtatcaattgtctttaaaccccagtggctagactttcataaattgaagtttacttcccagtcaaccaggaccaagtttcaaaatggcttcttttcccccagggcaaggcaccctcagaaactaacgaaatcaggttacggcaaaacagtgcaaatttattttcagaaaacccaccccaagctcagagtctacacttaaagggtgtagaggtgtgagctgcagctagacgttacctgctggattctactctggtcatttctctccagagactccactgtcatcaagtgtgggatggctctgtttatgcttttgcagcctcagcctagcttgctggtttttcatgtctccctctgcctctgagtataatccacttttctggagtacctaactgtgactttgccatagagtatttatctaacctcaaccctatttttgcagcttgggttgaggggagactcaggcaactgtgtgaatgtgtgtgtttttgtgtgcatgcacaaatacaaatgcatgggtgtgtatgtgtgagtatatagattagtttgttagggttgccatgacaaggtatcacacattggtggggggaggcttaaacaacagaaatttatagtcttacagttgggaggctagaagcacaaaatcctcagcagagttggttcctttggagggctgtgagggaaggatctgttccaggcccctctccttggcttataagtagttgtgttccctctatgcacatctctgtgtctacatttcctcttattctaaagaccctagtcatactggattagggcccaccctggtgacctcacttaaatgtgattacctctgtaaagactgatctccaaataaggtcacattctgaggtccttggtgttaggagttcaacataagaacttgtggagatgactcaagtcaacacacaacagtgtgcctgtgtgtgggtggagcatatgtgtgtttgtgtgtgtagtggactctggcgtctctgagacaccaggtcatttgcaaacctactccttggaaaatagtactttaagagcacatacagttgtctcttgtgaatagggcagatttaaaacctttttctaaaacaaatcttcccatgggtgtggaggggcaggtgtggtaatggagtgggtcccgggtgcccctcttgcatcgctggtcgagggcacttcataatggaaagtccttccctggttcttcattctcaagcagagcaatgccattggcatgtgatttctgcctcattttacttcagatgactaagtagcatcttgaagtgcctttggctacacaacagaacattccaattattccacagggcagcataaattcggagttcccttggagctccctggtgacttgataccaccaagtcagtcattgaggaactccccaatatttctaaataaatttggaaaatgtttttagcatatggaaaatgttgtttagatgctgtaaatagttgtaaagtctacttttagcctccttttcaaaagagccttcctgggctccatctactctgattatcccttccttgactcgtgtgcttgggagggtcccaggaggactgctatgctggctggtgtgcagaccacaggtgaaccctgttgcatctttcagctgctcaccaggacaaactgctctaaaactgaccccaaatgagctggccccacagaaccatgtgtagcgtttgtcatctttcccccagtttactgtaaatctcagttctctttgacctctaaaatcttactgaaaaagtgagtacttcatggtactgaactgacctggaattctgactgactttctagttctgcccgtaagttatgccctaaattttccaggtcaatgtagagttccagggaacgaggtggacggaatctggaggcagagttgagccagtgggtgttatcaggcagggggcactgataaacacgccaactccctgttagacttagtgtagtgctgggggccctattctgaggtgacactgatgtctctactcaaggcaaatgcacatctgttttcttgatggcagaggactgttgttagccatgggatggtgcagccacttcctccagatattccttgaaattagagcactcatctcagacttcagatgcatctgtccactttggcatggactataatgtagccacttaaaacatatcttacaagggccattaaataacataaaaagtgcttgtgaaatgatatgagtaaaaaaaaagttggcacagaattgcatttactgtctggtctcaatgatattaaatatgtatttctgagaagatgacaatggaatgaaataaaatattaactttttttctgattggaggggtaatgaatattttttattttctaaatgttctgtggtgagcatttgttatcacacacagacacacgcacacatgcacataccacatgcatgtacacacgcacaagcacacaccacaggctgtcctgaaaagtctgtctaactggagatttctccagggtctttcagattttttgctgcctcaatacccctgggatatcaattccctgcttgtcccagggcccacctctgaattgccgagaagacagtggtagctgattcacatcaatgctaactgattcacctcaacgccgccagctcctgcctccctgctcagccttgagcgtgacaggagcaggccgggcctgctctggctgggaatgccgctgccctccagctccggccagccagggaggggccaggcctctccgaaggaggttaaagtccttctttgtgtgaatggccttttagggagcagagggagggcccacggtgacatcacagtcttccgtcaggaggctcaggaggaatttgtccagcttgagccagggtgcacgcaggaatctgtctggaaaaaggcagttctcactgaggaggtttgaggcgcgcgctctgggcagggtaagccaagtctgctgacttatcttcgtgtccttttctttctaatttgaaaggacaggggtctttttttgaggccagtgtctttatggaggaggttttctgagtgtgtcatgtgctgtggagtcctttcttgctggagagtaggcagccgagctcagactggtgtcttgcttctctctctcttttttttttttttgcaaatcttgtaaaactctcagcttttgtgctaagaggcaaagaggacgctcagtcctgcacatatagtgcaaagctatatgagtcgtctgtggcagatcacgctttgaagatggtgcaagtgtgtctgtgagaatctgtgtgcccttttccagaacaaaaccaagtgactcggtgattctgtcgcctcgtttcttagccatctagcatttgttcaagagactcagtcttgtggtctacagctagccttctgtttccatgctgtggaactcaccacattcacagggtggcctgggggaatatggttttggggggaatgtgtggtgcttgtctcttggaggtcccatgggtatggaaggagaccctcgccagctttgttcataggcacagaatcatctgtagacagagggttaaccacaaatgcatctggcactgttttctcttttcttggggctctgcctcaatatagtggattctgctggtccacagtggtgtttggcttttgatctctgccatgacctgctcaccaggcgtgaacccaagatctggaactatttttaaaccaagagggacacagcaaatttataaagaactgaaaaactaggcttgcttttgtctttagcagaatcggttaccctagaaatctcaccttgcaggagccagagttccctctgtggccttgagcttggtttattctggggtagggactaccttgcaaaataatctccagtgaaaagggcctttggtgagaagagcctccgagggctccttgatagggcgctcagtatccctcattgaggaaaacatgaaactcacatctctccttattcacgggaaacccggaagcctctcagtcactcctgtaagaagtgggtctccaagtaacggaaagaaacaaccctttcatcagctgctgcagaaaaggcaacagcagcttccttcctttcctcccctccccgctgctgacccccaccacacacactgtcttcagtttctttcacagaaagcccaagctgtaaatatattcatcaaataacaccttaacattttccagatgtgattggagccactgacttttcagcagggctaagaggaggattgttcataggctaagctatggtgctgggggagactccgttctatgagaaattgaccagtctccttcactaggaatgtgggtcaagacacagggaagccttgtttccagtgaaggggtggggagttccagaagtattttcatcccgtcttcagacctgtacctgaggcataagacagagagaatagcagaacagtgattactcttttgaccaataccgtagaagctctcagaaaaaaaggctggacctgcaggagcaggaacaggactcctggcctccaaagggttgagttttctttttagaactgccctagtcacattgagctgtaatggcttcatggcaggagatccatggaggcaaaccaagaagtgtttttagtatctgccccttttaaggcccacagcattgacccgagcctgccgggtccaaatttagcctgcgtttgccccaggagtgcttgaggtctggagtctggccggctgtcttccatcagccaggaggggaggctctagcctctttagggagtggcttagttcccagtttcccacaatcaacacgggcccctagttccacaggccggaagaagctctgctcgggggatggaagaggaaagcctgcacaggactggaatgtggcccaggttatcacccggggcctctcctctcctccacttcccgcttataggctcggcttagaggcccaagtctaaccctcgcagcaagcagttcccagactttcctgctgtcagtgccttcaggggagggtggaacggcccactcggagtcccagctccttctccttcctgtcgtcgttagcagggagggccagaggaggtgcagccagcctgcttagaaactttggtgcaccgcgctttcttcaattctttttgcccggcacagtttgcgccgttgaagagggctggaagtttatttccagctattgctgcagcacttccttctcctagtgctgttcgttcttcttatgggaactggtactcactccctccaagtctgtgagcgtcttgctggggatggcggatcaccttggagctctgaggacctcgcacggcccaggctgagagcatatagctctgcagggtcccaggatatgcttatggatccaaggtagtgttgacctgttcaacttctgttcccttccttatgcttcgggttccctcggtttggggagttagcctcccccagacctcctgactgcagctttgcctggtttgtccaaagctgatgaggttcagctgatgtgggcatcttttaggtttctgggcatcatccaccagccaggtgcacttccttccatcccaccctcaccccttctgcatttgccttcatgctggagacatcctgacttagccagaaagttaaaaatttaggaagaacctctctaaagatagccacacatagctcgtggaaccagttcttcatcatgattgtcattgcgtcctgcgcactgaaaacgtgacttacaaaagagaggcaggatgagaagggaaaacggagatactctctgatttcacagctatgaggaagttttgttttatagccatgcctctgttcctaggccaagagtgagtttatatttttggtggaacttataaataactggattaaaggatcgggtcacctattatctggagaaaagcatttctaatttaaatgtcatggctttagtaggaagtaatctgggttattcaaagcagagaaacctggttgtacagcctgatgtttgagtaatttggttcacactgtgcatttaggctaggagcctaggaggtcgagatgggttaggcacactgtcgagctttaacagcctgaggatggtggggcagaggggaggctgtgaacacagtgaacattgtccttgtggtgaaggacacctttctgctctccgcctgggctcaggcagacctgctaaggaaaatgcacttccttaaagttatttctgtccatgacatgcctagctgtaggcctaggtaccctgggcagaaagaacacatgggtgtctatgcccagtggggcagggatcagggccctgctgttgtgttttctgtgcaaatgtaaacaggcttctagaatctcacttgtggtgttggtgaagagttgcagccttttcccacagtgtccatcataatgacatggacatgggatcttaatattttacctctggcaagtggccagaggaaacagaaccccttcagagaccagcccagagggtgaaatccccagaccgtgcaagaagtcacatttctagctgacacgtagagcaacagatacgtctccagagagttaactctccagggagttcatctatttctgaccaagactgaataaagaaggtaaagggatcatcgacttttaaagctaaattgtgagtctcacatcatctgtagagattcaagcaagcaaaagatcaaccaaaaagccaagctaactctgttttgatccatccactcttcttaccatttcccatgtcattttaaaagcctcctaatattgagactccattttgatgtatcaggatagaatgagaagaacccaccttcaaatcctggctagggcacttactaggcaggtgatcttgggaaacgtccctctatttctctatacctcttattctgaagttttaagactgaaataaaattcatgcctttcccacttaacagagggccatttttcaagcatcagctgacatatgtatgtgcatgtactgtgaaatgataagctattagacatgtgtcaaccagaaaatggggatgccacacttacagcatgcccacaggacaggcttgtcagggctgtctcattcacttgtacatttacttggctagttgagttgtggagatggaccaggttctgttttaaccaatgtgtgacccctcctctgcttcccatgtgactggagccccaggtctgggtggttcttgactgctcattctacttactgcatttcaggacttaacttttaaggacattttgtgaaattactccctctgttgcagcacaactgtatcttcctagtcgtgttcagcttcaactaaaattcacatgtaaggatctggggttggggaaagattagggagattagagctgccatagattctgactttgagtctttcccgggccttttttctttcatcttttcttcttgatttcttttcttctaaaaatctcctgctcttttcccaaaagaaaatcagtctgctgccagaaagaatataatacctgtcatttaaacctcagtgtaaaatggcttaataatagtgaacatttgcattaaccgttttacagtttacatagtacttttaagtacattttctaacttaattctcaaaacagatttgggagatattattagtcctgcttatgaaggagttctgttctcagcagaattccataattacaaaaagtctggtaggacttttataggtagagccaagaaatgaccccagactctggtctttggacgctaaactctgaattaccacatttcctgcattctttaggtggagacataggcacctgtgttgtaaattaagccacgctaatttgctttgcaaaactattaaacactttttggtaaataaaggcgactttagttgcagcctggctaccaggttatgttaaacacaggtctctgggaccaaattctggcactcatacagacttgagttgaataaacatttataaaaaatgctatgaggaaatctcagctccctaaatttctagatgctccaaccccaccttgcctgaagacagatgtggcaactttatgaagacaggattctgttaccattttagtgggtggtaagcaaccgaagtcccctgagccaaaggctagaaacaagatcgtttagttttcaaacctcaaacaccatccctaagggtgtataaaccaaagggttcgctctattggcatatcccctttatgaaagggtgaggaagatctctaatccacaaatttgaacaccaccaatttcacggatttctaacattcattatgctaattgacaggccactaatttcactaatgaaaacctatttctcaccttaattatgccaattagcaaagcttcaggggttcttgggagttaaagggagctaagtactggaggaagccacctgtggggcgtgggatctctcattggatcctagatgaccatcccttgagtttatattcccatttaggatggttgtcagaccctggaatgtaatttaaactaattccagaagcacacagctgtattaaattgccccgatcaagtatgtgaaagtaaatggtaggcatcctaaccagctgttaactattctagaatttagtgggaagggcaggtttctgtgtcgtggtattagggctctacctggagggtgaactgggccgatctaaaaagctcccacagcccctttgcaccttagtttttctctgaccttagaaaacccagtttgatgattctttcatatcctcctgtttttgcattggggcatagttcatttcaaaaaggactttcctggtgattgaatgaatgtgcatcttatctgaatctggaatcacgttcgcctaatttgaagcatggagaaaattctggaccttcttatcttcaaagagagcaataagcatttgttggtttaaacaagacatcatctgatgataccaagcccagattcctgcctaatccggataggttagatttccagcccatttccatttacctggtgtagttgccagtggctttgattctatcaggccatcatgcatgaaggcaaattcttactgctgacagtggaactcaggaattcgctcttttgttatcattgttgtctaactttacaaaacctcaggacctctggtgcatgattgtgaatcagtaattcagagttgtttatctctttaaatacttccatgccaattagaggttaaacctgctgcttcctgagtagatggaattgagtgtcatgaagaattttctgaatttatggggaaagggggactggatgccatatagctcacaagaaggagggcctctttcctgtttacaccctccagtgtctagaggtttaaaaaaatgtatcggaaaggaatcatcccaaattacactggaacccccaaactttgacttttaacaagtaactagcgtgtgtgtgtgtgtgtgtgtgtgtgtgtgtgtgtgtgtgatggagtttcactcttattgaccaggctggagtgccgtggcatgatctcggctcactgcaacttcctcctcccaggttcaagcaattctcctgcctcggcctctcaagcagctgggattacagaggcacctgccaccacgcctggctaattttttgtattttcagtagagatggggtttcaccatgttggccaggctggtgtcgaactcctgacctcacctcaggtgatctgcctgccttagcctcccaaagtgctgggattacaggggtgagccaccgtgcgggcttcttttttttttttctttttgataccaagcctcacttcctcacccaggctggaatgctccaacttctgctctccgggttcaagagattctcttgccaaatagctaggattacaggtgtacaccaccatgcctggccaacttttgtatttttagtggagacagggtttcaccatgttggtcaggctggtctcaaactcctgacctcaagtgatccacccacattggcctcccaaaatgttgggattacaggcgtgagccaccacacccagccttttttgagacagtctcacttcctcacccagactggaatgcagtggcactatcttggctcacagcaacctccgctctccaggttgaagcgattctcatgccaagtagctgggattacaggtgtacaccaaccaccatgcctggctaacttttgtatgtttagtggagaggaggtttcaccatgttgatcaggctgttctcaaactcctgacctcaagtgatccacccaccttggcctctcaaagtgctgggattacaggcatgagctattattgcaccctgccaactaactagcatattttaaaatctcagtttgaccgatcacagaagacataactacttgtaaaataatttctgattcaaagataatggcagttttgtattttttttcaaacaattgcaaaagtatattgtcaaattgttgtcttagattttaaatatttggtaccaaaacaactatttctagttcaaaaagggtgccttggaaagagctgatacaatttttgaatcctaaaaagaaaacgtggaaagtcatctgctcattcatcatcgagcacttgaagtgtgaaacattcaacagaaagggataatgctgatgtgaggagcggaaaagtgttcttgggaaatggctttggagataagccccatcactccttcctctgtgattagcaacaagagacaaagagaagcaatttcttcacttgcctgattcagactaagaaaactctaatatagacttagggctttcttggaagtacagagaactcattttttttttaaagggtgttgtcttctggagcttattgttgctgctaatttcattatgaccctgcagaataacctcccctcatgtttaatgaacggattaattaattaaactatagaactaattatttgccttttagtttcctttactattacgttgcccttcttcctctcctcaggtattctaaagcatcttgtgtttcaggagagcagtgttttctaaccatatttcagtcctaccagcttcctactgatttcccactaccctccgcccaccccggcccccaagccaaaaaggatagaaggagagctctgttgttcccatgcagaatattagcagtgagtcattggccaaaagaagccaggggtgagggtgccataggtaatctgactcatcttagcagtaccgtgaatctctctttgtttgtcttcttatttcaataataattttccatggagtgggctaattttggcctaggtttacttgaaattgaatggcagccagtaagtttcagcattcaaattttgtgtaatgcttaatgatatatgagtagaagttactgacaatgtctcatccaacaaaaagtttagttaatagttttaaaagggctggccatgcagggtggctcatgcctgtaatcccagcactctgggaggccaaggctggactgcttgagtccaggagtttgagaccagcctgggcaacatagcgagactctatctctacaaaaaattttaaaaattagccaggcatggtaatgcccacctgtagtcctaagggagactgaggcaggaggatcccatgagctcaggagttcaaggttgcagtgagctatgatcacatcactgtgctccagcctgggcaacagagcaagagcctgtctcttaaaaaaaaaaaggaaggtggtggcaaaaactactatttaatgatggtcaaaaataaaaaataaagatattagcaattataaatattaattgtgttaagtatcactccttaacaaagaccagacctagactggaagaaaatcagagaatggaagatgttgacaaaagaggaacactcattatttgtgcctgttaatggagaagacatatacattacttgaataatttaagtctgaaaggaaatgtggaaagtgaagagtgaaggaaaccccccagttcatggataactcagagagtttttcaacattctgacagcagtgtagagcacttacgatgaactccagtgttttcttaggtctcaagaacaaatccataattatccacttttttgggaaggattttgaaattaatttcctgagaatcgtcctaaggtggtgttttaatattctaagcatttaaaattgttgaaaccttagataaatgaaaattacactctcttgcaattttgcattgtcctatgtcaataataccaggcacattataaacttgagacagggaaacaaagccaacctaggtgttgtaaggtccttgatggtaactcaaattaagtttatactttactggaattctttgagataagccagagtcctttgatatgaaaaagaaaatcatcttataatttgaaaattaatgtttctaatgccaaataacaaaattacataggctagataactggtagaaaaataagatggatgggttgggtgtggtggctcatgtctgtaatcccagcacttcgggaggctgaggcgggcagattacttgagtacaggagttcaagaccagcctgggagacatggaggaactctgtctctacaaaaaaaaaaaaatatataaatatatatatatatataaatcagccaggggtgatggcacacaccggtagtcccaggaggtagaggttgcaatgagccgagatggcacactgcactccagcctgggccacagagcaaaatcccatctcaaaaaaaaaaaaaaaaaaaaaaaaagccctcaagacaaaaaacctccttccttaaaaaaaaaaaaaaaagaaaaatatgatgggttttaaaacattaagaagatagggttttcttattgaatcacaaactgaagatatcacatataaagcagttaaaaaactggaggagaggtaccattggccattagtttttcaaagcagtgctgacttcttaactaaagagtattattttgatgcaatcccagaaaacagagctgtgcagtcagtggctttggtgatggtgttcataaggcacatggtcaattacagccatggcagtgaggcactgtagcctgtgtgctgccattaaagggatctactgttttccagtattttattctgcaaagattttccaaaaagtttcttgtctccagaataactgcattacatctggcagagagtcatatgttttaaagatctgttcatacaaaaggaccttctttttgcaatcctattaatagtcgtattgcacagcctgcaatcatttgccgcaaaatacttgggaagactctggtacaataatgatgtaatctcttccaccttagtagataaaatttaaaaatggcactagcatgtaaacaaaatggaatccataaattagagaggattgggcacctgttactacaagaaaatgaacatttaagggattattagaaaatatctattcaaaagaatttgtcactgtggtttccattttccttcctcttaattatgagtcagtttgtcagcattcacatccataagagatgcagtatttaaccctgacttttgtttactctttattccagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactgctgtgattctgctgtggatggaacgtacaatggaacatcctccccagagcctggtgcagtggttctggtgggcggcctaagcccccctgtccacgaggcgacccagccagaacccactgaaagaacagctagccggcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagaagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgttggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcagagcatgtttgagccacctcaggtgtcttctcctgttcaagagaaaagggatgtattaccaaagattctgcctgctgaagacagggcgctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcactgccctccagaacatgctacaaaactgctccaggtaagtgaggtgcctcacatgagagacagatgccacagcagtctgttgttgttgattccagctcatgggtttctatgtggagcctcctctgtgtgtgtctggaataagtgttggggggacactggcatgagaattccagcatacagggacatgcaacaaaagtgtcaagagtgtcctctagaagaaccctgagcttgcatggagtttgccactttccagaggatgcaatagctccttctttgttgttctgctttggccttggtttattataaagaattgttctcttttacttgaaagcctgcctcttgtctgaaggagaggctgtttgtggcatagaaccagagtggacccatgtgtggactatgttggaatcagtagcttgaccctcagtatctagttaaacccatctgatttgggagttgtcctctactaactaaccccttctgaatgctggtttccttcccagcaatgatagtcatggcatggcattgcagactggtccatgcaaaatgcttttgttcatcttccgtgtaactgggtttttcttcttaagtcaccacaaagcaactactttggaatcaggagtggacgcatctgttcttgtcatgtgacccatttggaaaagttgaattactcttcacaaaggcaggtctttaatcccttcatattgcctgggtggtcccttttttgaatactttgtatagatggttgatgttaattagagtgctaattattattgctaccatatggataacagtgtgaccagttgtttttattttccatgtgaatgtgatagcaatcagggatccacagatcttcagctatggaaaacgctgctcaaagcgtggtccaagctagtccaggaatcatttgctactggttcattctaagttcagacatcgagagtaagcatttgaaaactcctattgcaatgtgatattgtcctgaaatccaagcgtgggatttttgtattttacaaaactattgcttcataatggactggtggggaaaaactgatgcttcaccagagaaaatttaagaatcgttaccctaaaggataattgttgacacttatcttggtccatccatatcttaatcttatcttgacacttggcttccatcaaacctacaatgactcaaggtcactcttctcattaactttttaaaattggaaagaatctccaacctaaagaaaagttcccaagtacagtacaaatgtctttctgttttgaatcatttgagagtaaattgccaacatgatgccccatcacccccaattttgtagactgctccctaatgtgggtctctgatgttttcatatgatgattttcaggttgtgcatctttggtaggaataccaccaaattgatgctgtgttctcactgtatccaaacaggtagcacgtggtattagtttgtcccattatggtgacaggtgtcaactctgatcacttaatattgattatgatcactccattgagggagtgtctgccagccttctgcacagtagttacttttttcttttgtaattaatatacattttgtagggcaatactgtggtattctgcaattttcaccccatttcttatcaaacttcatttatttatgtcggtatgatctcatggattcctgtgatattcaatggattcctgtgatattcaatggattataatccatttcttttattatttttatccgcaacttgttcagttacagctcacgggagccctttctggctaacttgtatgtcctttggagatgtccccgttttcctttgaatgcttcctcaatttctggcatcgcaagatattccagtttcatcttatactttcccaaccctgaaatcggtcgtctctctgaagagcactagtttctgatgatggagaatggtatttagaaacaaagatctgagtgctagctgtgctcattgttattgcattgtcactagccccaggcactctcagtggacagaattagaaattacacacatctctcttgaaaaccatgagtttgccctgatgctttttaattcttatttaataaaaagttcattcatactttctccctttccatatttgtgaccaccttcttgacaaaagatacttagtttttattatctgtaatatgtttattatttaactagccctccttcccccacactccagtataaccagtctcctgttttcctcaccaaacttgggctccgacatcattttccaggtggccactgccacgacccttcaccaacaccctccttaccctccctgggctccaacactacagcaggtaccatcttattcagcctggcctagtgacttttggactgagttgtttgggaaggaaaggaaagggaggaagaagaggaagagtgcagtgactttcttaatatatgccatcaaattggtgataaagtttcaacaaatgaataatgggggggcgggcacaaacattcagaccgtagcatgagtattttcaggcttctctgtctctatctcttaatcgaacccctcaccatattacctccaactttatttctagcacataaacaactgtctaatataaagacatttcaatgctttctcctgattcccccaccggctgttgtccatcaggcttccccaccaggaccgaggttgccttaaacaagtcagcatcctaaggcttgccactggcatcccagcaacccagtatcaatctccccagtacttccctctatgctaatgctgatctcttctcccatatcccacccccataggattgatttctggtccctacaaggggatggtaattcatccgtgcaagtctgttccaatcttgatgtcgtattgagtacaatcatgataatgatatgcatacatgtcattccttcatgtttatctctagaacatttaaagcaggcacccgggcttcccagaattacaacatgagttgaaagaaacggaatgtaaaatacaattttcttcctgttcatgcctggaaatctttggagtattgcttggctggccaacctccaagttcatgatcggggagaaggctgacacgtgactctgagcagccaaactagacaattcatggctagggtcagaactcctggcttcagtggttttgtgaatggaggtgttaccaagttcctgcggcacatttcatatttcatgccagaagaagtgactccactagtttgttgtgtgactcagattgatgattggatactaggtgatgaaaaatataatttttaacttctctggtagaaatcatgctggtggcatgctggaatcctaaaaccttaaagcaaataaaatccactgagagccaagatgtggtaaggaaggagaaatcttctaattctttccatacaaaagttatctagacagaaaccccatccccctggtgtggaaatgctatttgtttttgcttttagtgcttttgcttttaaaagatggacaatgaatgatagaagttctgttttgaaaaggatatagtcattgttaatgaccgggtatctagaaattatcttgttggttcttattttactttttttttttttttttttttgaggcagagtcttgctctgtctcccaggctggagtgcaatggggcaaactcggctcactgcaacctccacctcccaggttcaagtgattctcctgcctcagcctcctgaatagctgggattacaggtgtccatcaccatgcccagctaaattttttgtttgtttgttttttgtatttttagtagagacagagtttcatcatgttggccaggctggtctccaactcctgatccgcctcaggtgatccgcccgccttggcctcccaaagtgctaggattacaggcatgagccactgcacctggcccttatttgacttttaaaggaagaagctccacttaaatagaatttgagtgacatttgtttatacagaggtgaataaaaatgtatagtccctgctctcagggaacttaatggttcagtaagagaaacaacattaaacaaatgaggcaattttatgacagagaagcacagagacctgtaggagcacaaacaaggaagaccatatcatttggaggataaagaaagtcttccttccttaggaaattactgtctaagctgagaactgaaggggtaaagttgggctcagggtgtaggggagaaggaagggcacctaagagaggctcaaaaggaatagagaacttggcacatttgagatatttaagagtaagttaatggaagagatttaaaacaaaacagaaatagatttggagccagacaaccaagagctctatcaatcatgttaagggttgtagactttagagtttaccctatggtcagtgagaagccagtgagagtttttaaaggagtaattatctgaacacaaccccaagctgtcctgccttcactgtgagttgatggactaaatgtcttcctattgtaatgcatccatttcataggcttggattgagctcttcctgcttatgagcacttccgaaggcaggcgccatcttggtgaacaccctgtatgttatgtgaggggccatgctcccaatagtgtgtgcatgtgtgccctctgctgatggcacttagaattagagactaaaaggaagaaggccaggggtggtggtgcatgcctgtaatcccagcacttttggaggtggaggcaagaggattgcttaagtttgagacaagcctgggcaacatagcaagtccccatctcttaaaaaaaaaaaaaaaaagaaaaattacctgagtgtggtgacacatgcctgttgtcccagctacttgggaagctgaggcaagaagtttgcttgagcccaggtgttcaaggctgcagtgagctgtgatcgaaccattgtactccaggctgggcagcaaagtgccaaaaaaaaaaaaaaaaaaaaaggagagagagagaataaaggaagcacctttgcaggtacatgagcctgatttgaaggggtaactcacacagtgctgtaaaacacccttgaggaaagaattagggggtgggatatccaaacattgtattgaagttgcagttcaagaccttttcaaatgtcttttcatattggggttgccaacagttctcactttagtatctgtgtctattattagatatcctggtttcacttccaagttctaagtatgccagagaaacccagttaggtgatgatttgtttggttttttgagagtttctgttttcatgccagatgttgaatttatttaccaagtcagatcattcaccccgtgagacctacattatggagagtggcaaaagagaaggtgtagtttgctattaagttccataacttggggtatctgttcatgtcttctaatttgtggaaagatgtgatagttataaatgttacttttgtaagctgtacaggaagtgttgacttctgctgctgtctgtttagataagattagacatgaggtgatcattacattattataaagattcttaactgggtctctgttctttccccttcattatctgcaaatatcacaaaggaaagtcttaggaaaaatatgtttgcgactgtccacacattcttcatgaagcagagcttggtggagtgtgccatgctaaattagagccacatgaggcacagtttcatttgaggtgccctcattgctccatgggggaagtccctgtgtcagcatctgacagaaggattgatgatgagagagctctccatcagtagtacacagtgcctctctttcctgcaaggcaggcaccaactgtgcagcttgtaggagcccttctggctgtgtgaagctagctaaagcttattgtggagtgtccacagatggttattgtccaccaccatatttctagaacattctctggttacaaaagtctaatcatggtagttacaatttatcaaggccttaaagctgcatataatactagttatttcacacttgtcatttcttattttctcactgaatcctcccaacagccctctaagatacaaattacctcaactcttgaggccggatatatttctagattcagactttttctgattttagagaatttataaagtatatactattatttagaaaagtaatacaatgaacatactattatttaacacaactggcaggttctgggtcaacaccctgtgatcaaattaaatttctactctaaaacttgagaagaagaattagttacattaagtgggtaaagactaggagaccttcatgtcagctcatgtcaggttttgctgccaaataagttatgaaaaatctttcttttcagagttttttggatttgggaattatatatgaagagttgtggacctgtaataatattctttttcaaagaattactactagagcccagagagattaagttgcccaaggtcactcagcttgaaaatgggagagcctggtttcaaactcaggctctcatttgtctccaaaatccatcttctttcccctaccttctccttcccatttgttgagcctgctctatgaggtatacagtaatagcttctctctccaacctgtagctcaggttccctctaccctttcccaatcttatgcccaacccctgcattttcctgggtccttcttgatcctccttttaggagccactgtggctctgcaatccttcttttgcggtggcctgggtgtataaatttgactctcaggggccatgaaacagtgcttccctagtgacccaggatgattcctttctgctttcagaactcaattccaatgccccaaattacagtaggcaaaagcactcgggctgtccaaagatctgagcggatagccaagggactaacttagtccacatcagccatctagcctagctgctcttgtgagttctttttgaaagttatttcccaggaagaagctctgccatttactccagaaacaggttcattccttgaaaacttcgaaagaactgggtactcaagcaaggaagaaatttttaaatttgaggatgagcagggataagtgttcattattctgttaactaaacatgaacatttttggtgtactagggtcaaagtcaactaagttagttgactggtgatcattgagcaccatgactacgtactgttctccttgccttttaaaaattgatctttctgccttggcccagacttccctgtgttctctttatctaaatccagcaagtatgttttcttgaaaaatgcatgccatttggaaaggaattggtaagaaaagactatgttgaagctatgtttggcaaggggtgaaggtgtgcaatgaaatcaggacttttcaaagtatagaattccacattctctttagatattacccttaaaggcttggaaaagacaactgccatggttaaacctgcctgtcagcctcactcttctttttttttttttttttttttttttgagatggagtctcgttctgtcgcccagtctggagtgcagtggcgctatctcggctcactgcaagctctgcctcccaggttcacgccattctcctgcctcagcctcccgagtagctgggactacaggtgcccaccaccgcgtccagctaattttttgtatttttagtagagatggggtttcaccgtgttagccaggatggtctcaatctcctgaccttgttatccacctgcctcggcctcccaaagtgctgggatttgggattacaggcgtgagccaccgcgtgcagcccagcctcactcttgagatcctatgggcccagaagtctttattctgtgacaagcctgcagttacagcttctgggcagcagaactttggaaaaagcagaacgttccccaccagctgaattccctggtacaagcaggttctgctgttcctgctgattgtgctgggtcttcagatagatccgtgtgtctgggttggctcctgctggtgctgggccaccatgtgatgtcctcattgcctacttctgcatggcctctccatgctgcaagttagttaggggagcatcttatgaggaatcagactcagccatgcacaaaaacagatgcatagttttcaggtgacagagaggaggtgaatcaaagaacctaattcttgcaagttccttggtaagaaataggaactaatcaaaaccaggcttgggagcaggatgtcctctgtgactgctggggttcagggcagaatatgactgtgtcttttaccagccatagttacttgctgtgtacttccctaaggagactggcatttcagatctatttgatctttgtgtgctacatacttatggggtggaaggctaggaggtgaggtggggcagggagagagtgtatggggcagacaattagagcaccaaagaatatatgtgtagttcttgtaacgagattttctttctcatggccttgaaggtaaacttaaaagggttcccaaaatgtgtgtgtatctaactcacaagtattaccagtctctcttttatttcccattactcaagtataaatctatgtgcgaggtggctcatgcctgtaatcccagcactttgggaggctgaggtcagcagatcacttgaggtcaggagttcgagaccagcctggtcaacacagtgaaaccccatgtctaccaaaaatataaaaatgagccaggcgtggtgtcacatgcctgtaatcccagctactcgggaggctgaggcaggagaatcgcctgaacctgggaggcggaggttgtagtgagctacaatccctactgcactccaacctgggcaacaaagcaagactctgtctcaaaaaaaaaaaaaaaaaaattatgtgtgatggtcagggagaatatatgctaaaatatgacagtcacttctctggattcatatctcaagcttcattcctgactaccacttgctagctttgtgaccaacttacttcacctctgtaaacctcagtaaaataggaataaagttataccaacctcataaaaatgttgagacagggcctggtacataaaaagctcccagtaagagttattattgttgttgtcattacaacattacaacattacagttgctcttttgttttaagaaaaagcttagaggctgatcgcttgagaccagaagttcaagaccaacctgggcaatatagtgagaccctgtttctacggggggaaaaaatagctgaatttagtggtgtgtacctttagtcctagctactcaggaggcgaggtgggaggattgcttgagcttgagttcaacgctgctgtgagctatggtcatgccgctgaactccagtctgagtgacaaagcaagaccctgtctctaaaaagaaagaaaaggccagaaagccttagtagaattatttgtgagttgctcttttgcagcagttgtgagcctgaaataaataaccgaacacacatgataaaattgctttctattcctagctgggatttttttcagttacttccttagaattaacatttctcttagaaacttgaggtcaggaataatgagttttcagtagtccactatgattcgaaaaactaaagagtaaaaagtccatcattaaatgtactgagtgaataaaattacatgtattaccataaaaatgttttccttctggggggaggtaatcttcacacagccaagcccaccatgctagtagaaatgtatttgaagagaggatcttggtggagaattactattcaccataattttcattcttactgttttaattaacttttttcctttttggccttaaactctgcttgccctgtaagagcagagttctttctttccttctagagttttcatcatcttccagttgtgttcataggtataaacccaatatcagcaactcatccaacaacttgacttacctttaagcaataatatttgacagtttctcagacttgtttgccaagcagtggtatttctcatttctgagctaagtttataatctgaagattcatatcatcacattctcccacccctggggccttcaaaggaggagatgaaagaagaagggaccagctcttggtgtgcgggtcacagctggaaccgcacaagtccgtgcactctggggctgacaagcaggatgttcccttgtactgagaggaaacgaaattgaaaatgcaagtctgagctcatttctttctggtgacttgtgggtcgcttcagatgtttgcaaccttatcccaatgctgtgtgaagaaaggaggtcattgaaggaggccctggcttaggcatgtcctctggtgagtgattttgttcggttcagtttggtttttaaatacgagtgggtgaaggctttttcttttattttgagaaatgtggaaacaaaggctctttgatttaagacctcagacttcatgcatagagagagtaataatcacccaaatcataatatctgaccaaaattttcaggacttttggaatccccattcctggctttttaaaagttagacctgaaatccagaaggaagatttggacagtcagggatgacaatagctgtattctgagtgcatgcagccttttctcgggttctttgggtgggaggaattgcagattcttttctctgcctcctgtcagcacggctcgccacagatgcccaagggaaatccatccggcctggaaaatccagaagcacagccaaggcatggcttgctttctctggaccacagagtggtataactatttatgataaataaacaggaaacaccaatttatgctttcccactcatgatgggactaaactagctagtttggagtgaaactctttgggcttccttgctgcttagtctaccttgcaatgctacagtcttgtgagcaccaccattgcagagatgaacagtttttttccttctgagctcctctgggtatgcaccgcctgggatgatggaagggcttgtggatctgcctagtccataaaagttaaagcaagcaggtttacctgcttttctcagcgtgggctaataatatttacaagaaaacttttctggtttgttttatattttaaaattaatttgtgctgattgtagaaaaaaatgtaaaaagaatcaaaagtgattcataatcctactcccccaggaataaccacctttctagattttctccatgcccataggttcatggaagccaatattgggttgatacttgcattcgtttctattgctgctatgacaaattaccacaaatatagtagcttaaaaaatatgcatttagccaggcacagtggctcatgcctgtaatgccagcactttgggaagctgaggctagagaatctcttgagcccaggagttcaagccctgggcaacatagtgagaccttgtctctaataataataatttttaaaaatacacatgcattatcttacagctttagaaggcagaagtctgaaattcatctgctatggatgactatctgaccaaaataattttcagaacttttggaatccccattcttggctttttaaaagttagacctgaaatccaaaaggaggattgagaccagcctggtctcaattgagacccctgtcccgcaaattcgtatactgaagtcttaaccctcagtgtggtggtgtttggaggtgggccctttgggatataattaggtttacatgaagtcacagagtggagccctcatgacaggatcaatgcccttgtaagaagagatatcagacagcttctctccccaccatgtgtggacacagcaagagggcagctgtctgcaatccagggagagagccttcagcagaaaccgaccattctggcacctcgatcttggacttccagactctaaagttgtgagaaaataagtgcgtgttgttcaaaccatccagtctatggtattttatggcagctcaaacaaacctaagactgggctaaaatcaaggtgtcagtgggtagtgttccttctagtggctctggggaagagttcactttcttccctctttcgttctgtatgctgcctacattccttggctcatggccccttcctccatcttcaaggccagcagtgcagcatcttcagatctctctctctctctcgctgaccctcctagttccctcctacaattacatcagacccaactggatatttcaggatagctttcccatctcaagtacctaaacttaatcacaactgcaaagttctttttacctctaaagcaacgtattacaggttttggggattaggacttggacattgttggtgaggccattgttctgcccaccacaggaggcaacatatagtgttcatcttatgctgattgagtgtctgccatgtgctatgcacttttgctttctttcacacagttaagaagtggtgaactaggatttgaacccaggcagtctggctctcccgcctgcactcttgaactcctgcaatatatctacttctgcagtctgctttttctcttaatatagtttgaatattttctcatgaccttaaccattcctctaagtttgagagtctaaaacatcatttataatggctaactaatacttcattgcctaaatgagccatagctaacttaaccattcttcaataggaagatatcttggtgtagttaaaaaaaacacagtgctgaacgttcttgtacatgagctgtgtgcccatacttacttattaaatgaacttgggccagaaaagttccctggaagctggttaactactgtacattagacaacagtatttcctaaactgtttttcttcttttttccccttctgtattcatttacttactttaaaatttttttccccttctgtattcatttacttacttttaaaatgaggtctcactatgttaaccaggctggtctcaaactcctgagctcaagtgatcctctgacctcagcctcctgaagtgctgggattacaggcatgagcctctgcacctggctttttttcttgaggcacttaatagattctatgaagtgaggttttctggttaactaaacttaagaaatgctgcactcccattcctgaattagagcttcacaatcatattagcactaaaaccagaagtcctctggtaaacaaatccctctctccctccttgttttctttaacccagagtttcccaagcttaatttgaccaaagatttttttctttgaggcatcaagtaactatcctacaaagctaaggtcacaggacacaatgttagaaacacatctttggagtcaaccaagtgaagccacttaccctcaaactccttcaaaggcttaagtctaaaattactccagatggaatagtttgaatatgatcacgtttatgaaataaacttaaacgtttcctatcctccactcggaatttcagtctaacattgttgtagtggttccttacgttccttatagaggtcacattatacctgttccctgctctgtaaatgtcagggctggccatcagccaagaccaatacggacctgccctgaggtctacatggcactgtgtgttcatgttgttgtttaaggatagtgaccgatgtccttcaagagagccgttctggccgggcacagtggctcatgcctgtaatcccagcactttgggtggctgagacagactgatcacttgaggtcaggagttcgagaccagcctggccaacatggtaaaaccctgtctctagtaaaaatacaaaaattagccaggcatagtggtgggtgcctgtaatcccagctactcaggaggctgaggcaggagaatcgcttgaacctgggaggcagaggttgcaatgaacccagatcactgcactccagcctgggcaacagagcaagactccatttcaaaaaaatgaaagaaaaaaaagtgttctatagagtgttcagtgcaggtgaggaactggatggcaggatgttctcattgaaaatggggcagatttcaggcatcacaagctattgaatcattacaggtgaataaaccaatagcagagcaaagtttgagggagtaagcaaagctggacctggggttactggggaagttctgggtgagatgcacactggatcagtgaaaaagaagcaccaaagataaccatcatggtttggggagtctaatggggcatgtcctcttggccaagggacttcaaggggccttatggggtcatgaaaaagaatgtgattgagctcccaggcctgtggcacagactatttgcatcacattcatttaatgatcttcaagacccaaacagtggtgctgtctgcagtgtccactattgggggaagagcatccggagtgctgtcaccgtcctaatggagaggacctctggctgcaaactctggacctctgaggaagttgtcaggtgtggaacaggtttctctccagccttttggcagcctgtgtgattcctaagatggcacccagaattctggtgcctggtttgaaccatacttggggaggatcatcagagatcacagggcccagcagaggagcctggctgagctagcttcccttgatactgaccagaatgatggccggaagtctggggatgaggcatagtgtcttctctctctggggacctgtgatagcctctcctaagggggtagatagaaccagaacatgggctcagttatccaaagcgaccattctcagcccccttgttcctggaagcccctgctccagaactgctaagccagcctttctttcctgctacttctctgacctctagtggctagaactggaaaaacttgctcaagggatgaaatcatcaataagcaggaaatgtctttgatgttaaatggctgtccacttctctatagtaatccttcaccctctttacaacattctttctgcatacatcccatcatttaattcagccatcatcaacactgggtttgggctccagactgtgactgtcactgtcttatgtaacttgggctggagttggcatctgagcctctgtggtcatgacatccaggtgtcacgacatccaccctaactacattccagggttgttgcaaggctcaaatgacatgaagcctacaaaagaagtggtatataaatccgcttgttactccaaagccattgagtctgtgattctgtaagcctaaaatgttttaattcatatattttggtgaaggcatttaagccctttcctctgattctctatgggagattctgtcccaatccataagcatttacttgtggttgttatatatatttcataatggacttactgattactcaacaaacatgaattgcctacctcgtgccatgtaccacagctactgctgggatctggcaatgatcagacaggcaaggctctaccctaatggagtttgcattcaaatgaattaaggggattcatagacaggtgaaacatacccccctgtcctcaggatgacattatagcttaattgagaagacaaaagcttcaatagccagataagatttaagtcagtatgtgaaaatggccttcacagaaatataaacaggagttccactgtgctgtgtgtgaaagggagaagctagaagcaatgaatataggctgtgctttctaggtgtttaactctggaagagtggctggtgggaagtgatctggacacttgagaggtcaactggaaaatgatgaaaattaacctggtaattggtgtctatttctggtcccagaagagatgcaaaaattttatgcagaatatgcatgaaattgttcatctcaccctatagtcacattattctttgagattccaattaagtggtagctagaatcattagatgctttctgttctgaatattaaccttataaatattaactttgtcctcataataactatctgagggtaggtacccttatcatcatacccattttactgatgaggaaactaagatatcaaaagagtaagtaacttgcccaaagtgatttggctgccaagtcatggattcaagcccaaaccggctggctccagagcttacacgctcaccactgtgctatattgtttcttaagccttcaattaaaaagtcaatcggaattttcagagatacatactaagtgtgcaggagtgaggtgacctgaggtctgggattggtttaaaataattcagcaagtctaaggaaggaaggaagagccaattatgctaaaatcttgataaatgtttactctgggtgatgtttataatgtttataggggtcattatagcattccctaatttccgtaataaaaaataggaactgtttctagtgaacttggagattttgaaatacttattattgtactgttaatatcaaaagacttttcagttatctgggtaatttagatcaaagcaacaaatttcactgttattaatgtaatgtggccatgaaatgcagtgcccttttctgtatattaaaacctattttccacctaatccccaagtgtaacagctaaataccttaaaaaaaatcaagaagggtgtatcctgccaaacatatttgatagaatagcaaaacgtttgagttagaagagaccacaaagataacttcttccaaaattcccatttaaccgctatggcagttaaagctaggagaatttaagtgatcagcccacgattgaaatgggaatatgaaacgatgatctatagtcagtcacgtagccaagtactggaagagcaggagttaaaaacctgggtttcctggactccaggcctttgtatctctcatcagaaggaggttgtgccagtaaagggctaagcagcccatatggaaatgtggacaccaggcttcacttgtgattcctgctacatcaggcagttgccaagttagaagcctgggatgtaagatgaagaaaggtgagtccccttcggcttggaactggaagaggtcaaatggccctttcccctcccaaacggagccatgcaagccccatttatcttgtgtgttttatccacattccttgttcacaggttttagccgcatcaaccacaaagggcataattggaaaaatcataattgttatacttgaagatacttctcagaagtgcatttggggctctgtgtcaataaacccaccccatgaagggccagaagccagggccaggcatttcttgggagggagggatggaaatggtcttggtgagggtgcgtagagtcaccacaccactgttgaattaatcactgacctcatctctccatcctgaggattcttggaggacattgcgagagctaaaatctcctcattcccaaggctggtgtgcaccttttccattgcctttgttggtgtacacttcttaaggtctgggaggcctcaaaccccaatgtttcaggaccccagcaggtgaggtaaatgaataaagctggccagtgtaagaccggggcaaactgagaagaacaaacttcatccttattcaaaggttttataacactgggctgtctgcacaaaaagcctgggcaggtcagcagacaattgacttcctctgctatagaggatagaccctggtgaggaaagcaggaggcctgggtaccatcactggctccctatgacttgagtacagccttcccttggcagagcctcaagcgctttcatctgttaagaagtgggtctgtgagtctccaaggtgccaccacctctgacagtctaattctgtgatctgtgatagaatacatatctcaaaacaactggagccactgtcggtctgtccaacatatatttgcaaaatgcgtgctgtgcctgtttgatctaactgactttttggaacttggtgtccttgagatctttggatgggtttgtgcattaaccttaagtgctttgatccctgtaatataataaaatggcctacacttaaccatcattctggtaccactctctgtgtcagaggttgttgctcttttatttgccagttttctttctaaaagcagtcatgagcagacaagcttagaaagggtattttcttcgtgttgtttcagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagtgtaagtttttcctcctttcctctttcacttctctgagcgcggccatcggtgtggcgtgtggcattccagttcaggcacaaatgtgtatgtcgttgtctggtcagcattagggttccagtatcagttttcatatatgtggtttcacatgcctggaactgggtttgggtttttgcctgtttcaaaaaaaaattgttgatcttgcagggagctggtcctttgctgccaagtatagctggagtcgaccagcaaggctagtgtgtaagatgtttggtgcatagaaagacagcatgcaagggccacgcagggagaaggttgcaagtgccctgaaatcatccctatgcacctgggagctgatttctaccattgcccagtagagattttatttctctagaaaaggatgaagatgctgttccttcaaagccgacactctaggcaatccctaacaatgttacagtgcttaaaagactgagtgtgtttggggctgttaacaagcccatgtgcatagcttgaaagcaaagagccagtgaaaatgacagttgaaaaccacatggctactctgctacacccaagccctcggaactttgcacataacgttcaaattaactgtgaaggaagtcacatgctctgtggtttctttctccggttagagacataggaactgttgctctacacagtcccaggagcctggagatcagcctcagggttcatgccaacctcctgtgggtcttctggcaccagtctcttagcacatattgaagtcatcacctcctcccctgactgcacttaagtcacagatagcttgggttggttgaggatcctactgagtttacctgagacagtcctggcttatgcctgttgtggtgttgtggttattaatatccccttcaactcttttgttgttgttgttgttgttgttgttgagacagggtctgtctctgtcacccaggctggaatgcattgatgtaatcatggctcattgcagcctcgacctcctgggttcaggcaatcctcccgcctcagcctcctgaatagctgggaccacacgcgtatgccaccatacctggcttattttttaacttttttgtagaaaggaggtctcattatgttgctcagactgttcttcaactcctgagctcaagggatactcccaccccagcctcctaaagtgctgggattacagacatgagccactgcacccagcctgcctttcactcttgaaagtgtcccagtttgggtgataaaccatctggtcaccttaaacttgaatgctatgaagttcacagtaagaattccctgctgttttattgccttttatatcctagctggctaagttaaaggatttctggagttgaagcccagatgctgaaagttgctttcaaaatatatggcggtaaagaaaggaagaaagcaaatggatatctggcagcctggcttctcacttggcatctcccaggctttcccttttgtttacacctgaactgcgtggagcactggctcagctgctgtattaggctgcagctattctactgggctcttcactgtattagacagtgggatgatgcccggccctgggtagctgctgcagacatttccactgctgaacctcactgtaggggagccagcagctcctttcgtgagcctgcaggatttttccctggctactcagtcactttcaccagcccttctttgaagccccacttcaaaggataaagtttgccttaagaattttctgaaagttaaatcattttgaaacttggtgctctaggtgtctggtttcttttctcccagtgactctgctctatacatcagcagttttggtagaatttagccaagtgggtgccccacactctgatgtggatggggaagaacaagtagaaccacttagcatgtgacccacgcgagtgtttgctgaacacactctacttgtcacttgtgtatgtcttttgtgttggagtgcagatgatagggaaaaatactccatacagaagggtagaggcagttctcactcatttcgtaaaggcagagggctggaagctcttttgtgcacacgctgacactctggcagccacctaacaaatgccaaccaggttgagtttttcctctgcatgaatgaagctgcttggaatcagcgttttaatatgctgattgcccttcacttacaaatcaaagaggcagcctcctgtctctatattttccagtaaataaacattttgaaaaagaaagagacctaactaattaagctgttaatatccctggatcttggattcaaagccaaatgttttgcactgttattgctattacaacagaaccaagtttgctgttgttgaaaattcttaggatcaggacaaaatctaccaatccactatatgctcatttaagagacccaaatctaaaacaacaaattcagattgcttctaaagcaaagatatgatcatcagtcaggcttcaaatgagagccttctcctagcccttccaatttaggggaccttttctcctgtatctgtgtcaatcactggtgaatgtgttgaagtttacctgtagggatgaacaaacattcatttttttcctaaccaatctgtggccccttttccattttttctttttctttaataccagaaggatagtaatagagagcagatggattgctggggggatgagttgtgtaactggcttacctatccgtagaagcataaagttaattctcttaaaggtaaagtaattctggtctctagcctccatttacatacactattctcacagagaaacatggcttcttagactctccaccctctaagcacctcagtggctcacacctacacacccagcatctccccatgttatgcagcatcacccctggcacctccatttgccaatattttttccagtaagccacttggcagcattttggcatgccgttttggagatgataaaccacacctgagaatcaatgcctgtcgcgtgattagaacacaaccatgtgtttgcccatcgaaagtaacagttatttgtgaattgagcaaaaataattcttattttttattctttttaaggagaaggcagagttaaaaacaagacaggcgctgatcattggaatgtgtataaagtgtgatatgttagacacaatggtatcgaggagagtgaaagacagaaggagaaagatagaatgtagctacggctgaagttttgctgagtgagaaaaactgatctttgccatcaaaacaagttcagtgtcccccgagcccccatcaggggtgtggtggcctctggggtcctgtccacagggactcagctcagggccctgctctctccagttttccactttataaaaagtcatatgcagagaggcccctggcttatgggagtcagggagtggtgttatccaaaggttgtccccaaccagccatatttgttactagctcagaacttgagcaaagtactccctttagttgccacagtcttcacccacctgggctgatttctttgtcctgtatattggagtcaccaatgagtatctccagcctcacttattaatggacctcttggctaattctgagggcaggaggattaccatccccacccctacccacttacccaaggctgtttaccaacctatgcaaggcctttgtgtgaattaggaaaaaaaaccacccttgttcctctatgaagatatgaagatgcagccctgcaccagccacacatttggggggtagagtaggggactgggctttagtaccattcatccctttagtctgatgcttttgtgcagtgcacacaacacacacccagatgcagcaatcctattcatattgtgggtttctcttatctggaaatgttctcttatgtggaaatgtccacttatctgggtctcataccatttctgctcagtcatgcaattcataatggactagtgaatcctagtttcctaaagggcttcttgatgccttgcaaagcgactgcctccaaggtggggttgcccactcatggacctggaagacatttggatcagtgggcacaaatgatgggctatttggatgtttttccttcaggcatgaagaacccctctaggaaactctgattcattagtccatcctgagtgacatgactgtatttaggcaaacagtatttttccagccaattgtttccctaacctgacctgagcctcagaaagtgaagatgatgggtcattgagtcaatgatgctcatgaacatctcgagggtttgctttgcctttctcagttgaagggatgctgaccagagtccaaatcacagcctcctggatgttcagccccatctttacttttagcgcaggatctgccctcagtggggttttccagtgtgctctctctctctttctcatcccatgacttcattactgagaggtcatccaaccactctgtctcatcttagaacaagagaagacctcgtcggttttcctgggctacgtcaaagctgagagttcctggcacacattacccttccagaccaggacatgcattgagagttgtggccatactctcgctcagtgtgtgaaggaagcctatctgcctcctgtttccccagacgctacaggaagctcagtgatgccttgtgcttccctaactctctcttacgttctcactcgtaccctagtgaagatgcaaaggagagagaagagctcctgacttgtcagctcccagccattagcccaatcatgacagaactataattcctaagtgctacatataagaagcagtcagcaatcacagatgtgtgatcccacctaactagtctatggctatcaatgccccaaaccaataaatgctttaaatgccccaagcagtgtaaatgtacgctcattaccataattctggagagggatgtcccaaattggtcctgccatctcattttccatagtcaggccatttttttctgtactttgagtaagacttttagtcccctataggaactaaaggatcatttcagttcctaagtgctcatactaataatcctatataatcaccagaaattgctatcaaaggatgatcccactctcaggaacttacccaggcccccagggttctgacgagggaggctgtgtggtctccctaggcaagactacccttaggccggtttcagagaatctgcctccacaaaccaactgctgtgattaggatcttcttttaatggaacaacaggttacaagacggctttggggttcagagaagcctacgggaagagaaaaggctatttggctacagactctagcaaatccaaaatggcccccaacgaccttgctggtgggcagctgattgtgtacagaggggaaggaatcttgttaattcaaagtacagaaactgaaagcaacgttttgaattaacaaagtacggcttatctgatatttttattagtgaacaatagggtatctagttgctgcaaagaatagacttataaataaactaatatcagatggagaaagttttggcatgggtgtagaatggcctcctggtattacttcccctcccatcctcttctggtgtggtgcctgttcccggctagggggtgttctgtaagtgtgtcactgccatgtactaaccctggtcttttccctctctgccagtacacttctaagttactgtcttgcaaggtgacttccgaggtacttttcaatttgtttgtcttggtcttactgaatgcatgatccaggtgcatgctgttgtggtttgccatttcctgatgagttaaacgaaaatggcaagaaaaatgacttgtctccatatgtatttttttgtgcctgttctgaaatatgggactgcctcgaaatgttggagtccatgcaacagtgatatacaatggtgtggtttgctgtgctgtgctgtgggggcgagtgggagggtactggggaagaccttgcctgctcacgaatcttgaagacgtttggaccagaggacacaagtgatgggctattttggtttttaaagtttctttaggcattaatagcaagtatacttggcctggttggaaaacagtgcagctcatgcagattgagctatggattttcacccattctttgtttaccttaacataaagctagaaagctccattctatagatttaagatgaaccatcctaatctacagatttatcaaatgtaaaccatcctagacctccctccctccaatctttaaacgtgtatttttattttagaaactctaagccttgatttctccaaaagcctccttgtttaagagacaaggtcttactctgttgcccagggtggagtacagtggtgcaatcatagctcactgtagccttaacctcctgggctcaagcgatcctcctatctcagcctcccaaagagctggaactactggtgtgtgccactatgcccagctaatttatttttttatattttttttgtagggacgggggtctcgctatgttgcccaggctggtctcaaactcctggcctcaagtgatcctcctgcctcagcctcccaaagcattgaggttacaggtgtgagccactgttctcggtccccaaaagtcttctttccttttacacagatttcacaaatatatgtgctataaatatgtgtgctatgagaaggcataatatttttctcttttaatttttttctattttgtccattttttctttttgctgagaaagcacaatatttttcatatttttatttctgtattttattttgattttaaaagaattatttcaaatatacagaattctagagagaatcattcgttcattcatttaacaattttcaaggctctactatgtgtcaggcattgttctaggttccaagaatacagcagtcaacaaaacaagttcctgatatcatggaactggcattcagaataatataagataataaaataataaaacccacctacccagctttgtccattcttatcatttcatgatatttaatatttttaaaagaaattagtattgcaaatacaatttaagccctctcgtacttctcccagttccctcctcccttacaatctcgcagaggtaactatttttgagcttgttgttcatcatttccatgcatggttttatacttatactacaaatgtgtatatacataaacaacaccttatttttgcatgtttgaagacattctataagcggtaaatcatgttgcagtatcttctgctcctgactttgttctgtctgcattgttttgagatgtgtccttgttgatcactgtggctctggttcattctttataactgctgtatggtattccattgaatgaatatatcactatttattcaatcttctgttatggaaatgtagactatttccagtttttcttaccgttagaaataatgcttttatgaatgttattatacatgtctctttatgtacctatggaagaacctgtctctatatttaggagtagaagcactggctagtagcctgatacatcctaacatttactagatattgtaaattatttttcaagttggttgcattaacctgtagcataataagttttttggtctctctatttagccaaagaattatatttaaatatagagctgacctgctgattatcagtaattttctttcataagatatcaaatgaatactgagaatatcattctgtaccttctttaacgtctaattgtggttctcatctggaggatggcagtttgagaattaggactaagcccgtctcccctttgagtccatttaaaacaatgaaaatctggtcaaatatatccaaggaagatagagttgggcccactctgtcttcaatttaaaagcaggttggaagatgaaatataaatattaatatgaatagggtgatattatttaacatatctgtcttttgtttcatatgtccaaattaaaattttctatattgattgctttcaaagttaagcaattcacttgaattccctaagcattagagagaaaaattaatattaaagggttgttgagagataattgttttttattccctaccagacctgaatgtgaatttgtgaaaacaataaaactttgtttatttatttagtttacttttttttttttttttttttgagacaccgtctcactctgtcacccaggctgaagtacagtggtgcgatctcagctcactgcagcctctgcctcccatgctcaggcgagtctcatgcctcaacctcctaagtagctgggactacaggtggcagccaccatgcccagctaatttttgtatttttagtagagacaggttttcactatgttggccaggctggtctcgaacacctagtctcaagcaatctgcctgccttggcctcccaaactgctgggattacaggcttgagccactgcacccagccacaataaaactttaaatcagatcgttttttgttttcccttttccatttccatggggagtgttgattgctcttctctggtgtgtctccttctggactccttacagccattgggcagccagatagtctggtggcctcaagcatcaactctgcacccagagtgcagagttcaaatcttggttttgccttctgctaactgggtaattctgggcaagttacttaacctccctgtgcttcaggttcttcatataaaaaatgggagtaataacagcataaatgtcatagactagtagtgaggattcaaacagtaacatcgtacttaggacatgagtatgacattattagagccccagagacatatgcctttttgcccagaaaataaaggaatgaactttagaaagtgaagttaatatgcagtaataaacaagtaataaaagctctaaatttgctagagattcacacacacacacacacacacacacacacacacacacacacacacgtctgaattaattacagaacagatactcattcaaataccttgatttttgaatcttctgaagaccagttgtggtgcagctttactcccagacacccctgggtcataagccttatgaacccaaagacagctttatatcaagattgccaggtatttcagtaaggatgtttattttcttgtctgtgccattactagaggctttagatttcactagaaatttattgtatggccatggtaagtgattgtatgaccatggtaaatgggcatacatactaggggaatgaattaagaaaagagagctcattgttggtataagtgaattactggggctcttgacaagtagatgtccaaacccaagctatactaaacgtttccataattatgagtattatttttctgcccattatacttttcgtcactaaactccatgagggaagggactattctatcctcaacacgaagcactgtgccttatacttggtaggaaactaataaatatgtgtaaattggattgatagatggcttgtaacaagagttcctaaagagcagagcaaactcaatttgctcaagttgtttgagaattaaaatagggtttaaataacaagacaaagaacattccaagaggatggggaccatagtttttagaactttagatttatttttagctttgatgtaaacctttctgtttgtatctgcaatctgaaaggcaaagagatgatccttttatacaatgtagagttctttataaaacgccctatttgtatgccacttcataatttatatatccctttcacatgatgatagaaataattattccatcatagtttgagagcttactatgtgctgggaactatactttacatacattgcctcattgatttatccgtccaactttatgctgtagtttttatgatccccattttacatggggatactgaagcacaggggtaagtgacttttccaaggtcatgaggatttgaagtagacctgcctggacttctgagtccacagtgccttctgagaaagcctgtgaagtggggtagctgtgttctccatgttatagataagaaatgtgagataaaagatgaacaacaaaggacaaaactggaaatagagcccaagacttccacgtgcagtccagtgctgtttttcagttccatgctaccacacattagactattagaaaatttctctatttaactatacagatttggaagcatgctttcctcctactaatttgttattcgtagatatctgtggatattgagtgagtgaccgtgatatgcttacatacaaaacacattatgcaaaacacacatggcttgtgtgcttaacaatgcatcattcattcagcaaacgtgactgaggaggaaaaggggaggcttcacagaggaagatatgttgaagctctgggtggtccattcctttgacaaaggtgcagagaagcaggttgagatggacccccgatctcccatctacccacaatctgcttatgtctgggctcccacctctgcctgtaactgcatctccttgcttctctggagttgccaactgtattagtccattttcatactgctatgaagaaataaccaagactgggtaatttataaagaaaaagaggtttaatggactcacagttccacatggctggggaggcctcacaatcatggcagaaggtgaaggaagatcaaaggcacgtcttacatggcagcaggcaagacagtgtgtgcaggggaactgccctttataaaaccatcaggtctggtgagacttattcactatcacgagaacagcatgggaaaactcgctcccacattgaattacctcctatgagtccctcctgctacacaaggggattatgggagctacaattcaagatgagatttgggtggagacacagccaatccatatcaccaacatcactgtcccttgcctaactgattatatttagaatgagcagtgccttcattgcagtttgcataatcaaccaatgttggctctactggacttttcttcaaaatcagaaactgtacatcctaagcaaatgccagaacaattggcaagaatgcctggacttgttttctgcatggtcatgaaatagaaccatttttcatatgttggcaacctaaatgccattaatctggaatctcttcttgatcaaactgaaactggaccagataggctgaagtctcctctcgggattccacagactgccctagtgaatgggaggaagggaggctctccctcagtggtggtgagcctacttgtccttagtgttgtcacctttcatttcattgattagcatgtggggtctgaagttgcatcagaatgctgagattgcttctattgatccaagaacttttttttttcatgtaatggcttttttagtttaattttgccaaagtaggtttttatactataaatatcatcatggcttatataggtttgcaaagcttgatggactgaatccacactggtcccattgtttggaattattttctggtttgcttgtttatgaagagactaagaccatctatagtgtgctgtctaatatggtaatcactagtcacatggagctattcaaattaaaattaattaaaatgaaataaaattaaatatttagcttctcagccacactagccctatttcaagtgctcaatagccacgtatggctagtggctaccatactggatagcagagatacgttttcatcattgcataaagttcaattggacagcactgatctgctgcgtgtagggatctgctttatctgaaaacttgatgcagaatcacggctagttcaaagaaacttgcagaacatttcatgaaaattaaatttctctatggtgaaaactaggggtcaagtagcagatgaatactggctgtgagatgaatgcataaccagaacctcccattcccctttttccagcgtctctcctatctcccagcagtgctttatcactttctcctctcaagttgataaagagaaaggaagaaagaaacagagaagtcggtttatgttcataattaacatccatgaactctgcataattttttcccctctctttacaggtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggagagtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgcgcttcatgttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataa

SEQ ID NO: 1483 - DNA, 392215 bp, Homo sapiens; identical to SEQ ID NO: 1482

SEQ ID NO: 1484 - DNA, 500431 bp, Homo sapiens
ctggaattattattttttttattgacaatggaaagggtttctgttatcattaccttttgactgaatctgttaaataaaaatagacatcaaaacaaatgtaatgtacgtgcaaacatagcaaattaaaatacagaaaagaaattactaatgacaggtcttgcgcttaataagatcaagcagcagaaaatcagcagttagataaatggtattattaaataggctttactttgaatctcccatataaacaaagaataaacaacagtaacaccaccaaataaagccacagggaagagattactcttctatacttttatacactatatatgttaatcattctgtctttcatttatttcctctgataaaactgacttcagggaagtcgcaacaaggccatctcggctaaaagcttataacattagacatgagtctggctaatgccctgttacattgacaaaagggaaaggtatcttgggtttcgttttctctagtggaaatgagcctcagactctgcggtggttgacattcactgtccagtactggctggcatttcaagatatttgaatgaacatgtggttcttagtaaagaagtttttttatctttttttttttcttggtccacaggtaacaagagaagattatggttttttaatataaatttttaaataattgcttttgacccttgtaaacagcttggctttgttttgtattgaaaaggagatcaagccatcacagtgctatttctaaagatataggacatccctgattgcctttaaagctctatttttggctccggttccaggttaaatcattcttttttacatgatcagaggcaggttgttcagctttaagtattgacagacttgaaggagaaacacgttgaagcatgaaacatgcttcaaggaaacatattgatttgactattaacaatccaaaaactgtaaaaatggtggaatggtaaaatacaaacagtacttggaattgtcaaatgtttgcactcgagactccatgaaccatatattttattttttaaaaaatcatatttatatccatttacataagacttacacatttaaaaagaaatgcacggtaatacataaatgcctagtatattacaataaaacatgaaaaacaactggcttcatttcataaaagcatctgttgtacagagtttatgatgtagatgatgtttattattcaaatgacttaagcattttattacaatttgtagtaaactaatcaaatgtaatatctgactccccccaaaaatcacatttttcagcttttaataagtcatgacgtcattatttccttagaattcagttttcacaaaggttttcactgctcgtcttcttagatggtagtgcactttaggtagagtagactgaaaagacgccatctaaaatatacaatggatagcattagttcactgaaaagtcccagactgggaaatctcattctactcctctgtggtgtacctccacgcagcctgcttactcctgtcctagaagatcatgagaaggaaatcatctaggatgtagccaacagccgtatgtaattaacatttgcttttctccaatttggtgcaggggagcttaacaaataatagaatttgctcaactttgtggaaagtatggcagtaatgtaaacaaaggtagttatgcaaaatgttagcatgccttctgaaaaatttacaacttgctaattaataaattgggttgaattgacctatttcataatgtagatttatattctagttcatatattttagagttcttaaaaaatacctttatttgttacaaaaacataacgataataagtcacctattgtaaacgtttgtgtcagtagtatggcattgctgattgttttcagccataatgtacttagaaaaagctcacaattgctattactgacacaaaagaaacagcaagtagtatgctctggattattttaatatcaaaagtgttgttgtttcacccaaacaaaaaatggttgtcctagattgaattattgtaaatgaatactgttatcccaattaatggtaaaaactaggaaatatgaactagaatgtcatgcacaaaaaacagattgcaaatagagtaactctacccatcacttaagagctaagaagcaagcactattgaacatattaaatagtcatttgtaaattagtgaagtgttcatttcctgaagaaattataatgctatgtgtagaatctaatataaacagtattttgggagacctcttatttagccaaattattatatactttaaatcatgtctaattaggtgccaaattatataccataattaaaattttaatgtaagggttgtacattctgaaattaaatctcttatcgggatgcttttcattttatcagcttcaaatagtgatccaaataaggcagcatatctgctcccatcctaagcccaaaagaccaacaataaattgtgtggcacttttagttcaaggcaatgaaaacagcacaaggtgagttgttcctctgtctataactgttttctcttaaccctgtgcacacattttgttctaaatatcgctcttaaaaagtatttttctaaaatattgattcatcgaaagtggttaaatattttggtaaagcatagttttaggttgaaaaaaaattatgaacatttgacatttataaatctaagaaaccacagttttactattaagactgtttttcaataaaacctcatttttatatggattttaaagtagctttcattaattggtatttccttaaaatcaaatgcttggtatttatggttacataggaaggttttgtgctggtcctattctccattcttaaagtaattttattttgttcctatatgtcttaaatacttaaaatttatatttgtttttagcaagtgtaaatcagattgataagaaacaatgtaataaaggtttgaatttttcacagtttctactatttatttattgatttattttaagacggagtcatgctctgtcacccaagcttgagtgcagtggcaccatcgctcactgcaacttctgcctcccaggttcaagtgactctcttgcctcagcctcccaagtagatgggattatgggagtgcaacaccatgcctggctactttttgtgtttttagtagagatgaggtttcaccatgttggccaggctggtctctaactcctgacctgaagtgatccacctgcctcggcaagtttctattttttaatatgaaaccatctctaaatcattttcctgtctgttgctatttgactcggtgaacttgcttaaatccctatccgctaccttggcttccttatataaaatatacacttaaaaagataggattttttaaagtgctgaattattatcaataaaatgctaagttactcaacaggaaatggtactaaaaagtagaaaacagtgtagtggcaacccattgatgtgtaataatacagtgataggcctccaacaggcagaccttaaaccacaggagacagatggtgataggaaatgctagactaagtgttacaatatgaagatttctttttcccctgaagcaattcaaaagggttatctcatttctgtactgctagggcataccaaagagtatagtgtatatttattagtctatgtaggttccatttttttgtctttttttttttgtcagccaaagggaaactactcacagcaggtcagtgctgcctcctttgagtggctggtcaacatgagtatgtgcgaacagtggagttgtctaacctctgcagtcttgatgaagcaactgcaaatggagaaaagggctttagagggacttggatgattgagtacaagatttcagatgagaaagatttattttccctgcatacagggattccgaacatattagtagaccttctttctctcagatataagccactcacattcctcttctctagatcaagttcctaatgaaaatttatcccaatgtaaatgacctgagcttttgagttgttatgtattcttccttagataaaatcggtaacaagagcagctcccgagggtgcttctgattttgatatggagattgctcttagagaactcattatagtggattttttttcctttccaagtattgaagaacttctacactaattgtaatgatgttaaattcctcatgaatttcgctgacatgttccaccgtattaacaagttgtaagaaatgtagatcaagatcacagtttatgttggaactaaatttgagttataataactgtgaccttgacaagaaataatgatgctaggtgattatcttaacaaatagcatgggactatttttctttaatgcctcccaaacagaaataattttgtgactactatttcaaagttgtctctcctctggaatgacttttcttttgtaaattagatagcttaagtctaatgtccacagaaggaaatagtaattgggaaattactgtgttttgtgtttctttaattctcttctcatgttcatggcttgtttatttaagggcttctgctttggctagagggaaaaatatttgatgagtgaatttctaagatgacatataaaactcgcagtatttaaacatgtagggagacagtggagttaatttccatttactatggatctttagtccaagtccaacctctaacttaaacaaattgttaattttgggaatagaagactaaagaaacacaaatcctgccgatgtttattgttcctcctagaggtggacattaaccaaattgttctttttgggatgttataaattattttgaaaatgtgaataaagtgccatgagttcatgcaatagcagtgtaaaaaggagtctggtttgtgatgagagcaaagtaaatttcaagcagagcaaaccaactcaagaaaataattccaaaaagcaaggtcagagaattatactagctttggctaaacaagctttttgcttgataagcagcaatgcaaaactactgtaccatctgttgtcatttttcttgactgcccagaggttgtggttaacctaaatccagctggtaatgtttctgaggacccaggcatcatgctgattccatgtacttcacgaggaggaaactgccttctccaggttgatccacgtctgaagttcttgtcatcactctgccagtacagttataaggtgatgttatgaaaacaagtaaactagtccatgtgcttaaagctctgtgcttagaaacatgtaacatagattatttacatttagtctgtcaagtatacgtatggaatcacgctttatcaagatagttagttctatgattccaaaacaagactataggagatttgatatataaatttttaaataaaacttttcatacaatttcaaatttaaggtctgacatctatacagtaaatatccttgaaagcctaaaataagcaaccaatgttttccaaaataaatattgtatatacattgttccactttatgccgacgggttttatggaaagagatgatatacttaattgaatcagttgttgagtagactacatttaactcacacacttgaatgaaatgacttctatgtacacaaatacaatgtaggtatttattttggggaaatctatatttgagatggcatggctaatatgagacactgtagcctattataatatctgtacaagaaactctaaatatgtgatttgtgaagttttaggtgacacagaattaacttgcaatttgttgaaaaatctgtgtagcctggacaccatcctttcaataagtacatgtggtctttgggtaccaccgaaagcataatattaccctggttacattttaataatgtgtattttaatatacacagaggcagagagtcacatcccatttaattggcccagtagactttttctctagttcattactatcaggaagcaacatcataccccacataggctagtgtctctacttggacagatcctagggtgaatccacattttagaatgtagcatagcaattacattttaattctggttgctgattttgttatgccttaataaaataatctcttccttctctttgtgtacataaagtacttttacagacataattattttcctccaaattggcaagtagcaatatataattcagcagtcaatgaatattctgtgtctaattccaaggaaaatatgaatcattccacataggtcttgtcttctcatctcactgtttcttatctagggaaggactatctatgccatagataggtatagccaagtatatgttgtgtatcctaatatctcatttgatttcattctggcatttggaataataagtctatattcactcaacatagtaatttgtgctatgttatagtgaataattctataaggtaggctttgtagactgctatattaattaagggacatttaaagtcaatcagggaaaaataaaatcatttttatataataacatatatccactgtttcaatccttatcatcattaaaatctacattttgtttcagtgtggtagccattttgcacattaagagatgtccgctactcttcccaactgctgtgtttttcattgccctagatctccaaatgtgtgtaaatgtagaaaagaaacagaatttcacagttgcagcctctacgacttcttgattcttggagaagtttttgcattaagcataaatagtcttcagttttataaaacactatgttacactgtagagctacacaactccttacagtgtcgtagctaggggcttaaaaataagccagttttggctgggcgtggtggctcacgcctgtaatcccagcattttgggaggctgaggtgggcggatcacctgaggtcaggagttccagaccagcctgaccaacatggagaaaccctgtctctactaaaaaatacaaaattagatgggtgtggtggcacatgcctgtaatcccagctacttgggaggctcaggtgggagaatcgctggaacccaggagacggaggttgtggtgagccgagatcacaccattgcactccagcctgggcaacaagagcgaaactctgtcaaaaaaaaaaaaaaaaaaaaaaaaaattgccagtttttagagttaagcgtttgaattatgattcctgacttctgttctttcaacatattgttactgcagaaagttgatagaactataaacaacaacatcatggggaaaacttttcatgagatagggttaattcttttaattggggtcaaagtctgtataagcttgttgacacctctcagattatttcagtggaatctgaatgtgatcagcaaaaccgcagaaataagtccactactgttctaagtaagttggctatttttgctcacactaaaaaataaaataaaattgaacaaaagagactagagggtttaaatgacaaaattctattttgtgcttttaaaaataagaaaaagcagcagcatagtttaaagacaacgagtcgcatctcgtttaattggctcaatagacttttcttctagttcattactattaagaagctaccccacacctggacagctcctaagagaatgtagcaatatgacaactcttcaataattttttattagaaatttttgcaacttataagtaagaataattgtattttaagatgtatgagtttataagactacctttttgaatcaataatttctagtaaggatttaaaagactgtcatgcaacttataagacgaggcttttaaaaatattaatcattatgctgattgaataagagcatgaatttatcagaagttagctgagttcaagactgtagaacttatctctctataatccccaccataaaggacagagtggattttataataccaagattatctgtcctgcctatttgaatatagaatgattggtccatatttgaatttgctgaggtcttcacaaaataattttaatcagcttgtctttgtagtaaggaacacctgtactttgcaacacagaattatgcatctctttattttctatttcatgctcaggtttccttcccacttcttccagaaagaccctgtagaaaaactcagaaagactattaaaatgtctacagtccacagcatttgctgatatcccttgtattcattcatctcgggaggctacttacatgtttattattttccaaataacttaatatgcacatattatatagcgattcttatattcaatatagctttcaaattctatgactgttaaaatgttattaatctgttttgaaggaaaactcagtatcaatatataaaataataaaaagctttccatttattgaagcaagttttatcctcattttaattttctaaaatttcctggcaagatatactgatatttaagaaatacacgcactctttattaaaaagctgaatttatcaacattagtgttttaacttttttctaattttttaaaataatgttgcccaacgttttgcagtcacgactcataaaaatgttttgtaaattactgtttagtatctctacctgctgaaatgataatatttatgaattaatatagctctttccaaaattaagtaataagattgaatatttaacaacaaacctggagaaaattattgattctaaccatagaacagtcatttgattaatttccaagcactattccttaaaaacaaagatgttctatcatttttcttttactctctcagatctcttttgaataacaggtggacttacttcatccagtcgcctttcagttcccagggccaagaggttattgtattctctttcaagaatctgccttgcctgttgacgtcaaattacagttaccatcaccgaaatcacattttattttaaaaatcaagtagcttatatttatctgataatgtattataaaccatactttatttatgggttttgaagtttttagccctccatgtctgttattagccattgtaaattttaactacaaaaaaaacagggcttttttttttttttctgtgaacagtagagagacagtcttgcataaacatctgaggtcaagaggctttggcctcacttcgttactatatttcaattgagtattttgtttaatctctgaaatatgtaaaaacaaaataaaaagtgaaacgagactgccaaatttttattgaatctatgtaggtagttctcaaacctggccaatgattatcatttgaggaaagttttgataataaagattcctatgccctatctcttgacaactgatgtcttaggactatgatgtgggttggaggttttattttttattcataaggaactatactgattcaaattattatccagttttgggaatcactgacatatccaatgctaagagtctgtataattcatacatgtaaatagaaatgactgcctctcagagaggcagagactgatggccatctgtcagggatttcatttagtggaatctggcattcaggtgggagactgggccacataacttcgaaatccctttcttgtttaattgtatgatttttttttttttttttttggctagaaatccactagcctgaaattaaaaccccagtgacatatttcaaacattgagttaactttcattaacaatcatgaatacacagccaatttttttctaaaagtttagtttatcattatataaaccagaacacattgagactacagcagaaagtgacttgcctgggtgttctgtgttggaatctgtaataataaagctaagctgctgtagtcaaagttttcatccagggctataagtgagccatgcacaccgctctcaagtatattatttgcatattctcgaagtccaattgcttgtatccagcgaataactcggtcattgctccacaccaacacgtctaggaaaagagatgcatcattttaggatgcattatttttctttcttttttttttttttttttttttttgagacggagactcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcgcattatttttcatagtagaaccactggctgaaatgagccatgggtatctggccaggtcacatttatgctgattcatccacactctaatccatctggctcccttcatttgtgtgtagttactgttttaataattaatcttttcgagtctctatttaaaaaagttgttatttttcagagtgtttgttatagctaaaatgacagcacttcagtcgcgtagaacacgatgtctgtgtttcttgttttcatactagagaactaggtgtctgtctgaagttcaatatttttaccatcagagggagacatttcttatttgtgtcttgatacacacctcttcagtaaacagcagacgagattgtaatactgtctttcatcagaagtgtttgttaaccactacctaaacattggcatatagactagaagattttttttcacctgaagtaatatataagaacagaacggtaaaataatataaggcatcaacagatggatacttaccttagtattatatttcaatgcatttttcccaatcacatgctaatgcaaaattcaagcactcagtcaaatgtcaaaaattgtttccactctattgaaagtagtattctattgaggaaaaaatttctttgatttttattttctaaaaataaaactttcagagaaaaatgccgtttctttttttttagataaaaacatcaaattatgttttatcatttattttcttcaatatcttcccattaaaagttgacagaatgctatataaaatgagtaaaatagtccgaaggactaaaattgtccatagaaaagaaagaattttaagaaacttaaggggatatgagaaaaaaattaaaacatttttactacccatagaaagggaaaggaaactataattactattaaagtaaaagtaagttttcctgtccattttttttctttctaatgaagtgcctagctctttcagacaaagtataaaaatctttcaggaaatattcttcaactttaactgttttaaatacctgtttcaataagcctttgaaaagcatgttctaaataattattttgatgagtctttgaaaatccttatttatcttattttatccatttataaccaacttagatgttcttgtgtataactttgaagcaatacagtgatagcacagacccacagaggtcccctcatgcaacttctcaggcaccattctcacctaacagtaaccaatattctgacttctttcattacagaatcgccttgcccgatttattttttttagcttttcatacataaaatcacccaatatgtacttttttgtctgcctttcattcaatatggaatttatctacgctttagcaaatagcagtggcgtgttcatgatcattgctatctagcatcccattgcatgattatgctgcaatgtgtccattctactgtagatggacatgtgagtagattccactttgggttattaagaatagtgttcctttgagggggaaagggtgggggatggcaagggataaaaaacaacacatcgggtacagggtacactgcttggttgatgagtggaccaaaatgtcagaaaaatcaccactaaagaacttgttcatgtaacctaacaccacctgttccccaaaaacctattgaaataaaaaaacaataaatagtgctgctttgaatattgttatacatggattttgttttgtatatttacatgttgcagtagaataaataacaaggaatagaattgttatgtgtttacttgttagcagatattgctaagcaaattccactctcacaatttaaccttgcattattaatgtctgaacatcttcatctttaccaatgctttgtatttctcatttttgttcttgttttgtcttgctttttttagtcattatggtaggtgtggtattatgggttgaattgtgttccccaaaattcttgtagaagccctaacttccagtacctaagaatgtaaccttacttggatatcaggtctttatagaaatgatcaattaaaatgagtcaatagagtgggcccaaattcaatgagactgttatcattcttgaatggcaaaatttggaaatagacatgcacacatggagagcattatgtgactatgaaggcagggatcgtggcgatgttcctacccgccaaagaacatcaaaaattgccagcaaatcaccagaagtcagggggcgaagcgaatagcagattcttttcagtagcaactgactctgctaacaccttggtctggaacttctagtgtgtaaaagtgtgagacaacacatttctgttgtttaagacacacaatctgtggtactttgatacagcagccctgacaaactaatacatggggtgtctcattgtagttttaatcagtaacacccattatgaactgaaaacgtctgctacttttaaggtttgtcagtttttactttccatattttaaatctacatattagatgtatactaatttgctatatctttccttctattatttgaaaatagccaacttatttctagtatgtttcctgccttaaagtttatattctgatattagaagaatcacagtagctttggttaatatttgcatgtatacctcatttactaataagttttctatgttcttatattgaaagtgtgtccattgtatacagcatatcattgttttttaatctgtccttaaattgaagtagttagttcttgcccatttaatattattactttgatatttgtgctgaattctaccatctatttgtcctatctgttctttgttctttttctctctttcttgccatttattgttttcttattttattctaccactccattagctttcttttttcttttattttttgagactcagtctcactcttgttgcccaggctggagtgcaatggcatgatctctgcttactgcaacctctgcctccaaggttcaagcgattctcctgcctcaccctcccaagtagctgggactacaggcatgcgccaccacacctggctaattttgtatttttgctagagatggggttttaccatgttagtcaggctggtctcatctcctgacctcaggtgatccacctgccttggtctgccaaagtgctgagattataggcatgagccaccatgcccggccctctattagctttttatatttacactttatattattattttagtagtgacacttaaagcttataatatgtgttcttattagagtctactataaattattccttttattattttctagataatgcaaagactttcaaataatttaatttcacttattcccttccttttgcattatagttatgtattttaattctatgtaaaatttaagtcctgcagatattatttttactattattatgacatttacccatacatttttcagttctcctccatcatgtgtgcatttttttattatctttatgatcatttccatctgcctgaatcacttattctaatatttcttttctatttgttttttttctggtgaaatagtctctcagattttgtttgtctgaaagtttattaattctctctttactattgatggacatacttcaaagtaagttagtttgattcagcattttaaggtaataattccattttcctctagcattatttagttgagcaatatcagttatattatgttgcgccattgaaattattgtggagtttactctggcagattctaagattttggggtgtgggaaatcatggttttcagtagctctattgtaatgtgtttagacgtgtttttatttccgcttttatttttaatctcacttggggtccatcgagaaccttgagtctgtggtttatcatttcaattattttctttttatgtctccaccagtatcttttcaaatattgcttctttcttattgtctcttacctcaccatgtccaatatgtctctagtgatgttttatatcattcgtcctttttgtttcttgtcatatgtgggctagatgttttcaagtgatcttttatttcactaaactctcttctactgttaaaccacctattgtgttctcaatttaagtctttatacttttcacttcttcaaatttccatttgattatttgttaaacatattgattccaactatattaaattctccattttctcacttatattccttacatattttttaataaacactgtcagggtcaactatggatatgtttcttttttctgattttatcatcgtggttttcctcattttggccattatctgacatgtctgaatttttcttttattggctctcacataatatgattgaaaaattgcagaggctctgaatgtcaacttcttcttaaaaggacttttatgtttttctgaagttataataagggcagatcaacttaattccaattaaagattgagataaatcaatgctagatttcaattttaacatttcaaaataaagcttaggaatctccttcactatagtaaccattttactacctatatgtgttctgtaatatgttctaaacctcaaatatacataataaaatttatttttaacattaatagacataataaatagcctgatctgtttaagtttaccctagtcctacggtgtgttttatcagagacctcaaattaaagcatatttggtggttatgacctttgattttttttactgtattatcatgagattacaacagttctctttctagatttattaccctttggcttcagctttctgttcaatttttagattataattccatccttcttggaagtccacaaatgtctctagaggagtattgtataaatggtcagtcttacttattttattattactatgttttacacattctttgctcctgaaggcccggcagttttggcacctctaaattccaatccccaccaccaccccactccgttccctgcttctctgttagatagaggaaaaacagaagagaatgacagttttactatttccttacatttttcttttttccaagatcataacctctcaagtcttgtccctcttaattggtttctactgttttcaaatagctctttattaccatttattgatttatctatcctttctatttcttcttagtggaagattggtctgacttaatatgctccaatctatcagaagtagaagttcttcaaattagttggtgtcctttctgtctgtgccaatccacagtactagcaaaacatttgtatatgaatctggaagctgaacatgtatcagcctcacatctctctacttaactccttttgtggatagaatgatctcatttcaaaagaaaggtcctagatctttctttggatttagataataaggaatatgagaggaatgcccacatcccacagtcttattattattagctgctccattcaaagcagaatgaatttctgcccgaagaaggacatttattgtcctcccctcagagttttgcctctttctccccgcccccccccaaaccggtctgcagcaaagcaaaggatttccttaatattctttactatataaggaaattttatattatacatgttaattgtctctctgagtcagttctgaagtgtagcttttcctccgagttttccttagcctattccattgaggttttcagacctcagaaaatgggatgtgagttggttagcatcacattttggctatataatcagctgctgctgatagttactgattcattctaacaactggttaccctacacttgaatcccaaaagctaggcaagtgcttgtgggtggcagcaacagttctccacttaattttattaaacacaccgttttttaaaaatgaacgtgacaatgctctcaataataaaaaataaatccagttttctttgcactagttggatttgtaaatagggagtatttggtttttttctagacttaggtttatattttgatagtctaagacatattatgtggtcgtgatatttctgcaaatatgtgcccatcaaaaattccatcgtcacacctgtagttaagagtgatcaaatatttaaactgatctgtttatgaggtaaagacaaataaagcattaattcaaacgtttcctcctcagaacaaaatacttcttttttttttcatttttaaagttagatctctttccataaatctgtttccaagcaatgtatgcactgactttaaaactgtgtagaaatcttcttgacctaaacaataaatggctagaaatcagtgttgactgcttcttagcaacaaattaaatgttagtaggttcttgatattcacatggtctcttcacttcagaaaactattcattaaggtcagggttaattcacacttcagataataagagacccctagtcactgttgagaattattcctgtaaatgtcaccagatcagtcataggaaacaagctatttatgatctcattcacagctatttatcagatagagttgtgtgtgatcataatgaatcatggcagtttttttttcctcagagctacactctaatcagcaattgccagatactaatataacatttggtatagggccaactgggtaattcctctcctttagatctatctatatgtgaaacatttcacgtggtgagctgaggcataataaaatctaattggataaaaatacttcagaaaggaaactacaaagtggtatcccatgggtaaaatctacctgtgtgctaagacattcattgtgtggtcacatgcaaacttccttctggggtccatctttggtccattaattcccaaatttcaattcaactgaacagcaatgcactgaaaacaacctgcagtttcctggggcccccaaataaagtgaagtcaaacaactcaattttgataatggaaaagcactttcgtgcttcgaagtaatgcatcaaatgaagtgttacaagaaatccattgtgagtctgtctactctccgatgagacgtacgtagaaaactatttttaaccaatcactttcacatgcattcaagcccgttccattagaactaatgtactttccaagacctgacaaagataaaagtaatttctgacattgtttatcaaaaatgtaaattatagaaacctaaaaaaaatcttaagaataaaacagcactaaacgttaatattggagaatgtaatatatactactttcttatctaaattaagccttaaaagaagtgaagatgaaaacagagattcatgcctacccttgaaccattaatgtaatgtagaaacacccattacatttgatgtaatgcttgcacatatcaactcttggataataggaaatgtaaatacaactaataagtattttaatatccaaaattttccttaaaagctttggttatattttccttaatattttcttctttttttttttttttcttgagacggagtcttgctctgtcacccaggctggagtgcagtgcagtggggcaatctcggctcactgcaagctctgcctccagggttcacgccattctcctgcctcagcctcccgagtagctgggactacaggcgcctgccaccacgcccggctaattttttgtatttttagtagaaacagggtttcaccatgttagccaggatggtcttgatctcctgacctcgtgatccgcccgcctcggcctcccaaagtgctgcgattacaggcgtgagccacagcacctggcctttttcttctttaaacaacaaaagtggattgattatttttagcaaaaaaaagcccacgtattatcttaagtgaaacaattcagaaacaaagtcaaatacctcatgctttcacttacaagtgggcaataaataatgtgtccaggtgaacacagagtatgcagtgatagtcattggagtctcagaagggtgggaggctgggagggtggcgaaagatgagaaattacttaatgggtacaatgtacatcattcaggggatgggtacactaaaacccagacttcaccaccacaaatatatccatgtaagaaaaccgcacttgaaccctttaaatttaaaacaaaaaaatacctttacctatatctttttccaatcatgtatttttttccttcaacaacaacaataataaaaatagaacggtctctaagaatagaatctaacatattcctctttgaaattattctttctcgggtatattaaggtacttctcttttgaaattattctttcttgggcatattaaggtacttctcttttgaaattatcctttgtcgggtatattaaggtacttctcaacatttagatgatttatttttaaatatagtattttttctaacaaacctgcaatatggagtgtcttttcttgttattcaaataaaacatttttctgcacataacagctgcagcaatttacactgttcctgataatattaccagctaaaattattaatgaactagtttggtttataggggaaaatccttatatcattcctgcataaaatcaccatataatttctttaactatacagtgttacaaaaataaaattgctggggcactggaataaaattaaaatgatataaaccaaagatgaactgccataaaaatgatataccatgtttctctgaatcatactgagaatgttccattaaaagtctgacaaaaatatctacatggagacatctttagtataagcagaatgtataattaataggttcacataaataagtctcaattcaaaaactcaagattactccccaaatgggatattcaccctataatatggagatacctgtttctgtattttaattagaaaagaatggaaaaaaaacagtaacaattctagccaaatacttatgctacttactgaccattgtaacacatataacattttaggttagtaaaagtgaaagctaaaaaccccagaataaaggcatttcatatgaaagaaagatatattaccttttatttcatgttggcttgcttcccgtcttctttctagttcttttctgtcataattcaacctctttaagcacataattccatattgtaaacttgttcttttttttttattaaaaaaaaaaaaacacagtgagtctaccttagcaggtggagaaagttttgtgattagccatagtcaacactatgcactgcttcttagggcaacaagttaataaattacatttgcagccaaatccttcagtattggagggaaatacatttataattattctaagcacaaaatgtttcgaagtaatagaaaaaaagttttcaaaataagaaaaaacagttttaaaatcatcatggattatattgttcatctatgtgtctttgtctttcatttagctattcctacattaggtgcaggcaaattaatattttattcacttgaaaagaatttaaagtccccattatggagacagtaaggaatttataagaaatggatactctcttcttaagctgatgagaaaaataacacaaaacataagtaagtgaggtaatagaagaccaaatactaaaatgagtagctcataactctaaatgatacagaagtatgtaagaagaaccagtcagcagatattgaaactgaatgaaaaggatatgtggaatgagcagaaaattgattgatccttaaagtatcaagtagcagagacaggttgactcaggaaaatggagcatcatgaacaaaagattgcagatggaaatttaaaggtgtggttagcgagacacacattccagggctgaaaacccatgctaggaagtaaggaggaatacaattatacatggagaaaagggcatattaaggaaagccttaaattgtgtttaagtatgaaatacatataattgatacagaattattggacaattttcggaggaggaagaggtgacaataaagttttctgtttggccaggcatggtggctcacgcctgtaatcacagcactttgggaggctgaggtgggtggatcacgtggtcaggagttcgagaccagcttggtcaatatggtgaaaccccgtctctactaaaagtacaaaaattagctggctgtggtggcacatgcctgtagtcccagctactcgggaggctgaggcagaagaatcgcttgagcccgggaggcggaggttgaagtagcccagatcgtgccaccgcactccaccctgggcaacagagtgagactccatctccaaaaaaaaaaaaaaagttttctgtttaaggaaaagtaatctcatagcaaaataggagatggagaaataagtaatcagagaagatagagaaatcaattcagggttcagttctgccaaaatagggacaacagccatgagcttgaaaggaaaatcgataaaccaggcatgttctgagagagaaaatgagaaggtttagtgacattatgtataaagatgcagaagatgtgataggaaaaaataatctgtagacttcaagagtaaagatcattgattatcagtgatactttacatgtttaggaatataagcaaatttagacatacacattggccagattacacttacttgctagatgcatttctaagccccgcattttaataaaaacaatgttgagtcaaatatttcagaatcagagaaaaatggaaagaaaattgcattaggcaggtgttgtgggttgaattgtgttccctaaaatttacgtgtggaagcgctaattctcagtacttcagaatgtgattgcatttggagatagtgcccttaaagaggtaattgagttaaatgaggccattaaggtgggccctaatccaaactgactggtgaccttattaaaaagagatttggacacttggtgacaacaggtatatatattcacagagaaaggattatttgaggacaccaagaggtgaccatcagcaagcccaggagagaggcctcagaagaaaccagacctgctgattccttgatcttgaacttctagcctccggaactgtgagaaaatgaattctgttgtttatgacacccatctgtggtcttttgctgtggcatccctagcaaactaattcagtgatatactagataatactgatataatcactatcacagatattgggcagcttgagattaaaccaatgcttcttggtcagtttctgccaagttttgatatagaatacaaaattatactatacagaggacatataatattatgaaaatgtctgtcagatggaaaactgtgccgaaaagaccataggatgcaatatacagtcaggtactacttgctttaagttggagattagcataacttaaaaatgaagcttgggcatttcccagaacaaacaaaaaccaagtcatttgagtattttttttaatttgatcattatagaaaacattttactaaagtaataaaacagtattaaaagtcaatctagtgaagaacggaaaaaccggaccccaaaaatctaatgcaaacgtgaaatatgaagccctaaacttcccgtgacagggagctcactcactacctcacaatgtatacactacaaggcagctgagagtggtacaaagttgtttcttctattaactagaagtcactcacctaggatctacatctgtgttaactaaaaaatgaggtgctcaacagagaaaaaataattcttctatcacataataatgatcttaaaacctaagaaaacttacttatttaaagtcttccttcatccaatttaaatgtatttaattacttcaactttaccactggacttctaccaccttataacaatttgatacccacaaataaatgcaatttctttttgttatgtcactgtatggtagcacttttgttgtctcagccaataaacacagtctaaacatgccttgtcaagccattaaccaaaatggagagtttcgtgctaaggataaattccttatctttttcacacaactttctgttaaattatggattctccatccagcactttaatgggttttttaaaaaacactgttatatttatctttaccacatttaattcaacagtgtcaacaactgcattaaaattcaaaatatcaccataagttggaagcaaaagccccaattatcctctatttatcctaattttatgtcatcaacatatctaatttttataccatcttcactccagccactgattaaatgttggacaggagagaagcaaatacagtctcccaagccaaaatcatctatggttatatttattaacttatcaccacaatcaactttatgtgaaaaaaacaaccaaaatccagctgacattgcttcacctaacataaacatagcatttatgatatggtattataacagacccctttttatctgctggatggtaaacaacttgaaaaaaagacattgccttttgttcaactgcatcctcacagttatctaacacagtattgtttttgttctgaaattaatatacaaataagcaaactcataaaaagacatagaaaaataaaaaaacacaaatatgtcttagaagaacaatttcttctcaaaattttccctagaatgttcctaaattataaaatttataaccacatatttgtgtagagttgaaactatgaatttgtttattcttcctaattttctaatataaacacatataactataaaattaccaacatggaattttcaaagaatctcacaaaaaaatagatgtatgctctatgaggagaattttgtacacatatatttccataaactttgggcacataatatgcacatagctctaaattagaaagtccctgcaatttgctggatgaaaacatttttccaagtagatgtatacaaacgatgtttcaaatgacatatattttctgtcttctagacgtccatttttgttttactaaagtataggtaatatattgtttcattttaattattctttggggaaaaaaaagaaaaaacacctaccgatggaaactatccaccatttttaaatggacacggagatctttttttgttaggtgatctaacattcttgcatctaccaagcattccataaagtaacttctgtactgaggtaaccccaagctgggaagccattcatttccaatccactcatgattcatatctccataagccagggtctgtagaaaaaccggacactagaattgttttatagcagtcaagtttcttaaccaatcagataagatggtaattggataatattacctattattataactgatatttaattactatgatatgtggaaacaaagcaaaaataatattcagatagcatttgattcgatttggtataaaatggaactctgcatacatttattaaagcatctgcctattgaaaatgattggctatttactttgtattctcaaaaggaattacattttgtccaagtatgtattttattaataaagaaattattatacaaactctgagctttaagattctgtctttaaattgataggtttgttttatttgtatctgtcatttccctcttgtcaatgcacttattgccatttcccacttatcaatgccactactaccattgctatattgtaatggcaaatgttgatgtgaaatgggaacctcagtaaacagagaaaggaataaatgttttggagagacagaattttgaagctttttatggacattgttgttacttagcaaagcaggtcgtcagctttccaaaaaatcattggaaagaatcagtcttttctagaaattaatcaagatagactctaaaagaagcaggacaggatcaaaaactaagacagataacctaattctttaatataacaaacaaactattcttaccaatactgttcaaaacagctaaaatgaaaacccaaatcaaccattaccactaaaccaatattttaaaagaactattactctctattatttttacagaattcccatttagttccttatcatgccctaatttctcaattctaatatgcatttctagggaaaatctaactgttcctcttcttttgtgtgttctcaagaacaatgaaatttttatcaaaatcaaaatcaaatacaatcctactgtgtgtttaaatacaggtcctaatgtaactaccaaattttttcttatattgaaaggtttcaatcagattgaatataacacaaattttctcttttggtcatccaaaatgtggaaatgtagaaaaaatgcacagcttccttgcaaaagtatatgtctgttccaagtatagacacctgtctcatacaaacatctcaataaatgctagtgactctgtggtctgcaacgccaacacttgctcctccaacctctcttcatacactttgcattatatctgaaggcatgtgcaactccaaataagtcttttctttctttttgttccccctttagatccaacttgaatgcttcctgattaaatatatacaggagtgatttcagaggaatttaagttttggatcattcttttgagaaagaaagaaaagtacccttttaaaagaggtaaggtatgaaacgtcaatcatcttattttaaaaatatggtaacttaaaaagacatataaagtattaaacataatctacatttacctatacacatcagcctaatattgagctaagtgaaggtttacaatattatgacttatgacagtttcttgatttatattctcattgcctactaaatgatattaagggtcttaaagcatatgaatctcctacctgggcccagcttccttcctcagattctttctgtgttagcagcaggaaatgattaataaagcaggtaaatataaattaatttcaaatcaatacagtaaaatttttctagcagaagcaaaattgttatacaaaatattttgtataacaggtagaataaacacacagattcatagacccacagtgatcaattttgcagttcaaaggcaattaggcagcaactacatcattttcaattaattctaatttaaatgttaaattcataattttgtgaacatttgatttggtcattacaaacctttttttaattcttaaatgagtgtaatttttaaaatgtaatgtgctataataaaaacttctgatgacaaatatatatatgtatatatgatagagaaatcttatacaaagtaaattagtgaagtgaaaaaactgtatccctccaacaaagctttgtgataatcaaatcgatttcaacaacagccaacaaaacaaaacaagacaaaaaccaagtacaacaaaactaaactaaaaatgaaattagtacatgacattggtgtttttatccttaacaaacttgtagataatcaattttcaaataaggataacactgaaaagacattaaattaaaaagaagttgataaagataaaatatatgatatgcccaactttgttactttacatgaaaaaatgatttttatagcattttatttttaaaagtgacaaagagtccccaagaaattctttaaaattgtgcttttcagtaccaaattaacataacacttttttggttttttgggggtttttttggtcaagcttgtatctaagatggtaaagcacaagaaaccacatgatcatattaaaaatgaatattcaatctaatcttttctattaccaatttaatttggtttagaaacatgttacctgtgaatatgtccaatactaaatatttgttacaaaaacttccaatgttgcaacatgaatactatttattactttcttccttattgtttgtgtactataagctcttatgatattagccacaatctaacactatttcattaaaaaatttcaagagagtgcagtaaaagaaaactgtaaaaaatgttagttatcattgcatgtaactataaaaacacaccctattactctggtctattgtaaacagattagtttcctcatccaaagagcagcaaagtcactttccttcaggttcaacaaagccattaagactaaccgtttttgctggagctgcaagattttccatttcttcatgagtcacccaaacgttgcctgaaggctagtgaggaggcccagagggaagcagaggaatccatgggaggcaagcagtggtaaagaagaaaggcagcacctctgtgagttaacagcaacacagcaataccacagtgcccttgcccctaccgtgtgcatgaaagagacagcatggctggtttgctcagagctccctgtttcttctactcaaaaagattaactagaaagaggcattctgtgaagctcttggggatgtagatttaaaatgacatttctgcaattattaatcagaaaaagagcatcatcaaaatttgcatttcaatggtatgtggctatcagatcaatttttgtaataacggtgaactgattaaatttgaactgtagaataatgtaattttaattttttactcagaaaacaatggcacatgcactttgttgtgttattatcaaaatttccttcacataattttgattctcgatatcctttgaaggaaaaaaaatggttgtcaatataaagcgggaagcattatcgtaacttatctggaaaccagcatcagcttttcccaaaagattccttttactgtgtgtgattcagtaaatagtaagtgtccctgaattcttgcagctgagaaagaagtgaaatgctatttttaatttaataaaatgtattttttagccacactaataactgtcaaattataaaatccatatatttcctaattctccaccagtatctgataccattatagagaagaacatagtgtaaaataattttttttctctagcaggcaatattctattataaagtcccatttgctttctaaataaaacaccccttggtattagttctatacacttaataacgtacagtttcgaaaccaaagtccacttagtaacatacagatcaggcatatcattgaaggtattggcccctggaaaccacttgccatcaaattccatcatttctttatgaacattgcaaggttttccaagcacatcaatgaaatttacatcctatatattatctgctacttgttttggggagggtccaatctttaaagaattggtgtagcaaagttgttacccaaacattacaagtcatcaccataattcactttgggtttttctgccattcacctagtaccataacttttcctgtattaaaaacaaatgtaactacatataaattgatgagtataatttgatgtaagtgaaatcttatatatgtatatacatacatatatacagtcatgcactacataccgacattgtagtcaagaatggggtgcatgcacaacaaatggtctcatatgattataatggagctgaaaagttcctgtcacctagtgatatcagagccattataccatcgtagtgcaatgcattattcacatgtttgtggtaatgctagtgtaaacaaacctattgcactgccagtcgtctaaaagtatagcacgtgcaactatgtgcagcccataacccttgataatcatcattaatgactgggttattggtttatgtatttaccacaccatgatttttaaatcattattttacagtgtactccctctacttttgttttttaaagagttaactgtaaaatagccccaagtaggttccttgggaggcatctcaaaagaaggcattgatatcctaggagatgacagctccatgtgtgttactgccccaatgacttttcagtggaacagaatatggagatgaaagacagtgatactgatggtcccgatcctgtgtaggcctatagtgatttttgtgtttgtgtcttagtttgtaacgaaaaagcttaaagaggggaaaaaataatgaaatagcagaaagcttataggacaaggatataaagaaagatattaattttgttcagctgtacaatgtatttgtgttttaagctaagtattattttaaaaagagtcaaaagttaacaaaaaaaaagatttataaattacaaatgttaccataagctaaggctaatttattactgaggaaataaaaaggtttttttatgaattgtgtgtagtataaagtatagtgtttataaagtctacagtagtatatagtaatgtcctaggccttcgtattcactaagtgccctattcacgtgtaccattttttatcttttatactatatttttactgtaccttttctatgtttagacatatttggatacacaaatacttaccacagtgttacatttgcctacagtattcagcttagtatcatgctgtgcaggtttgtaccctggagcaataagttataccacatagcctaggtgtgcagtagtctataccatttaggtttatgtaagtatgctctatggtactctcaaaacgaagaaattgtttcatgactcatttctcagaacatatatctgcattaagtgatatttgattgtatatatacttaagtaacaaatggaaatgggtggtaaagattcataattataagcaaattcgaggcacataaaaattccacaggctagacatcaaatatatgtatagaatttattttcttctactgttttggaatttagagtacagatgatgttttttctataagataaatctgtgtacacctattaaataaatttagaatataaaagtcatttatgtccttaaaagtcccttccttgtattccctgcttctaacaatgatgctcattataaacagaaagttgcatatgagtatataaatcattacattacttggaataaattgtttttattgactttaggaggagagtgctgtgctgaaaagtactttacatgcatctgtcacattccctttacactgagttatcgtggtgctttcttgagtgggtatactgttggttcaaagtgagtttcagcaatgattacctgagaagaaattcatttaagccaatcttaaatggcttaagcttgcagaacagtgtaaaatcaattttacactgatttgtgtagcttctgctttgaatcgtaatccaaataatgaagatctcattacttctttaagaaactacctgtattaattatctcatactagaatagatacatgcatagtatctttcacagattatctttaagtctgtgtctgccagtctgtcaccatattctgggatgtggaacatgctggaagctatggttttatctgtttcattcctcacaaaataagcatatacccaggacaattttctgaagtatgactggcaaactttcagaagttgtatgttagttgtttctgtttgatatgcagttttacttgtgaagaccactgccagccctatagtcttgtaaaaagccgacagaaatagtttctacacaacctagtcaagtagacattaactgaagttttaacaagtttattttataggcaagctcatatgtagtaagtcaattattcaatcagattgctctctctccaccaccactttaggggatggaacttgcatctaagtacattgtgacggagtaatttacagcatgagagtttcagagcaaagcatccctacaagatagctagattgggaaactgagcaatcaaagggcataaagatatgagtaccttgggattgaggatacagtacaaaaagtaggttggaaaagcataagaaacaaatattgtataacttggttgtggttctctgagatccccttaaaattatctactcactgcccttggtagtctgtgctgcaatctcccccaaaaatgtgcgagctagaaaatgcaaaccaatagtcatttttttgtggctaatatcatctgagtctaacatgaaatttataaaatttcaattatattatcaaattagaatcaaggggcttgagttatacagtagcacttactaatgactactctaggacatttcctaagcctgtctaaatttcaggttctgcacttcttaagtgggactaaaagtgcatgctccagaatagaaagaaacactaaaaagtttacattatgatacaacatgttcttatacagggctgggactaggatgaggcacatgaggtcctgggaggctataatttaaggaaacattcactttcagggttgatatctgacaatgagagcctctttaaattttatgcttgagattatcttgcttgtctccccttagtacccatggaatagaactttgagaaagtatcaagggagaaggagaaggaaatttctaaaaaatgatcagaattaaagaacttacctaatgaaatcattctggaaagagttaagacagaaaaataaatattacaatgaacttaagaaataacttgtgaaaattaatcaggtgaaaataatgagtagtcttgctgtcagagatacagtataagtaaagcagccagacctcagaataatcctaaatcttacctagttaaagtaacttttgttactacctaggtcatttaaagtgttttttactttgtaatggaattacaaagtagtaacttgaaattacttttcacattcaaatggcctggatccacatttctcccttatctgaatttttgtctctcattataagataaatccttctcattataataagaatgatatttacacctcactctcttttcaataaaggttaaggtttataaaggcaattataccacaccctcttttcaataaaggttggggcttatgaggtaagtaataatgaaaagaggaatcaaacagactaaaagaatgctataaaaagaaggaaaactgatagagtgcaggaagcagaagcaggagaatgtgcttgttaggagaaaacccacataggagtatgaccttaggtgagtcagtttacttctttacattagttttgcccatttgtgaaacagctataataaaagtacctttctcatagctgtagttgtgagagtcaaatgggctattacatgtaaagcgcttagaacagtccctgacagtgagcattctgctgatgttggctactactgtaattatattagatattctgttaggtagtctccattcaagcaaatctttaattcaagaaatactctgtaggtctctgtattacactgagctgactaatgcctatcttacaccttacatttatgtttaatcttgttgaattatatggttatcaaaaatcactttgtttaaaacttatttatttccactgcacttgcttttaaaatgtttaattcatcaacttaaataaatgttacataaagcaaaatataaaacaaatttggctcctatataaacactaagttgaattagttggaaaaaccagagataggcaaatcttgaatgaaacacactatcaataaaatacaattttgtcaaagtctggggaaggcattgtaaatgtccagaaggattcctcattcaaatggctttttgagttatcttgaagtcgtcactttaaaaagaaacaccaactagagaaattaaacatgtttccagataagattatctaaaaggataatgtggaactccagacattggaaacatacacaaaaatagttttaggtgctccatctaaatttgcaattctttaacatttctgtaatttttacctgagataaagtattcaaagaatgcacttatttttgttacatccttcttcaaccaaatttcaattaactggtatctccatctctatcctactaggtaagagactttctgtagtaatagtagcttggagaaaagaaacagaaagctggaaatttagggctggctcaaggtaatcatatatgtgacatttaaattttcctttttgatggtccagcccattatatctaggcaggaaaggaggctgaatcaaataaagtagtagaataaataaataaataaaagttaaaaataaaaaagccccgaagcccaagtaccttgtctttttctcctcagaacttcagttaataaacacgaaatacctggctgaggaacccaagcccaaacctcagtgtgcaaaataacttgtataatctaaacaaactgtagtgttcttgaagacatgatagaataactttgttaaaaaaaaaaaatctgcctttgtgttttgtaagtgtgaattctaatacataatgttaggttatgactttatgtagtggattcattaatagtgatttatgtggaattttcatttgcaatgcaaattgtattggaaatatattagaaatgagtaaatgctaccatgtagagtgagtagaaggaagaggaaacatttagtagatacttttaaagcctagagacacaacttaacttgtctcatagaatttgcatcagtatctggcaagaggtacatatattccgtgaatacagagctattacacattagtaaaaagatatatattcctataataataaagataagttgggaaggttatgaatagaaaattaatataaataccagattaataagaatataaaaatttgcacatttagtagtgatttttaaaatgtaaattaagcaaggagataaccaatgttgacaaagggagaaaaaatagcaacacaacacaatttaacaattaaagtttaaaagtattaagaatatgcattccgtatacacaaatatagcaatggaaataaccacagtttatgcaacaacataattacaagcacatattttacacacaacaacaaattgtgttacacaaaacaaagaaaatgtccaatactaggaatttgattaaataacttatcacatttctacaaaggacatattcaataactaaaagtgatgttgcagttgcatatttaataaaatgaagaaaatgcttacactacattactaaatttacaaaaaagtacaaattaatatattatgtgaaataatccatttatataaaaagataatgaaaaaagaatgacaagatcttcatcaaatgttttcaatagtgaaaaaattaacattgattatctctaaaatcagtattttttaatgtttttaaattattttgttgtcatctttgtatttttctgtattttacaaatgttatacaggatcatgtattagttcaataaacatataaaacttaaatgctataaacaatatattttttatgtttcaaatgttcatttttgtctgaagccttatccagcttgtagtgatttctcctttcttgaagctccatcacacttcacttctattgcacattttggagttaatctatataatcctgtactaaatctaccagtcaacatgcttattttccttagtagagtttccctttctgatctcaaggccacacgtttcttatacttcagcagagtatatgaaatatgtgggtagagtgatctatacaatgattattttaaggtgaatatttacataatatctaaaatttgccaggcactattgctaaggcttggggttgatggaaacctgatgctatctttatttcgtctagtgtgagataaatgaagaaaagaagaactgtaaaatgttgtttataagtacatggagtggtaactcaggaaggaaaccaaacccaggctttgggggctcagcaaaagcttttcagaggaaatatgtaaaggaatcgataaatgaataatgaattggagaaaatatgatgactttgaagtaggatgaaagttttgggcaaagggaagaccaactacaaaagctcataactgaccaaaaggaaagatgtttgaaaaactgaaagtagttcctgacctgggaaataaagccttcgaggtgaactgaggctagatcataaagctttctttacttctccccattctttaaacaattgaatgttaattaatatggtataatttaaattccttcaggttggttaaatagttttagaaaaatggttttaaaattccctattgttcattaagaaatgaattacactggtaaataaaaataataaaatgtatcatatttttcatctggaagttgggacttcaaatttatttttgcaagattcataatgtttaataattttgtttgcatttgctcttgggaggaaaatgtggatataaactatttatgatgcttctctctcagctggaaattactcagcaaactcttcatcagacttaaattaaatttacaataactattttaatggtcttctcagtttcttattttaaatatacaggtggctcttgaacaacacaggtttgaactgcatcattccacttatacacagactttcttctgccactgccactcctgagacaacatgaccaatctctccccttcctcctcctcagcgtactttcaacataaagacgacgaggataaaggcatttatgatgaactacttccacataatgaatagtaaatataatttctcttccctatgattttcttaataatattttcttttctctagcttactttattgtacgaatggagcatatatgtgtacatataaaacacataatacatgcttatcaactatttgtgttatcagtaaggcttccagtcaacagtaggctcttagtagttaagtcttgggagagccaaaaattctagctgattttttgactgtgtgtggggggtcagcacccttaactcctatcttattcaaggggctattgtattctaaattgtcttttagcttgagtcataatccaggtatagtgaaaaacatttgtgtctatttaaaaataatataggtaagaattttaaaaattatatatttttcctacatgtcatttaggaagaacttaaaatggagttatgtaagaattatataagccttttaaatttgaccttttatttctggcattagaatctagtatactgggaaggaaaatgtgtaaatagaaatgaaacaaactattcacaactgtttaagatcatgtataaaaaagttatacttgttacttttctgcctgaaaactgcaataaagtaataagactttttaatattttacctattgctaaaatttatctcattctcccatattttattatgctatataagatatgagatttgggaaatctagtaattatcagaaataatatactttataaacaaaatatataatttaggaatggaataaacaaataattaaatactatttgggagtttttgggaatttgtcgtcatgcatgccttttttgtcacattttgttcttttctaggattaggataggtaaaaaattatgagatgactaggaatttataactgaaaaacaaacagactttgaaagaaaaagatattccagatattccatttggtatctgtaaaacgtcaaactcacataatttcataattacagaaacttcttaagaaatagtgagttacaaaagaacacatacaagtgtccaacaaacatataaaaaagctcaatatcactaatcatcagatatatgcaattaaaaccaagtgagataccatcccacctcagtcagaatggctattactaaaaagttaagaaaaaaaaaagatgtcggcaagggcacagagaaaagggaacacttatacactgttggtgggaatgtaaattaatacaacctctatggaagacagtatggagatttctcaaagaactaaaaatagaatgagcattcaactaagtaatctcgctacttagtacctacccaaaggaaaagcaattgttatatcaaaataattcctgcactcatgtctttatcacaacattaatcataatagcaaaatcatggaatgaatctaagtgtccatcagtggatgattggataaataaaatgtatatacacaccatggaatactatgcagtcataaaaaagaataaactaatgtcttttgtagcaacataaatggaactggagaccattatcccaagtgaaataacttggaaacaaaaaaaaatcaaatacaacatgtcctcacttgtaagtgagagctaaacaatgggtacatgtggacaggtagaaggaaataacagacattggagactccaaaagggaagaggttggtagggatgaggtttgaaaaattacccattgggtacaacgttcactatttgggtgatgggcacactggaagccccaaaatctccattacataatatacccatgtaacgaactttcacatgtaccccctgaatctataaaaataaaaaatattaaaactaaaaaatgtagtcacttaagccttgcatctttagtaatcactaatgcttatatcttatcttctgagaaattacctgagggaaagagaaaggaaggaaggaagaagggaaggaaggaaggaaggtaggtaggaaggaaggaaggaaggaaggaaggaaggaaggaaggaaggaaggaaagaaggaaggaagggagggaggaagggagggaggaacaaaggaacgaaggaaggaaggaattgaaaaaagagtaagctcagggtcttgtcgcttgggagaaaaatctaaacttcagatgctagctcaaaagtctgctatgctagctttcacgtctgatatgaatcatagttcctcatttgaaaacctattaaaagtagcagcaaggttaataaagagcaagcttaatctcttgagaataattcaagctgacattgaaatgtgtgctgtcacaattttgctctgtagacttagacacacggctatttgcctagcactgaggaaggggaggagcagaaactgactcacagttcgagatgttggaggagctgaaggacttgttagggaaaccatctcctggattgctaatcgaagttttaagcgatgcagtggattgctgattccaatttctctctggatctcagtgtcagataaagcagacatgatggcaccactcttcacgttggctcggcaggctgccacgtaccacgcaggcattcccaaccaaagctgttagataggaaaaaatacactaacaaattataataatagttatcattttagtgtctcatatgctaggaattattttatgtatcttacatacatgacctcaccccacgagataaaatgttatcattattttccctagaggacatagatgcacaaagaaattaaatgatgtatttaaaaacaccagggaggcagggatagaaacaagatttgaaattgagacatgctagctccagagactctattttaactaattcatattactagtggtaaaagtaatggctgcatggcaccaagttcccctttgtatgtagggaccagaacggctacaagccacatttgataagggactcaattaatgtttgcttaatgagtggcttcaatttataatgcttctttggaattctgagtgaagagaaattctgtcacagaacgagacagctgtgccacatccagccatgtgatttcgatcaaagcatgcagtgtagctaagccacatttccacctaccttcctacaccatgtgaaagatgtgtgaacttaattagatgctatatatgaaaatgccttttagagagtgaaatgatgtgctaagaaagaagttaaaactcaaatcattgaaaaactaaagaaagcaacaaaattaataatgcatcagaaattagagattttaagactgggcacagtggctcatgcctgtaatctcagcactttgggaggccgaggtggaaggatcacatgaggtcaggagttcgagaccagcctggccaacttggtgaaacatcataatactaaaaatacaaaaattagctgagcatgatggcgagtgcctataactccagctactcgggaggctgaggcaggagaatcacttgaaactgagcagcagaggttgcagtgagctgagatcaggcctttagactccaggctggggacagaatgagactctgcctcaaaacgaaacaaaagaaaacaacaacaaaaaatgaggccaggcgcggtggctcacgcctgtaatcctagcactttgggaggctgagatgactggattgcctgagcttaggagttcaagaccagcctgggcaacatggtgaaactctgtctctactaaaactaaaacaaacaaacaaaaaaatcagccaggcgtggtggcagatgcctgtaattccagctacgggggaggctgaggcacgagaattgcttaaacccgggaggcagaggttgcagtgagctgagactgtgccactgcaatccagcctaggcaacaaagtgaaactctgtctcaaaaaagaaaagaaattagatattttgatttttcaactttgctgtgagactcttgaaagacaattaaaccagcagtgctatttacacagcacaggtctcgtgcacatctcaagcactgggtgaatgccaatcacgggcattatatttcagcacctgaataacatcacttaaaacaggaatattctcccattttccctccatcattagttatgagtaagaagtagaaaacacaacaaaaaattagcagcttacatatttgtttttgaatgtccaaaagattgactgatttttttttctatttgttgaaataaacagattgaacaaaggagagaattgtgagagtgagaaaaagtgagacaaagaagaaaaactataaatcagcaaaatacagtgccaagagctctggaccacaaatcagaagacctgagccctaattcctttccagtcattggtgagtcatgtaacccatctaaacctcagccatattttcctcatttgtaaaatgaaggaatcaagcttgattatttctctctacctcctgatatccgttcccttctataatctccttcttttgggggtaggattggcccagtgatttatttctaataaatagctgatgataaaagtgatgggatgtcactttccagtttaggcaataaaatgactgtggtttcattcctgctagtcccctcccgctgtctctttccctctgagctctcactctggagtaagtcagatctcaggagccctgtggagagtcccatatgacaaggaactaatgtttctggccaacagccagcaggaaactgaatcatgaccctgaccatatgaatgagcatggaagtggattctccccaagtctagccttgagatgactgctgccctggctgataccttgattgcagccctgtgagagactctgagcagaggccatcacaaagctattcccagactcctgacccatagaagtcatgagatcataaatgccaaatttgggggtaatttgtaaacagcaatagctaaccagtataaacatccttttagttgaaaaattctacaatattaaaagactatttgtctcttttgaaaaaaaaaatgccaacaacgaaactctttgagtcagtgtggactgggttgtgatagagataagagaaaagaaggggaagatctaagtacaatgtgtgactgtacagattatgctttcttccagcaggttaggcacaaataattgaccttgacaggtacattatatatgacagaagatagtacttgactatttagtttataaactcaaactgttcaaaataactaaacatctaaatatgtcttctttggaccctaatgatttttttacctttgtcttctaagatatttggatttccacactagttaacatcacccaaatgcctgccaatacattgttaccaatgtcatccataattagaccttaaagagtctttgatgcggataaatggcatgtgaagcatggaattctcgcctacacaaaattcttaacaggctgtgcactcaaggaggaacgaaaggagatgaagttaaagtttcattcattggatcactcagctcattcatcttgtttattccattttataatttaagttgcattaggaatcataggcaatttctgtgtactcagaataggtttaattagcacaaacttcactgtctgtcatctcctatcaccttaatgtcagtaaatctgtttcttttttctttttatctgaaggatttgttcgtcgcttgccaaaatagcagcgaactctctgtcaaactgcaactcattttatcggagcaaaaactgaacaaagaactgctatcatttctgaggtgtgatttcttaagcattttgtcttgtgattgattttttaaatatagtaattttaaagacacggttgaaagaagcagctgatcgctaatatctgatggctaatatgctaaatttccctgtctgatgtgaaagaataaagtaaaagcaaaatacaggcatttttcattcagtgcaagaaaaaatacaaagcgtgtttctagatctatctaagtctatttttaaaactaaaatgggctttaatgtttctttattatttatttacttagctctggctataataaaatgaagacggataattttataatccaagaccatttaaaacaacatgtataattacctctggcaggcaaggaaagcctggattcttctttgccctgacacaggcatatcctagcagctactagcagctcacatagagaactgaatagaaggggcagtgaacagtactgttaagtgacatgaaacagcccttcgtagtcaaatatgtagttccgtcaatgtcaaggtcagtttctgctgcctcctacactgttcagatattcccttatttttccagaacactatgttgtacaggaaatgctgaaaatagttcttcttttattgtagcattcagtttggacacagaagggaataaggtgtaagtcttctgtttaatcccaagtgtctaaacctagctggtccataggctttagagaactaggttcaggaactaaattacaggcaaaggaatgtctctctgtacatctaggtgatcttactaccttggattacagaagtgttgaatatggagagggtcttctctgtaacctgctaatgaggaagggccctggcctaatggatgggaatggatgttctcttgcaacaataaaattttgtttcttctcttgctctagaaatgaaaagggtgtgatttagagacacttccttttatcccactgcatgatttcttctactacgatcacaaaaaagtgtcagcataaaatcataaatttattccctagtaagcaaatagtcccttatgagcaattccagactaaggggatgctgtgatttcagaaacttgccgttacctgtctcaaaaaaattatcaacttagtagtgattgattcaagggcctcctagtttcattctcttacctctagccatgcgaccacagttggcccatcccactgggcaaaaggtaatccctttctccgagcttcttcaagaagttcatgcctgaagtatatagcaaagattattaggcaggtatatggaaaaatatggctgtgattatttttaatgataatattttaaaataaccaatcatcctttacaagattttttatgatacaatatagaataacagaattccttattcctttgagtaacacacacacatcatccattgattttattacgaatgaagcattgacatagaaaagtaattttccccaacatttattcatgaaaattagaacattaagtgctaatggaattagaagtggaattatattaccagcaaatatcttatccctttaatgagaaaatggcccaaatgttcatattcaagtatgcattatgggatctaaatgtggcttccaccatctgccctgccctctttgccttactatctccatggcaaagaaaatgcttatatagagaggcagaagataaatttggtccttttagtcacattctagtgatgtggttgattttagtatgccctgtgggtccagggatctatcttaggagttagttatttgtctagactataaaactacatctcacttggagaaaactccaaggtaaattgatttctaacactcgaaagcaatgtaaggtatcaaattcaatggtacacttgcttttatctataatcactactgttttaatgaaattaaaatatcttaataacaacaaatggttgttttgataacaaaagatgcaaaagaactctgaaaaatgcatctataatttcactgaccctcttactgatttttagaattgacatccacttacaaagccaatttgagatcactcattgttaagatagtagctatgtgctttcactgaaattcaaattgatatatacttggccaggaatatattggaaaatacattctctttactttagtatgccttgatcttacacatagatgataaaaacatggtataataattgctttattttgaatgcgtatgttttatgcttaggaatatttcatgaaaatcatttatgaactcccaaatggataatttgattattttctactattaatcaattagttactgtggtagactatattaatacattaagatatataatgaataaaatgcctttcaacacagagttttctgtgtttgtaatagatgcaaccaaaaattcattaaaaaaggtgcaaaatacaaatttaagttatagtggctgaagagacataaatcaactgctgtttcatttgaggggatagaagtgttaagttctgcatgtaagctattcagcacctgggaaagggaacagcgatactcgtgctctgaatctaaaaaagtagaggcacttcttcacctggcttgctctatcatcctccattccctcaggtctcccagtgacattcctttagtgaaaaccagtttcaaatagcttagcctcactgtgacagatatatatatatagaaatggattgaaggatcaaaaacaaataacctattaggtacttattgaacacctgttgtggactgagacttgtgtttggtgtggaaaatagatatgggtctaatttcccaggatatcctgttagatggacaaaacaaacacatgaaactgtctgaaaatacaatacaatacaatataatacaatacattacacaaacagctgctaacgtgaaaacttggtgatgtaccttgtgaagtatgtcattttagaaaaggggttaatagccattgaaggtgttgtgaaggcattgtggcaatggagctggcttcgaagggcaggtaggaaagaggtggggatggcattccaagcaggagaagcactaatggggaggtatggaacttaacatgaaatacgtggaagaaaatttagggtaggccttcacagagttaatgcatgttgtaagagttttaatgttacatccaatagggaaagcgacacttctagttatgtcataggtttgtgacattaaaagggaagaaataaatttacatttacaattagtttttgcttcacatagtaaaaaagcaagtaaatatgcactaataacctaaggagcacgtaacattttcagaagtgtattctatgagttgtacaaaagctatttttaaatattagaacgctttcattttgaaacttctgactagttccctaataaaaatcccactagaaaggccagagtgatccttttgagtctgatcatgtaacttttctgttcataactctccaatcacttcctgtctcactggaaataaaagccaaaacagctgctacaatctatcgtacccgcgccatctctctgactaaactcccatctcagtcagcaacactggcctccttgctgttctttggaaacaacccagacctcttttctgtctcaggatcttggcagctcacctggaatgctcttcccctctatctctacatggctaactctctcagctactttaaatctttactcaaatgtcacctgttctctgaatgtctcctcccttactccctgaaaactccaataaggaatttcttatccccattgtttgctttatttttctccaaggtattgcccttctaacatagtatattatttactcctcattctgtcatctgccaataaaatgtaagctcagggaggatctgtgttttcatatgctctgttcagagatgaatttgaagtctagaacaagatcaggcacagaagaggtgctaaataaatacgtgtaaatgttaaacaaaatgccaatcagtgtttatatttaggtgcttcttgtttcagtaaattgtgtcctataatgttttgtttttgtagtccaaatagctttttctattttaccttataaccatgtacaacattttgtattttaaagaacaaatttttttcttgcatcttacctcctcttgagcttttatttcccactttctcacaatagtactgattctagctgatcccaagagtctgatctatttgggattcctggtgagaatttggttaagaggcaacccaatgtgctcaaatagttctgttctatgaacagaagtattgataacacaattgtttgggaaattattgagcaatctggccactgaaaaagttttattttcttggtttttgttttgtttaaatcacaaactctaataacaggatgactttagtaatagcagtctaagaaaatgagataagggagctcaaatcctttggtttccaacagttagggcaaaatctctagcatctgtcttagggctgacatacttgagactgtggaaaaacggatcagatgggagggatggctaggttttacaccaggactgtgtgctacatgatggtaactccagatgtgcttttccttttgagagaagtaacaattatttaaaaaagaacagcattgaaatttacaaagcaatattgccttgcattattatttttaattataaaataatcggcaccatacaaaatttataaaaggcatatatctaggcatgttggtttgagagacaagcaatgctagaaaaataaagcaatgtgggcaatgctataatacttggaaataactgaatttaatacatgatgatatgctaatagattattaagggtagcactaattacataagggcatgcttattctcatcaagttttggagttactgtcagaaaaatagtgatctgaactgtataagaaatcctaaatgacaaactgatttggcacaaagaagtcttttggatatactgctgttctccgttcaacctgtcaatgtatgtaaagggatttagtctggaatggattttctttgtagccagaattcaactttttttaaaggtcaagtgacagttcatccagaaaaagaatgtgatcacttaccccagtacaaatttaactatgaaaattactctctttccctgttggcctgaagaataattttagtgtgtttttaaaaataatttcagtcaatcaaatatttgaccatcttttcccaaaggatcacccgtacatcactaaatttcggggcatacatttcaggtttaagattcagaatagattttagagggcatcagctgtacttccttttagaggaagtgtcaggcatggaggtgttatcacttgggtcaaaacacaaacaagaaaagtactaattgcaagaaacagttattttgagacagtacaacttctgaatcattgtgcattttcaagaaacactcttcaataaagaatgctgttagtatcttccataggcctcaggttctcctattattgatatcaataagttactgtgactagaaagtgatattttaggaggcccaacatgtggtgagcactcaggtctgtgaataatttgcaagtccgtatctaaatgtgcagagggaagtctgcacttgctatgcctgaactgaagacaggagcaaacaaagggtgtgcagtcaagaaatgacgagactcaaaaatttctagataaaagaccaataggttctagaaaatgtatataaattagaagcattggccaagctacagatttccaacttttaatgcagactaattaaccaggcgggtgcaactctggttgaatgactaaatccagatggaaatgcctggattttcattcttaggttttaagtttctccttagcgattgttgttgtggtctaattggtatacgagtagagtctctggctcccatctcttgcatttgcatgccatcacatgcctccctgccttatctccccacatactttgtcttgattttcatgattcaacaaaaatgcttcctttctatatccatccttctcttgccctggaggcattatctaccactttcatacataggccccatagtactaagcaattttctctatagtatcttttatgtttcattgaatttgttggttcacaagttgtgacccctgactccatgggcttgacagcagagactttgtacgctctgtgtctgagttgattagggggtcagtcatctgatttgtatagacctactatatgccaagttttgcagcaagcaaagaataaagccaactgaatctctgacctcaaagaccatacattccagtgaggaaggaagatttgtataaacacatatacacatacataaacaaaataagttgagccattgatatgtgttctacaggaggtaaaatagactaaggcagtaaagtaggcaatgcttatagtgttctgggaacatagatgtctataacgaggcaacatttgagtagaaacatgtacgttgaaaagtggcagggagtaggggtatggtgggaatgttttaagcagaaacatagtataaaattcctattaaaggagtggaattaaatgtttgagcaactgataaaagccaagaagggccagtgtgactggagtgaattgaaggacacgggagttggtggtggaggaagatgaaattggagacgtagacaagagaaaagcaagaacatgttgggctttgggagctgaagaggagtttattctaaacatagtaagaagccatcagagggtttaagcacaagaacataaaataatttgtacattataaaggcatttctggctgttgaggatagcacggacttgagtcaggccagagttgtgatctaaggatacaagttagaaggttgtttcaattttcaagcagaagataatggttgctttgtcctgagctgtggcagcagaaatggtgagaggttattggaatagggattcaggcacacagcatacattcaataaatcataactgaatgaatgaatgcatggcaaattaacttcttaccagctatgtgttttttggctatgtacttaatctctttgagacttaattttcccatatttgaagatgattataaattgatctcaatttataagaactaaataagataatacttacaaaagcacctagcagccaatatgtattcaatagataactaatttccgttctccaattttttcttattttcccaaagcaattcattgtgtgtgctaccatcagattaacctccttaaagtaaacatttattagcttactatataactcagtaaacatatttattagcttactatataactccaatttctataatggcttttaatttactattggaagaatggcctttaaggtcattcttgatctgcccctaaattgcatttccagatttacctactgtatctattctctctagctacaatggatactcaccattctttgcactttacctcttctgttctactgactttctctccatttggaatggcctttcctcaattcataccattcaaattttctctatcccttgagtgatgccactcatatcatgtgcaagactctggtaggccgttcaccgtatgtacacagccttatttccgctacactataatctcctgcaggcatgagccatgtctcaactatttaaaattacttattagacaatcctttccataaatagctatcctattggcaactatattggaatggtaaaacttgaatttgttagtgtttatatttgcaattctgaaaaatgaaattcattagttactcaaaaaagtcacagaccatagggaacagtatgtctcctcctcattcttcctactgtggatggtttatctctgtcagtgaaaagagactttattcacagacctctcactttagcatgctattctgggatgccaatttgtggtatgactgtccaaataccatacagcactgtcccctctgtcactcatgatggccatttcattcaccttctatttgatgcctgtcattttccccttcatactttctaatgtatcttcctttactttctattgtcactgctaccacagtttttttctcagcctttaattggtccttctctccaggcttcttacactgacattaaagaaaaaaaaaatctgcctggaagataaactttatggcagagtgggtgagaaagtggctcccaaaatcaaattgcttgagcttgattcctttgcctgtccttttgggctgcacatccataacaagtcactgtattttgctgtgattcagtttcctcatgtggaacatgaagctgataacccatctaatagggtttttacaaaggttttgtaagaaaatatgtgtaatatgattacaaaagtaactcacacaaaaggcaatggtcaataaatgtgagcttctttcttactgttttttgtttgtttgtttgtttgtttcgttgtttttttttttttttttttggcagagttttactctgtcttccaggctgcagtgcaggggcctgatctcggctcactgcaacctctgccttccaggttcaagtgattgtcctgcttcagcctcctgagtagctgtgattataggcacgtgccaccatgcctggctaaatttttgtatttttagtagagatggggtttcaccatgttagccagggtggtctcgaactcctggcctcaagtgatctgctcacgtcagcttcccaaagtgctggcattactgacatgagccactgtgcctggccaggttttactttaaataatcatagcactgtcctctaaagccccttcagtctttcctcaaatgtctaaaagattatttttaatcttcattacaaagagattcctggtttaatcttgatttaattatctaattacctttccttctaaccagaattgaaaagtactttcacagtttgtgcattaccaattccacctttgcaaataccacttcccagagctggtaagttgatcgctactttttcaactatcaacaaccttgtgtttacttaactcctggcttcccttttatatgaaatattttgtgatcagcccaatctacaattatcctcttctcctttaaaatctggaagcctgtagtgtcaatctcactcatagagatcactggttaccaccatgtgcccgcagcctcatctccaacccaagacagtaaaatcctggaaataagagtttgttcttcaaccgtatcatgcatctttctctggatgttctagtcaagaacatcttttgaatgactgctaaattgtaatccaaaaaactcacaatgttgacaatcacctaggatccttgattatagggcatttttaaagtattctatatttttataacttccaactgttcattgcatctcaaaaagaaataagaattctgcatcacagttacccaggttggctgcagaaaagattacaatgttatatctaacattcagaaagacattttctagactaactgaatactgccaaagcttttgtttaagccctcatcaattgatgatgatggtgatgggctcctagaatctctctatctctcatttggtaacttgtcccttccaacctccactgagaccttcctaaacacaaatctttttgtaagactcacctgtttaaaagcctccctgactgtcctcaaaataaaggccaaatatcttacacaaagacgcttcacaatctggctgtctccctggctttttctgctcaactaacacaaatatttgctattacccaaatacctcattcgattttacccctccatgtcttgctatatgcccttttcttctgccaagagcatccttcttcacatcaccatcataacaactttaacttatccttcagacagaactcatgctttatttttttctattaagattctaagtcctctcccaggcagaattaactctctcttctatgcaaataccataacttgtatctattatacttgtacttattatactttcacttaaaatttaaaatgtaatctaaatataattaaataaattgcattacaatttaatacagtaagtgctataattgagatacatctaatgcgctctcctgttcatctgaaccagttcatattcttataagatgaaatatagtggtttgaaagagcaaaggttctggatgcagacaaattaggctttggatcacacaaaacagtaactaatgtgcatttatcacttactacctatgaagcactatcctaagtgtttttatgtgtattaattcatttaattttcataataatccaataagatacatattgacacacatttgcagatgagaacaccgaagaacagaggccagttggagtcatggaaccgtcgaggtgcagaatcagaatttgaaccccaataacctgtccacagagtcagctctcttaacctccatgccatctcttagccaattaacatttctgaaatttttcataactgaaaaatgaggataatagcaccttccttattgtaagtgtaaaataaaataatggtcccctacttttctttcttttcctatggttcatttgtttttagaagtggcatacatttatttgacttcctggttaatacataaggtctttaccttcttattgtcacacatttcaatcctcagcattataaaagaacaaacgaactgtggcttttcttttcttgttattccctagtaatatcaggttgtacatcttggccagagaaaagttagcctagtttaaatgaatgagatagaaaagttgaatttgttgccattcatttcatttcaattgattttgtaataaccatacaaaataattctctgggtgaaaaatttaccttcagagctactgatttactatggcacataagaagtacttactgataaaaccagaagaaatacatatgtggcttgataagaatgaagaataaaatataagtcaaataatgtgacaatgcaatatacttaattttgcatcacagaaaataaatcttccttacataatagtagcaggaaatgtacacagacttcacactattattaattgtaaaatgtatattgtttcactaaaattcagctttcaagagggtaaataggatgtaacctcctcaaatttcaaccaaagaatggacttattattcaggaatccatacttgattaagtctgtaaaaactaaaactacatatttgagaagctagttgaaattctggtcagcaaatgcaaagtatggtgccaactcaattattttttttaacatctgcaagctgaacatgtatatcttagttaacataattattctaaacagaaatatgttacaaattccaatcagttgcttcagaagattgattacctaactatacatatttagcttcataaaattaagagtttcaaattcaacattaaatttgacttgatttgaaagcaaagcatactgtgattttgtgtatgtgcaagtgcaagcgtgtgtgcctgtgtatcctattattgcatattttcacatttggtgaaaatgtatgaaaatccatgacatatttaagtagtgttttattcagattccagtaaaacatgctaggctgtttagatttcaaataatttcattacattggaactaaaattcattcatatttaaaccgtttatcttcaagcttctctgaaatatagggcatagtctcaggaaagaaatgtatttgggaattgagttgcgagttatgtaatctccttccttactgtattttgaatttaaatattttcaaagccattaaaaaggtataaatacccccctgacacacacacacatacacacaaatatgattgaatcatacaattatttatgctgttattgaaaatgagaggggcttatattcctccccattaaacaatttcacttttgcaagacaccatagtctgtactttccagtcacttcctaatagtaattggggacctactggagaatattgtaatttttcaggttatatgaataccacttagattagattgctctagtgtttcatctaattttaagccctcttttacccagtttggaagtgtatagtttgtatgcttctgaaggtacagacaagtagataataatattagtaagtacaaagaatatgtcagtcactcagggccatgtagcaagtaagtggggaagatggaatttaaactctatcttctgattcctaattcagtgttgtttgctcctcacatcttcctatgtcatcttcactatgttgtactatcttccctgatattatattatccaaagctttcttttagtaattgtactagggaaatggtgttaaggtcctaaaatgtttaagttcgaggagcatgtgtaagacaataagaaaccgaattgtagaatgaagtccattatatcagtttcttacagtccattaataagaatgcatcattcattcattgtttttcaatatttaattcaataaggactcaggggaattaagttttatttcttgaaattattttcctctgaaaaattaaaaatcattagaaaacagaagacaatttatatgatgacatgaaaactgtgttttaaaactcaatgtctataatatttgttattttcaaaaagagcttacaatattcatttggccaacatggttgacgagtactctaaacaaaacctgccttgcatttttaagaacaccttactagagcttttcttaattcctcaatattgtaaaacatcctaactgaagcaaataatacatcaccaagtcattttggcaatggcaactgtaacttaaaattatattaaaaataatataaaccttactagttaataaagtaatattacaaagtacaagaatttgtactggcatacaaaatatttatatagccaactagtaatatgtttaatagtttcctggataattgtatctcattgcagtcattttattgataaaaaataacactgctttaaatttaaaagcaataccttcttctcagtccaaagtgttttaatgagctcaccatgttacaaatgcagtagtctacaccaatgtaaatattatgcatattttattttacttttttactttgaagtcaaatttctgttaggaatagataaatactctaattttagctcaaagaaaaggatttaaaatttgaagccattatctgagtaattcaggtttttaaagctttagaaatcaaccagtagtacaggaaacaatgggaacaacacacattcaaccaaaaccaaggattattcttggctctctatatgtaaaagctctccagggaagaacagcatttaacccttttcagatatgtgccgttctattcattgatgaataagtttgtctcttgaacataacacaggtggaacattaagaaaggtagaggcggcccggcgtggtggctcacgcctgtagtcccagcactttgggaggccgaggcgggtggatcatgaggtcaggagatcgagaccatcctgactaacacggtgaaaccccgtctctaccaaaaatacaaaaaattagccaggcgtggtggtgggtgcctgtagtcccagctactcgggaggctgaggcaggagaatggcatgaacctgggaggcggagcttgcagtgagccgagatcgcgccactgcactccagcctgggcaacatagcaagactctgtctcaaaaaaaaaaaaaaaaaaaagaaagaaagaaagaaagaaaggtggaggcaattcagacaggcagcacaatcaatagtacctgagtggtctcaaagtatgacttgagcctggctgcttgccacattgaccctttagggaattacttgaaaactagagggaaggagtctagaatgtcttttgacatgtgtataataaaactgaagaaatacaagtgcccaaaagcttacataattaattaaaatgtgaacatttctctgaaccaatgattccttttactgtgtggaaataaatatgcttcatgattttcatttcaggtcagaggcagtgcagcttgtgttacaactcaaaagagtaatactctgaaaaaagaaaaaaaaagatggcgctgaaaataaacatgttcagcagccattgtgattcaacttacccagatgtgcttttcatgagatggagaaggacggatggaaaagaaaagcacacaaatgttaatggatacagttcaatccaaagaaaaccatggaataaaacaagagcattatttaagatgtgagaaagctcaggtatgagaaagacatggtgccattttgtatttcatcatgacacacatactcactgcgtcgaaaagcatagtcaggctgagggtagttctaatagttgaccaataagtctatgtcttgagtatgagccactctgaaacatgcatgaccacattttcccagcctcgagtacatcccaggaggaaatcaagaaatcttggtaaaggacattctttacctcaggccacttccatgctattttaccagtagaaacaataacttattaattggcacttagatttttatatagctttataagcctactgctaaggcccaagaaaaaagaacagcagacattagaatgggcagcaacttgaagtgaagaatgtccttcctagtttgaggatctgaaaatctagattctatttctcatacacagtttggtcaaaattattagcagattctgatcttcaatttcctcaacacaatccctggcaatagaaatgtgtaaagtccattccagatccataatgttattattccaaccaatgctgtaataataattactattttggtaaacatatatggctagtaatcagaacataagaaagtgtaaaaatgttctattcctcttcttcggtggccatattacttccttctctatttgactggcaaaataaacatcaagtttgtgtctattgtggctctttcagtggtagaaatatttaattatttgaataggtgtttataaatgttgtttttggggaaacatccataaattatattggttcaccaatattaccagaaatcatcactaaaacgacattgatacacatatagcttttgaagaacccacttgctccctggatgtagtagaggcattgagaaaatatggaagttaaataattcaacaaaaattcatgagagtattgttttaaaaatatattacaagcataatagcctaattattaaaaaataaaattgttactacaactcataaaacatgttcaatataacaaaatagaaagcagaaattcctatgtcagaaattaggcaagttagagcatcttcttttttatcgcacaattattataaagaaaagattgatgtgcaatggaacaccctgcacatgcctcctctcaaggcattcattcagagaaaccgtgtactttttattaaatcggcactttgaaaaaaatgcatatttttggccttaactccacagcatctgtgggaaactccttagattttcacataaacaaaagcagaaatgttcataaacactggcactacactgtcccaagaaatttatcatatttttcacatcatacaccccacagaaatgaaattaagaccaaaaggagatagtttttagattttaaaatgattttcttgtcaacatacctgtgaactctacgatgagctctgaaaaaataggcaatttctgagctttccaggaaaattgccaaaagcatttgggactagttatcaccatggacaacataatctttctgagcctactagctatctaggaatcacttccctataaaacaagttgattaaatttgcacgtagtgaaacctaatatttattagatgttccttgatcattttttaaaatagaaaacttacacagtataaataccttaaaatataaaatataagataaaatatgaaaataaacagaaaacacaaatttaaaagatactgctcaaaaagcattgcacaaatttctaatatttttgttatcaattcgtataaattatctgatttctcatagtttttatgagctttcttctcttccatagtaaataaagttaagaactatttcaagcagctatatcactttagaatgttaagaatttcacctcatgactttcaaacaaatgtgttctgcaaaagacaaaaatctatagttataaatgacccatattttgtgctaatatattataaacttcatataggaggtaatatatatttgcagagaagttttttctgattaatttttcttattgtaaatattgatacattcttttctacacatatttatttatagtagcatatagcctcattatttttctctccatgtcagaagtgtcaaggctatgttaatagtaagaaagattctgtcaagaataaatattcttcagtgaaagaccattgtgagtaattggcaagtaagttttaattaacataaaaaaataggttatgttaccatctaatgaatgagatcagatccaattattgacattatgttttccttgccaacatcagcatatattcagtcaggagaagaagaaatgaccagcaaacatatgtcttatatttcaaaatgagagccttcaacttttcagtttcctcaccttgatcttccagatctcctacaattgaatgaaccttcttctgttataaactagtcaattctggattgaaaacttcaaataagaaacaattcattaaatgagttttatatttggaatataattgactcttgctttgtaaagttcaagttggtgattcagacatatttttaaattagttattaacatcaaattgagtagttaatggctggtaactgaaatggaaaagtaaaataaataaatattttttttaataggtgaaagttgagaatgtttaaatgctgatgggggaaaaaaaaagacaggagcagaagttgaaagcaagggagaattccgcacaaaatgactaagaaaatggaaagggatgatctgagtaaaagaatagcctagttttctacaataagacagatggggcaagtgttagtgtatatttggcatcaagcaattcagggcacttggatggtttctctctctgtctctctgtctctctaagctagaatgtaaactcatcagcagaagattcaagtttgaggagagtggaggtttctaacaagagttgcagagagtagaacaacactaatgaaagaaaactcttgggattactaggtaatgctgaatttcacaatgaaactatttctaatttctctgctgtaattttctccaacagcacagatgtgccaaaatgtacacatggagaaagaaaattcatcattgggtgtggttgttatatgtagatgtgaccaaatgaaagtggagtgaagaaatttaacaaattttgagggtgttgaaattatggacgtgatctaagctaaaccaggagagaggggaaaacagaaaggtgataatgcactggaaaaggatagaggttaaataaagatgatagaagaaaaagttcataaagcaagatcaaaggtgggaagactgtgattagcaagaaatgagatgcttgaattggtaagtttgaaagaagcatgatttgtggtgatgacaagattcagaataggaccatgaagagtgtctgacttggggtaatgaacaacaatggaagcaataaagttgtaaaatcaaaaggttagtttttgaatgggtgatctatgtggatatcagagcatacgagggtgacatcaagaactgcttaaaattcctacttaaagacagatgatggggcctttaaagataaatatttaagcatgtttctagtgattcttacaaatgaaagaaatggttcagaagtttaaatgtggttcctcatcacattaaatataacttttctttaagttaatattgacttcaaataactaaaatatttgagactacttaaaggagtttaagaaatctttattgctctaagaattttgttaatcatctgcctagcaaacctaatacagttaagcctcaaattaaaatttcaattatggagaatctgaaccaaagatatttaattttatgtttgtgtgtgtgtctacgaaaatatacttaatacacacacacacacatatatatgtatgaagtctttttgtattgaattttttgtctgtaaaaccccggcaagagagagactatacgtaattactgcccttcttagaagtgtggagacagatacatttacttcatgaatggctcatttgaaataactatgggaagaaactaaatctccaaagatcttataaaaaatactatacaaagcttatatgagattttatattaacaggaacagatgtggaaaattctagattaagatgtcagcattatatttaaatatactttaatttgatttttttatttaaaaagccataattattcttgctattagacactctcttgtaagttttactggaatgaataatttagattgattcaagcacacatttaaattccttacatggtttatttattagggaacattcacattattatatcttatatcaaacattggaacattatgtgtggctaattatatcagaaaaagtcaattttataaaacagctacatctcgtgttttgaaatcctccccatccccactctttaaaagcatgactggtttgaatacatttgttgctcatttttaaggatagggtaggggcagataagaaactaattattctctagaggaaaaaaatatgctaccctttccagagtataaagagactggggaattcttcattcactccctatatagaccattaacattaaaagttatataggatattctaagtgcagttgagattggactacatattctttaaatcacagccctattcttagatactaaataattccaaggaaaactgggctctggagatctacatttttgtataacacagtgcctggaaagctatatttcttgatgcataaaagaaaatagcagtttttacattaaaggctttgtgaaaaatattagagataacacatgtaaaatgcatagaacagtgcattgcctagcacattacaactaatcaatgtgattattatgtacatattacatataaaatagataatgtcattagcatgcaaaggatgaggaaaaaaatgaagcagaatatatgcacacaaggaggtaagagtaatcaggaacaaaacaaatagatattaggtatatcaagaccatgaagtgcaagatgggaagcagagagataaagctggtgagatacacagggagcagataatgtagggatttatggactacataaagccatttgaaattaatcctagggttgttagggagtgattgaggggttttaggcagctaaaaaataagatttagataggtctgtttagcttaagcgtgactaacggattataggaaggcaagactagaagcagaaagactattgtagtatgatggcttgagctggaaagaagaaaatcaacagatttgagagattttttttaaaaaatgcaattgactacatttggtaatagtacatggacgtgtgtagaggaagaattaggacaaggaagagcagaagcaaagaagaaacccaggtttcaggtttggtcacctgggtagaaatcactgccctaactcctattacattttctcaggttttcttctttatcctagagttctttccttatccagcttctgtttatacattcaattatttgagaaatgtattttaaatacttacaatatgccagcatctatatgttaaaaattcaaagattctcctctgttcagttctcttctgaattttacagaggatcacagaatctcagggcagggacaatttaaaaagcaggtagttcaaactctcagccaaaagttgaatcctcgatgcaataatcctactatgtacatatgcctgtcaggtcaatattagacataattatggtgaacaattccctttcaaagtggtcaattctttcttcctacctctgtgattgctaataattctcctacagtcagctcaatttatctgtactaacccctgacttctggcctaaggtcttatcacaaggccataaagaacacgtttggttgttcattctgttggcagcatctatatctttgttctgtatataccacatattcctatttctaccagtctttgaggacatggctttgtgtcatctcactagtatggtcatgttcctctgaacatatgctggttttaatccactttaagtaactttcccagaaatgaacacaatacccagctacaatctggtaaatgcatcgaattttgaccctgttactgctattacggatattgaaaaacattaaattatttgtcaggcattgctcatttgcctaccttgtagaaagttttttcttaggagctacaggtaaattatatatgttcccctatatagaggaaatcagtaagtatagtcctaaagctggctgcagtattataaaaattcctctataaaatttcatcttgtcagatttggatgcctctgtaaaaatcatccttaagtatattctttatctaaaaactgagctatgccttctagcttcacactttgacaaatctgatgttcttatttaaatcatgtgtgaaagtgctgggttatgccaccttctgtttcacttagtcatcatcaattcatttgtgaagcccctttggttatttgtctttagctgggagaatgtcttgtaaataagaacattagggtgcctttgagttttcggcacttttctcattctccacaaagatttaaaaagtgatcatgaaccctgaaatacttaaatgcaataattagttttcatgtccatctctctacaagctctttgaagaacagaactacctaattcaaatatcagtaatttaaaacatttcttgggacatactgagcaaaagaatgaaaaattatcattttcatgttctattaatattaatccaggatttacatcaattaagataaataagaatttatttagaaaatgacattatcttctattatatgtaactatcttgattttaatttttcatatactaatttttattttactctttccagatcaaaaatgtttctcctggcagaaattatggagccagcacagggcttctgttctactcactttgttaatatattaacattgaactgctggctcaaaacagcaactctattccttttgtgctgttttccttcctctaaatagatcaaatatatctaaatatatctaaaagagaacactttggttttccttagctttctttttactaacaaatttcagtgcattctgacccttatccttgggatattattattatttacgttcagggaattcttataattgtctttggttgaaggtaggtagggctatacatgatcacatggcaaagcaacagcagctctattttagtgaaaacagagaagacaggcttctggagttccaagtaggaaactgggacatatttttccagagaaattttgaaagcattggttttaggttctaaaatgttgtatattattatattcattgaattagttgccgaggaattttcctgcagtaattgtgtctgtactaaataaaccctcgactaaaataaacaaactgatccaagcacaaatatctgttccaaactaggccataaaaggatttcatctaaggacttcatttttggaatgggatgaaggagaatatatgtgtttgtgacaagactgggaaaatctctcatgatctcttattgtcaaagttttgggaatatcttggctctattgtttctgtaatctgtgagatatcctggctctgttgtttctgtaatctgtgagataatctaatatcatgcaagtgaatccttctttttgctttatctacccagagacagttcctactgcatgcctacaaaacaaatttttgtgggggaagcacagacttttactttctgtgtatatagaatactcagatgggaaaatgtactcagagcttctaacacatcttataaattaagttctggaatacagttcatttaaaagtttaatttggcatataggcacttaacgaatatgtattaaatgaaagaatattgtggagtttctgtgataccttcacatataaatattttccatatcatttattttgcttacagatatgtacactctgaacctgccaaatgccaaagattaaaagtgcagtctcaaaacacattaaagattacacactgaaggagaccctcaggattgtgatgggaataaattaagtaaatctatagagcttaacttttatgtctgtgatattctaacataaagatttattggtagtaattaagtgtgactgctttgctccaaggataaactgcttctcgagagaggatgctgctgatagctgagtcggggtgttaatttcattttaatgatattgaaaaatttgttcacatatgaaatctattttcctttagcagtgttaaccattcagaatacatagaaaagtctaacatataataatatattatctttattgtaactaaagattgaaaatgataaattagtatattaacattcgtatgatatctttcaacttaagttacaaaatagagaagatttcagcatggatatatgctttactaaaaaaattatataatgttacgaggcaagagaaaacattagcagataaagaattaagctaaatatttcatcatttatattgctggagataaataacaattcaatggatattctatcaattttaatatgttcactgcctattcaggatggtcttgagaattagagaggtgaattactgttgaaacagacatcctcatctttaatcccagaagtttctataagactaaggttcttggaatgaaaattgagtgtagaaatgtgagtcctctagagtaacagttgtcagatagtccagcataacaagtcttcagtttgaaagaataaggtagaaaaatgaaacaaaacatttgaatagacacctacttacggcatttctgaacaccaaagataaagcaaaaataaataaataaaacagagagagagagagagaggaaaaagaaatcctacatgttatatacaaaagaatggcaatcaattgatcattagccataactagaagcaagaagagccataacttcaaaggtctgaggacaaattatttttaaccaatagttatatgtttcaggcaattatcaactgatgttaggtgtgacacatattttcaggtctctaatgacttaaggaatttgccacttgccctatcatcacatttctagagatgctgacatgtgaaactgacaactaaatatattccaggggagaaaagtaagaaatttaatgagatatataataaaaatataattaacactgatgattcaaaacttgcttaagcaagaatgttgatgacattaaattttattaattcccttgtaagctcatagttcttgattctaaagtaacaaatttatcaaattataataccataaatgttatttttaatattatggggggcttatacctgtgcaacttgaaagtctgtgactaaccaaatctttctgtgtcaggtagatttaactatttggagcttccagttatgctttttttttccccactatttacctaagccatgctctaccagctttactggaaatatggctgacagtttgatttctaattgactattttgttagtcaacaaataaattctgaacttaggcaaagaagagagtttctatttattgtgccctaaaatactcaaatatagtctctaagtacaatttggtgagttgaaccttattcagaaacacaggaattttggggggcaggcccatgtaggttttaaatctgaagggaccatctatcattccatacagtgtaattgtagctcactgtaaccccgaattcataggctcaagcaatcctcctgtctcagccttaggagtagctaggctacatgcacatgccatcatgtctgtctaatgtatttttattttttgtaaaaacagggtctcactctgctgcccaggctgggtctcaaatgcctaggcttgagcagttctcccacctcagcctccccaagtgctcggattacaggcatgagtcaccattactggcctgtgtggttggctttaatcggctatcctgaacttcgaagcttttaggttaaaacataggctggaaagctaagaatgggaaatacgttcttaaatatgagggcgaaaggtataaaagaaaaagagtgaaattttcaggtctggttgttctaaacgtaatagtaaaagagaagatatttttgttaaataagaagaggtgcctggagttcaaagaaatccaacagagagtgatggataagatctcagagagtcatggcatccccagatgaagtccgcattgaataaactatgaagaattataatattaatactgaaactaaatattgagaataagtgactcaccccttaaatgtcaggagcctacagagaaactgctcaaattttaaaagggaaaaccaataaaattactgtgaagcattcaaagaattacaagctgagttttagtttgacacaattattataggttaactatactctacataaacctgctggagaaatttatggaattgatgctttaaagaaaagtacagcaaagatgaggcatagtaaaggcaaactaggcagagcaacaatagattgactttaggccgaggttacgtgttactctgatgaaacaacaacagcaactgtttaataattatcaggaaggtaaagatggacaagacaagattttcatgactagtgggtggtttagcagattcaatattgttgatttcctatttctcataataagacaatagagagaaatataagcaaaactaatgcctggatcagaaaacaaagaaaaagtaggattaaagtaggaaaacaaatcttgtaagttgttgtaacctatgtgtgttaaatttactggatggtaagtgtgcctcaaattaaacctttgtttaggactgccaagttacaaatttctgaactttgcaaaaatttggaatgtcttaaatgctgctctctgaaagtaactcccccatatggctttttaaaaaatgtaccataattaactcctctagagatttctcccaattaaatttaaagttacagactgtcaattctaaatagctgctatcctagcaaatttgaaaataagatattgtctagttctggctatcctcacaaagactaatgaatctctgctatgaattatgggatagtgagcatagctctgttaagtactaagtcttggaaacaccattttgccagtccaatggatagaatttagaaacaactgataggatagcacaggttgcaactgtgtacgtacgatctgtagtgctcaacattatgaaaaatgttgcttcatttattgtttttatttatttttaaataaaatttacttaaaattatttttcatcctgatagaagactagcaaacatgaaatcggaacccagaaaagagtgtaactcattaaagtgcactgaaagaggatacggtttctttaaaaagaaagaaaattggaattgtttaaatgaaattttaaacacttggaaaaatccaagaataggctgtcaacatttaataatattaataattaacaatgtaaaattcaatagaaataaaatttgaaaccatgtaatttaaaagtaaattgtctatctctaataaaactcattatatgaagacaacttactctctggtaatccagaaatcaagccacagtggcatgcaaattccgaataggtgttaacaattattcatataagtcctttgaacactgattgcatgtttatgctcacagggctattgctatgggataatcaataataagggaaatacttttgtgctttcattaattaactctgacttgccttgttaaatccatttgaacctaaataccattaatccatgggaaataatcgtactaagaaatgttagccatttttgccttatagaatgttcttaatattcttcttaatattaaaagcaagtattctacataacacatcttacagttacattttgccaatacatgttgcaaaataaaacccaaagtcaagcatggtaacatatttaagggaagaattagtatttttttctgactgtgagggtacttagtagttgagaaacgagtctataaaattattatcaaatcaacccaatagtgtataaggttaatgatagctaaactttaaatatgttattttaaatcactgtataattgaaatgtttaactttagtagctatttaaaaagatatttcagttggctccatcaacaactaatgaagtatgcaatgcactgcctcaatatcagacttatatgcaattgtgaaagctgttcagattgccattctttgtcaaatatttgtctgggagaaatgagaattaactttcaagggaaataaactgagtccattagtcaggctgggttttgatcatttatatatttttagactggaaatcaactgcgaacatttaaaaatcttaacaaaggaaagtattttttagaagaatgtttttctcaataaatagtcacgaaatagagtatatcattaattggtaggactaaacaaaacgaagacatttgaaaaagattatgataatatttaaatatatttttgagtgatcagtaactaaagaataaatatatattattgattatggctgagcatttgattgtatggtagaaataattatgttctcaaagtcatttttttctggacaatattcctactgaattgggatatatgtacataatttttagtaactagcaaactaataaacaattaggttagtgagttgttctgcaacttgtaagtatatacttccctattattagtaaacatttacaaagcaagtgagaaagcaaaatatgaagtcaattgattagcctgtatattataatcctaagagcctatctgttaccaaatgatgatgagagcagtgaatattctttcataggaaagaaggaaaatgtgaaaaccaaaaacacaatgtaaggaatatttgagaagaaggaaaagaaataatcaaccaatagattctggaataaagagaaattgatttacatttaaagaacatgtcctaaaggtgccattttgtcaatgaaaatgttactatgtatttttaaaatgttattttgggaactacttgctttccaacagctgctgcaactcaaaattggccaattttgcaagtcatttaaatgtcctatattatatatgaatgaaaagatacactatcaatttcctgacagatgcaaaacaatctgctctgagtctaaaataagtttatattcaatcagtcagagaaatgtttctcctttactccatttcaaagagtagatacttataattgccatgagagaaaacaaagctagatggtataatctcattttatcaaaccaatcaggttttaattttgaacatcaatagcattgcattacttgtaaggattttgaaacaaatctatggatggttacgttgaagaaactgcttatttcaactacaggccaaatatttttatactcttttaaacagtagctcattataaccaggaaacataagccctgagtgttttaggtagtatctggaaaatattggcttcaatatagttcttttgtttccaaccactctctttttaattccctataaataataataaggaattgataaaagttagaaaaagagggaaaaatccccaaacctactttttctttagtcttcgatccttctcagcttgagttccgagtttgcctaaccccagggactcctgagctgcagcttcagtctccataaagcctcctgtgaagagaagtaactaagtattcagattatgttgcataggttgtgtcaattctgaagtcaggttgttaaaggtttagttgagcaactgtttagtatcacatttaaaaattttccttatattactaacccaagatgcataaaatggcatgggtacatacataaacatacactgagaaaatgaaaacaaaacaaagcagtacctatggggatataatttgttgcacccagtggcaacataataaatgtggcctgttcactgacaagacacttaaatatactgtccccaagtcttaaagtctgtttttatacttttcttatggaaaataagagcaaatatctatgcagcgtgtgagatttgtttattttttcaacacgttaagtatttgcaatatttcacatataatgggataaatgatagccaattgggtaggaactcaagtatatgttttctattacaagttgagagaatggagaaacatttgctgacttctaagagctcttcatagactgctcctggaaatttgttctgctctactggctgactcctatgtccttcactataaatcttacttccagaactcgatgtgttctgggcaggttcttgtgttgttttttaaacttcataatattttttgaaaaaattctaaatttcttcaaaagagcttgataaaaatagttatcaccaagtaggtcataagttctcatttagtgtcaatatataatatgtataccttatataactttgtaataaaaggaagaagaaagaaaagtatgatgtacattaaacacatatcacaggatttctaaacttacaaaattaattcataaattatctgttgtaattgaaaaataaggacttactcctatgttctgaagtcgagctaaatgaaaatgctcactatttttaaatgagttaaggtatatactttttttaataaaagaaaattaaactccagttaaggtcaagattaggtagaaagatttaagctaatataaactctcacaaagactatgcaagaaatttcatcactatatcagtaaataactattgaagacaacttttgctcttctctcattgtagtggacacttccttacttaacatttgcaggactcgaccaagatatggtttctctttagcaaagtaaaatatcttaccaaggtgccaaaagcaaattttgatgttactgtttttaatactttattttaccaaataatttataatactggataatattaacttgggaacattgatataaataaattaatctcattcctgataacctttttactgaactatataattttttaaaagtctcctttaattaaaaacacatttattgctgtatagatctaattcagagatgtggagtttgagggccaaaatttgttttagttattattcacatgtttaatgaatacgggtacttaaatctttttttattatgaaagatttttcttcttggtatggattaggaaagccttctactggtgactaaagtactcttgggaaagaaacattttcaaatgggaaattttccattatgtacagtgagtgcatattttcattttatttctctcatctgtatatttgccttactgtatatcaataaattattattcatagtcttcaaataataataaaaatgttttcttgaaatgtaaatgaaaatgaatgagtcacttaaaagttataaaattcttgaatggtccatatagggacatagagattgatgaggcagacatattcaataaacaaggaaagattttcaaccaccaggtggctagatgaatcaggcttttattcttctgagcaatataagaacatttaaattatgatttaaatttattcatatacccaaaattttaatagaaaaaaatcacatttttaaataataaaacttgaaataaaagcaaagaaaaatctaggaatattttgtgagttaaatctagacattttattttctcataactataaaataaaaagcatgaagaacttagaaatactcggagtattgcaaaatctagtatcttttttcaaagcatttgatagataactggaactacatcctactcaaaaatgccaagtacaaatgggacgtaaggccattgtaagtaaagctatttttaagcaacacattcaggccagtgcgcttaaccaggagaaaagtcccagcaagtgcatattttcagcccaattaaaacacttctgagggaggacattttttcacagaattgacctagctgcttcactcatctaatgtttatctttccacatacttgataaactagctggtaagggtgaccttagccaaaccagcttactaattattttactctatggatgattatctaaatccagtgagagtctgtctcattcttgtctaggcatcagtgggctcatatggctatgtgaacttcagaaatatctatttatctataccaatattttattcactccctacatgtgactattaagctcttgaaatgtgcctaattcagatgatgtattgtaagtgtaaaatacacaccaggttttgaaaacgtggtagaaaaatacatgtaattcataaattttaagtgatcatgtgttaaaatgagattattgtttctatatcaggttaaataaaatataggattaaaattaatcccacctatctcttttaacttttcttaatgtagctaccagaaaatttaaaattacatatgtggttcacatttgtggcttatattgtatcaatgttggccagcactatataccagagtttctacctggatacagtacatccacagagggaatgtaaatgtttgtgtatgttgagggagggtgcatttttttgggtattataatgattggcacatattggacaggggacaaggattctaaacatccttcattaaatagagaaactgcagcttgtttcttttttctttttttctttctttcttttttttttttttttaaacagggtctcagtctctctcagactggagtgcagtggtgccatcagagctcactgcagcctcaaactcctgaactcaacccatcctcctcccaagtagctgggactatagatgtgtgccactatgcccggctagtttttctattttttgtagagatgaggtcttgctatgttgcttaggcaggtcttcaactgctggcctcaagggatcctttgactttggcctcccaaagcactgggattacagatgtgagccaccatgcctggcctagcttgtcattctcaaaatgatgagtgcctcagaggagaaacactggcctgtggaaactaggggttactcattcttcaggaggtctattaggaaactatgtggaaagaacacaatgaactccacccctttcatggcctgaagtgcttgggcttgaaggtttgagtcccatgattcagcagactacttacataataaattgtttatcaccttgtcagggtccgcctagtggttgggcatgagcaaggcagccttcttgccctcaaagttttcttggctatcactcaggcatctttacttttgtgaggccttcgaggacttggaattattgagggcaagaccactcctaaggtgtgacaggcacagtcaaggatttttttttgccagcccctcttcctgtgtaaacagttttgaaccaccaaaaaatcagtgggacaacgatctactgattcaatctcatacaataccattcttgccagtgggagcgagggatccaattgccagaccaccctcttgaaaacagggtcagaccactgtctcaggatgactccatagatgcgactcactaggctccctggggcatctggtcgagtgcatgcgtggcgtagagtgtcaaagaaaaccctgaaggggagaaacagggacccaggctcctgctgtttggctggatcgggcaacatgtccagatggcactacttcccttctggtcccagtgtctgaacggtaactgagaacatttcgatgcttccagtgattagaccccgggtccgggtctcagctgggggtgccttgcccagatggcactgccagccctgaactttcccagacatcagagggagtcttaaaatttttcaaggaagttgctacaaaatgtagggcttgcgaaggctcagggctcagggcacaggaaggaaactcacatgcctagatctgtggatggaactagttggaggtatctattcatttggattgtgaaggtgtggaagttgttagaatcaaaatggagtcactattgttaagaaaatcctggcaagtagagccagggaaggccatgaacagaggattctcatgctcctacgcacgatagcaacaacaacaacaacaaaagaccctacgaaagccacaaccttgcacgaaggccattgcaatcccatgccaaaaaatatttttataggtatatctgtctggcaattgcctgtccaacctctgactggtggcacgcttgttattaatttgagtagccaaagataattatttcaaaaaattatgtaatgttcttaattttttgcctttaaaaatctttgtcttcctttccttccctgagtatacacatagtttatagtttactatgacatacatattcttatcacaatgctctattcctaaataaacatcttttcttttagagagcatctctatttggtatttaggtcaacaaagacaaatatctccccatttcccagtccttaaatttcattcaaaatcacttatttcatattggcccttgagatacaagtctgtagaaattgcttgacaaacccatattgcaaggcctctgtccttccatttgtccagcagaggtctctgtcattgtgtgaaaaagagatctctaactactacaatctgctgatgattggtggcttcatctttctttcagtagaactgtcttcatcattaataaatagcacatggtttgtattaaaacacatttgaatttataaattgttacttaattgttcaacatctgttagtctgttagctatccggagactgtatctatacacagtgcctggctcataaagggtatgtaacaaatacagtcataattggagctaaatactactttatttaaagaaagaccctttcactatgcagagcatgagtcatttctaatggacactttgtggaatttacattgtaactattggttccttagcaccaaggaacaatctaagttttggcgtaaaggccgacacagacacccaaattttagaggtagaaaaatacagtcatgcgccacataaagacctttctgttaatgatgggctgcatttatgacagtgttcccataaaactataatagcatattttcactataccttttatgtttaggtacacaaatacttaaccattgtgttacgattgcctacagtgttcagtacagtcacatattgtggattttttatagcaacaggctatacctatagtctaggtgtgtaggtggctattccatacagcctgggtaggtagtaggttatattatttaggtttgtgcaacaaaatcccctaagggatgcaatttttagaatgtatccttatcattaaacaatgcacgactgtacttgtgaaatgatgctggtgtactgctgaagctgtgtttttgtcactgtgaaattatttttttattaagcctattatagtaggtcaatgagttcagacaattataatacaaactggcagataaccataaaagaattgccatttagaggcaaaaaaagctctttaaatgtgtatattgcttttcatacgcatttaaaggaaacttgctaaagtggccctaacctaataatatatgcatttttatacatgcaattgggaattctgcttattcatagttaacgtgcttttctgttttcattatttttttcatagctttgttgttttggctctatttgatcactcccttgtcttgaatatctctttgtcttagatttgtttcatcttttgctatgcctgtcagtagcctcttctttatcctaaccattcactattgacatcagctaagttggtcagatgtgttcttgtttcttcattgtaattattagtagagctctgtgaagactcaaaagagttggtgtttctcaggtggcaaacaaatcagtatgttaagatggtatggagcagttaatttccctagaaatagtaaatgtttaaatatttctgtctcttctccatacactatcatcatttttctaagctgacaaactgcctctggaaaacagagctcgtttgctctaatccttaactctcacttctgcttggatgcttgaccctggaactcagatcatcttatttctgtggttggctctgcttcaagatgctgcctcccaatctctgcagttccaatctgtctgtggctgggtaacttgatctttggtgctaatcacttcctttgcttcataagctggcatcacacttctgacccagccagtacccacttcctatttaaccacagaaaacgccatttccatgacattctctctggagcttgctgtttaacatagtttcaatacccttttctcaaagataggtcccgtttgaaactctacctttacaccttttcaaatacgtaggaagattgcacttagatgatcctagtagaatcaaacatatacagggagagaaagattaacccagaactctctccaaacattatgtctgtatcttgtattagaaaaattataatgtttctgtgtgattttttattgttgccttgagttattatttattcatttatatgggatatcctcaagatgttatatacttcttgaataatcgtatttttaatttctttatgtgcccacacttgttccacagggataggaactcaatgaagtattttttgattgaaataatcccaagagtttcctttccggatcatcagaccaggaagtaggagccaggattcactatcaactctcttactaagtagctgctctgtcttctgaaatcatctcagtttcgatatgtatagaatgtggacaactacatgatcctcacatatcttctagaatctttaggcatacagctctagaagtctgtaatcttaaaagcagaaatttattttcatagtaaatattttatggtgttttagttgtataaagaagagttgccagagaaaagacttaaatgttagagattcatagattcagtattcctagggttgaagtagatcttaaagatcatccagtccaatcagctttccaatgcttggatcccctccacaacagctcttcctagtatttgcctagcttttgctcggcaatttccaagtgacaaataactcactacctcataagccagcccattttgtatagaattctgacaccccactgttctttcttacatcgagatgaagaataattttgtacaactttaatactttggttctagtttcgtatccttacttacaatgaaaaggacaatagctcttatacagaacaactcttcaaatgttgtgatcagctacttggtagttcagcaaagggaataaacacaccattcacttatgttctccgaacgtgattccaatcctctacaggtgcctaattttctcctccaaccttcctccaggttgatgatgtgcctttaaaagtacagtaaccaggatggattccattgcttggctgttcttttatcatagcagagtagagtagaaaaaactttcatatcaactcttatgtctgttaatgtggcctaaacttattaatcaatattgactttagagtcacatgaattttttattttttttctttaaaaacttgcttccaagaactatacttttagagtaggagaatttagatcccacttacatccattctttctatttttggtgggggggatagcatttaggggtaatactaatcttttcacttaggattcctccccttattagtaatccatcaatcagatacctgagctgtggaaacattcatatccaagtgattttggatgtgctgatcaagaacagagtgagtcctaatcatgccacgagaaactttgatcccaggtgacgttactccactcatcagtgggcaaggattatttaaccagttataaatcccacctaactgttccagcactcaggccccattttgacatcttgtccccagggatgtcatgagtgatggcttgctcaccacctttcattatctgttactaagtaaagttgccaaacaaacaaaggacattagtctgacatggctatttttaacataggttaatttactttgtttcaaaatagattaatgccttcagataaaattaaaagtcaagctagtcaggactgcaattatttatgcatgatcacagatcttagggttcatagccactgttcctagttctgacaggacagacaatgtagcagataaaacttttctgggccaaaaatatagtgaagttttagttttaagtataaagtttgtatttgtttacgtactatctttgctaaagtgaaaactcctcgatgccgatagccatgtcttagtcattttcctaaagtccataattggtactctgcatttaagagtggttcaatatatgtctattcactgaaagtaggaataaataaattattttggattatctatgtcttctctccctccaccaaaaaaaaaaaaaaataaatctcctcaactctgggtcataaatgccctcttggtaatgcctatattctggttgaactctttctcttcaagtaaacagatagaaacaaaaatgagtttttgaatggttccacttatttgcatattctattcacatcagataaatcttcatttcattcattttctctaaatttatacattactaaacaaaagtaacaatatagattctataattctcactttggtcttggtgatttttccaattgtctgtctgttttgatggatggcattcctgccactgcttttacatgtcgatgccacttgcttctatctattatttgtcatattctcactttccaatttttgtaacaaatcatttcatgtctgttttaggcagaaaactcccatttcagatacattgcttcttccttaatccacatcatcataaatataattgtgtgttaccatcctctggaattgctttgacagtacacagcctttggtgtcctaactacctttccatgttagttaagactgcacctatttctagcgtttcagtagcagtgtgtttggaattgatgctgtggtaggtcgtaaagtgattgacagatgaggaaagaaaaaagtagtgaacaactcagtcttgtacattaaatgcagggtaaagataagtcaatatttggagataatggcaagatcaagtgatagcttttaaaagtgtgaattagacatgagcatatttgagcaataatgaaaatatcagagatgcattgcatatggatgcataaattgaggggtggggagagatcatggtcattgtgctgtcaagtcttaacaggatgctattacatcctgaatctatgttccaggaagtcagcagaagtacatatcggtcctgttgtcatggggatacaaaccaaacctgtttatttaatttttcatcctgggatttgtgacattgaaagacaataaatggccaggcacagtggctcatgcttgtaatcccagcactttgggatgccaaggcgggcagatcacctgaggtcaggagttaagagaccagcctggccaacatggtgaaaccccatctctactgtaaatacaaaaattagccaggcatggtggtgggtgcctgtaatcccagctactagggaggttgaggcaggagaatcatttgaactgggaggcggaggttgcagtgagccgagattgtgccactgcactccagcctgggtgacagagtgaaattctgtctaaaaacaacaacaacaacaacaacaacaacaacaacaaaaagacaatgaacaaaaatacaaagaaatagaaatgactctaaaaccagatccccgagtaagctagaaggaatgcttcctctgttaggtgggtttccctaaattcaattgtggccttcaggtaaacttggcttaaattatgctttatttttcctgaatagtacttacaaatggaatttgaattctttacatggaagaacaaaccctcactgattcatttgagtctacatcactcctatttattttctgcccatacactgatacacatttcagttgggaaatcttgctcctacattataggtaataataatctaaataagaactgtaaaccctagtaagaacagaataattttttcaaaagatatataaaaacttgaaatctcctattagtaccacagctttttctatcctacttttgtaatttgagtgaactaaccatttgaaaaggatgtcataagaaaattttaaaataaaataattttggttggtttctgttaggtttattcaattgcttttcaatacagtgcttcctttgagttttggggtttccatactgatattgtctatgctagtaatacattagtaagaacagacatattgttgcacatattgagtttgattcttcatgggtaggagttatccatacaatcacatcgactgatccttcctatctgaagtttatgttattaccctagcatttcgaagtattatataaagcaaacaagatatcctttccaaatatttccctttgtgaattactacaaacatctcctttgctgttcatcatttctgatagaaccaaggaaacattttcatagtttcatttatacagctttccctttccacaccatatttctttatagacatgtagtatagctgctttcaacttaagtcatgtgtctctgctcttttgagttaaaccttttaagagttataaatcttagcacatggttcagaatttcaaatttggtactttgacatcactatctctttcccgtagttctttccctggcatactattctattttctagttctatttttactggtagaagaaagaacactggcaatgctcctgggttttagaattttccagatcaagacattaaaatcataatcactcgagatttttccctaggttcctcagatgcatgaataagcagtactaggttgtagtccctgggttggaaaaatgtgcatggtctttccatgacaacttggataccccttctaggaccaaagcagacctaaaactggtagcccttaactaaagtatcagtggggcccatgtatcatttcctttggtgcaaatatggttttctggaacctgtttagacctatgttttatttttatttcttcaagtctcattttcagtaaagactttgttctttttcctggaagctttgattcaccatttatgtagcttctacctagtttcataggtatagcattttgctcctgtcttcctcatccatattgcagtccttaacaagctgctgattctggctttgtttacactctacctctgctgttctatgaaataaagcaatattactcagagctcagaaactttcccaggtataaactgtgacctgaattaacttttgctagtttctgactttggtggggttgatgagaatataatagtaattgagttaattcttatctgctctgacctaaaacacacagtcagtgaaaatgagtaataaaggctaagtttctcaaaggttctatacttttctagactttaacttatatcttgcataccttgattttgacagaatattgttggcaaaatttctaatgatttaggaatttctcatcaaagttaaatatgaaataaaaatataaaattttaagtgataagggcaattaaatatattttaaaagtaaagtgtcaattatggcaactaagatgaatatatatgttgaaatataaataaatatgactatgatgttagcaaaattaatactcaaaaataaccactcacactatagtgactgacactgtaatatattggatatgacagatcatttggtcaaccactagttgtcaaataagataaaacaaattttaaaataatgtctggcatgtatattttaaacacaaaataatctgtgtctctcttttttcctcatgcaataatattatgtatagcctaaagagttcctctactgagaaagaggaatacaaaaagatttaattcctttgctggagaacatataatcacacactggccacacatcagtttcctgtagcttccgatgctttctgtgggtttcacactatggaagccaggaaaggcatttttggatactgtagtcataaatctgcaaacatgaatatcgcaatcagaaattcttttgatggtagggcagaaaactaagtcctggagttgggtattccttgcaaataattattactctatttgagaaaccaaaggatgtactaagaaatttggatcattccattcagcacttaccactgtaggtaggagtttaattctttcccaataatataactctaaaaattaatatatagaaagacaaccccccataagtgaaggatatatataatcatttcagaaatatcacagattcttctgacaattatgtaagtatgtatcatgtatgtatatatctgcttatttctaaatacatatttaagtagtaccatttcaaatgtactgatctacatttttattctattagtcactgacaataactaattataacacaatatctattgccctattcttttccccacatccattcctcaactatacaccatagagtttattagggggaagctatgatagttttaagcaaaaaaaaatcatgttctttacattttatgtaacatattataaagctttattctaactttttaaaaattctttttaattttttgtaggcttatcaattctttcaacaaaaaaacctttaaatctacatagctaagcttttatacacattcatgctttaagtggcagtatactcaatggttttaagctgattttgaaacattggcaccacgatgaatatcacagttatgcgatttatgaagacattatttactcattaataaaataaggtttataccactagcatttactttgtaggcaactgtgcctgtcacaagagttagcattaaataaattctagctattgttataaagagagaaataaaatgactgaaaagttcacaataccctttcactaagttgtattaagcattattcagctaaattgaacatttaaagctaatcaaaatataaattttgtcaggtagaaaagagaagaaatgaaaagaagagcaatgaaatgaaatgaaagatagatggatactgtgacatgactaaaatgagtggcagtggaaagtcttaacacatgcatacttacggagctgcccaagtcgagctttttcttttttaccaaacaaacgtcctattgaagacttgattcctttcttcttgggggctttgtgaagagagtcttggctgctgttggcactaccaagcccgaggctttctggctcaagagagacagataaactactgcaaaacacaaaagaggaaaatacatgcaacatccacaaggtacacaaaagtcatttcctttataaaatgcaccaaaggaggaacaagcagacttgtaatgttgttttttcccctattttcccatgtttccttttaagatattaaatgcagttttttttttcagcctttgggccctgaaactccaaatttccataagataaattcatttttgctccgaatgtctttttttctttacttttttggtataatctcaaactaatcagtgaatataggctgagttattaactgcatgataaatggccttctattatggagcacttgatccattgtctatttatttctcagagtctgtttttctaatcttaaacataatgacctacagcaaggaactgaaatataactattgtgaaattgaagctgctcttctaatctacagttttacttgattttcctctagccatcgttccctttctcagttttggagccaaattcagttaatttaaaatcatctgggtgcaatttggaagcaacaaaccatgtatcctcgtgatcaatgtatgtgttttcctaattagagtactcaaatattattttaaatacatgttaaactgaaatgcttttcaagcagttggttaagtttcaatttatggtcaatatatttgacaccgtattaataggatgggatcaatagacattgttattagtttctatagttgttaattttataacaccatgataaattacttacttttacttactcatgtgaattaatttgaactcacattccctaaccttcaagcaatagctttttatatgttgaaatatactcttttttggagagtgaaagaagtaatattttgaagctgaagtaactgatttttccacattaacaacaaaaaatagttggaaaaaagaaatgactgccaacacagaaagccctacttttaaaagcatttattgtaaaacataatatctagaagatagatatttttattgaagcattcatccttaagtcattatatttggttatattaattatgtgtctacagatgctgcaattgatgagacaataagagaagatatatttcagatataaactacatgcttaggtatattcatatcatcagtgattatagagatctgtttgcagtgctttatgcatatggataagacagtataaagaattgtgatgacaaatgacatatttctccatctagacttatctttttatttaatattttagccaaggatttttttattttctaataactttctgactgaggagttattactgctggcagcagcagtacccacaggatgcacatacctgtctgctaaaaggcacaatcatatacttttcagactttaattacgcttatactgcaatccaaatttatgatcttgtcctacagtctccttagttttttgttaatatttctagtaagtccttcctctagcctgatctcattgtaatagaaaatatccactaaaaaatagaagagttattcttatctatattgaccaataataagaccacaaagatacagttaactttaaaaatacaaatttgatatcaaaattgaaatttggttatttcacaagtgatactgggaaagggaagctggagaattctggctcaaataatgtaaattgttaagcagtctattcgacaacaacgaaggaagaggaatatttttggaaggagggcattcagtgtgcagtgtgcctgcagagtcttaccttcgagcatcattgtggtaggaagaagggagagtgtgagtcattctgagggctctaggggtaggaggaggagaagtttcacatttaattgttgctttgtcctctcgaccatcttcttccacaactgcaatctagaagcaaaaacaatacattcaaataaaccctttctaaatttcagttgaaattgacacaaatggagaatcatgagaacaaggctgtcgagtaattttaatacaaaataaaacaacaaaacttggggcatttaagtcttacatacataaattcccattaaagagtttgattttcacaaatatttaaattggacacattaaaattaaaaaaaaatcatagacccactacacaaaaatgtttgattaataaacaccatagatcaagcttttccaacccacagcctgctggaaacatatagcccaagacggctttgaatgcagcccaacacgaattcgtaaactgtcttaaaacgatttatgcacggaccttttttttaaagttcattagctatcattagtgttagagtagtttatgtgtggcccaagacaattcttcttctaatgtagcccagggaagccaaaagattagacactgctgccataaatcaactagttgctgactattgatctatagtgtttattgacattgatctatgatattttataacatcagaatataaactctttacaaaaaggtattaaacacacatttgaacaattcactaacatatagcattatacatactcaggctatcataataaagacatcttttaagtagggatttttgaaatgagaagttgataaaatataactttatcagataaagtgttttaaatcagtcagcctaatgaaatttattacagggtatttaaaatatgagttgtggtttgtaagaaaaaaatctctttttaaagagaataataaaaggtaagatagtaatgttttcaaattgttccattttactaccatgatgggaaaactggcaaagacatacagaaaaccaaaagaagatgagatgggagggatttccttaaagaacactttagtacagaatccagaatgactcaggatactatccattttgtcagagatgaagatatagagctgtaacttaaaattttttccaatgtcaagttaattgtagagacatagtttttacaacaatgctgcatatttttcatggcatcgttgtgtatcacaatatggagagatcaggattgtagaaaacacagctaaagacttatggctttagagttctgatgaaaaaagttcttagtatggctaaacaaaaatttttaaagttctagggaaatattttgtttgtttttatgtaaagctgttatttataaatgtgtttatctataataaagaccttgtaactttgaggaacttcatgaaattgtcaggacttttgtcacccaatcttaggttccttttaacagcttaggtaggtaggcatttttatataattcctttgctctattcaactagcatattgccatcaggagaatcttttttcaataactgctttcggattgattctgatgctgtggaaaacctttttaaacccacaacccagctaaactcttaagcgtgtttctgaactattcctaatacatgttagtgttttcacagttctgtgatcccaccatgactcttctctgattgtttctgctaagcatggccatttttgctgtcagaattttgcttctgaaacatcttataaaataccctctttgtcctccctgccagccaaactatacttattcccaataacagcttctaaaaacagcatggcacatgtatacatatgtaactaaccggcacattgtgcacatgtaccctaaaacttaaagtataataataataataataataataataataataaatcatgtacaaaactttcctctgaatatcacttagagttttggaattagagagggatttgaattctgatttttcttaaatgttgaataaataggctgattacttacctgctctaatattacatttcctcatcaataaaatggaagtgatacaacacttttcttaatgtagtcttttgaagtgtaaataccatcatttatttaactcgttccccgatacacaagatttttttggttgtggtccctctttccatgacttttctcacaaattatgttgttacttcctgaattatttgagactacattttcgtatagaaccttccatcctacctttctatttcttacagccattaaacttatatagtctttttaaggtgatggaggtcaaagaaaataaggacattatacttggtaaatttggtaaataagaatgaactggtagtgttaaggagaagaggctataggtagatagataatagcccaggaaaataaaatggtaattccatctattcaagccatgtaagaataatatagattcctttattttttttaaaaaaaggacataaaagttatctggttccaggagtgttccaatgtttgggtgtaagctgactaccacatctcgaagatgctgaggaatagatttttgcactgaatagaagtttgaatctttgaaatctttttcatctgatgtcccatgagtgaaagctctactcaattatctaataagatgtcattttgtgaatcagaacttcagttcattttgttttccatattccatatttattctcttgatttcattccaaacagaaaagcggtgtttcgaacatatttttttattttgcatagtcttgatgctctggcatctggagaggatgctcctctaaccctagggatagttaattcctggaaatagcacatcactcacctataagtacacctttcacatgcaaaccaaacaactcacagcccatactctaaatcatcttctccatctggctcttactctccaagaggcaatattcctctgccctaatcacctgtgggccaggctgagacaactagagagagtccctacatcctgaggccagacaaaattaatcaggctatccatcctaacctgcttatcctgccttgtcttgcctttccctaagatacctcagaaaaccttctgccctgctccttctgcctcctgactgacgctggtgctgtcctgaggcacagagtactctctcctcttgggaactgtgagtaacaagctatctttttttgacagctttctcccaatctgttgtcctcaccctatcaaaataataataataaaatatttgaaaacaacgagcattatttattatatattaaatattaaaacatttgtactatattatattaataaatataaatacttatattaaaatataaaattacaccatccttggtttaaatattcaatggaaaacaggatattatggttcttataatctaattattgctccagaaatcataaacaattttatctttgaagtattttctattataatcaaatttaaacaattcaatacactttaaatactctcaactttttaatgttttatcaacattcgactagagggaatattattttaaagctttcatagaataaaacagtattcaattcgtaatgatgtaaaagttatttactgtacctttctccgatgtttcctcagatcacttggctgtgattggcagtaataaaaacataaaacacaattaattaagaattaacaatcatttgaccaagttacaattttaaatagtgtctacaacttgactatcatttttttcttcattttgttattttctaaataaacatattttaattactataaaagcactccgcctggtagttaaatttagagagggaacttctcaggtaacataagtcagatgattgtttccataatggggccatgtgtacaggcactggatacgaggcatggaccctgggaaagagaaactgtggaatgagtgagtgagtctagctagaagagtgagctagctagaaataaacgagactgcatcttttcaagaaaatattattgggagtgaagatccaatgcatatacaaggagtttataaattcttgtttttgccccatctatgcagagctttgggcctcctttgggcagatgtgctgttcctgtgggatctcaaaatttttggcatcctaaaatctttctctttcccacaaatgccaaaagcattttcttcaggttaaaaaaaattacccatattttattaaaaatatacaattgatgacagaattatattaggtgttaaggacttcctggatttcatttcttgcttctctgacttagatattaaacactttaaatatttctttactcttctaaaaatgccttttttttcagtactctaattataatgtaataatattcatattccactgatttatttattactaattgttcaagagaattcatgaaagcactggcatctttctctctctctctgtctctcacacacacacacaatcacatctaaaggattataaatattttattgctatgaaagtaatagcactatcaagagttatgatgcttatgtttataaaaagacttaaaagtgtaaaactgtgttgtaaaaatgtcagaaataaaagcaatacaaaaataatcaaagtattcctgccttgaatgctgactaaattttattctgtggtccaggattcttactataggtttggtactaagttgctcattaatactatgtagcatatcttatataggcagaaactaagcaagagacaataacacttttaactaacaaaatcagatgaatggttcctaaatttctaaaataagcagatcacaatgtagttccgtatgtttggttagtatatctcagcacattggctaaaagtttgtactgtatccaagtggaatcagttctgattagctgggcattttttctggttggccattgtctattctatttaaaaaacatttttagtaggaagttttggaaatgagcagaaaatagtggactcagcagcttaaagaggtaactgtcttctttttaaaaaaaattcacaatttttcttttacataagttttatggcttggaagcctcaaaattgtaagtatgccaatgcatattcactacaaaaacataattttacctccataaacagttcagaatgttttaatcttcatcattggtgtcatttcaacatactatatttctaggtaatgactgaaacagaaagacatggtagtacatgcttttaaattaggcaaatttgtggaaaaatccagctccatttattagctgtgttgaatatgggcactccatttatactctcaaaacctccactctctgttgagataatgccctactacctccagttttgccacgagaattaaatgactaacatcatggtattcagcagtcatcacaatcatattttccagaggttttattatatataaatatatataatgaaatatattttataatgaaatacatatattacatattaatatatttttataataaaattttttagaatggggaaatttgactttttctcagttgcattcaggagacttcctaatttaggcttccatcttctaatcccaaatataaagataaatgaaataaggaattaatgtatacatgtgaaaatgtgaatataaaatctaaaacaaaattaggaattagtagctgttgttttttatggctcttaacacaaataatgcaagaaatttatgttatatattgaaaagttataaaactctatcttggtgtattgaagcaattataatactaagttttgttacttattatgttaaaaacacacacacacagagtccaaagtgatttcctccgtatgccatcaataaaaatgtacttaatggtttaagtcattcaatttttaaaaaaaaattattttattttatttttttcaagaaggaatctcactctgttgcccaggctggagtgcagtgttgccatgatagctcactgcagtctcaaattcctaggctcaaggaatcctgctgcctcagtatcctaagtagcagtgactacaggtacagaccaccaccacacccagctaatttttttctttttctctttttcttttctttttttttgagatgcggtcttgctatgtttcttaggctagtcttgaaatccttgcctctaggtaatcctcctgcctcagcctccaaaagcgctaggattatagctgtgagccactatgcccagaaattcattgacatttataatgtgctatttagatctctgctctaccattgacttactatttgacccttagaaagttacagcacctgtgtgggttaccatttcttcatctcataatgggattcataaatgtactgatcacatagggatgttgtgaataagaaaataaataaacaataaaatacacagaaagtacttagactagaacaaacacccagttaagttttagctaaagcatcattaatcttaacaggaggcaaaggttctctggacacatcaccataccagtgtcatgactcccatccgatccatttccctggcagggcttcgaggggtgagctttggagttgagtgtccactggggggagatgaactggccagcgatgaagctgtaacagaggcagtaatggaggtacctgggtggacccttgccaaattcaggccttcgaggctcacactagccactctattttcaatttcttcagcacgcaactctgtagattctttttcttcctgaattagcctgaaagatacagtttaattatgatccatatataatttaatatggatccattatatgctgctgtaaggatcattggaattcacataataaatcagtagaaactattcttgaacattttacatcaaatctaattttttcatcttttttttttctctaaatagtgtaacttgcagtaaattccagggacttcctggctgcagtttagaaaattgttttcaaatgatacattttttcctgacaacttccagttttaccttctttgtatactaccacctgctaaaactatttaaaaatcttgaacctaattaatttctaccattaatcctaatcttacatttgacctcaggaaccactaaaagagactttagaaactcagccttgagatggcaaaggactagcaatagcttagaaaaagtgaaagattataattacatgtaaatatccctcttaagattcaaagtcattgaatcttacctcctacctaatgaaaaagtttaaatgatagtatcctcagtaaatggtcattcataattagccaaataaaaccctgagtcttttcttaatattaatacttagccaagcctcctttaaataagtaccagaaaaggtaataatgtgaaaatatagttatatagatagatgatgaatacataaataatgaaaaagtaacttgcaaataaaactaggccaggagtggtggctcacgcctgtaatcccagcactttgggaggccgagatgggtggatcatgaggtcaggagttcgagaccagcctggccaatatggtgaaaccccgtctctactaaaaatacaaaaatcagccaggcatggtggtgcatgcctgtaatcccagctactcgggaggctgaagcaggagaatcgcttgaacccgggaggcagagtttgcagtgagccgagatagcgccactgcactccagcctgggtggcagagtgagaaaaaaaattatataaattatttattacaaaggcacaaataggaaagagctttagctaggttgtgtaaaaatcctatttgaatcctgaattaaatctatacacattttgtatgttgttataatgaaactgtgtaccagtatagtttgataagggggtcgtaaaattctcctgagctattttgttcttgattacaaatggtttattgggatcccctcttatatagaacctgtaccttcaagtttatgatcacttcaaagttttctttttacatatttagaatggagaatgtaatttatttgctaaatttattcgctaaatttattcaataggaaatacttctctggtgtacgtttactatgggaagttgagctacatttactcacctgtttttatatgttcaccagctctttgattattaactcactgctggtgtcttcactaactattctgcaaatctttcagtttttaagtagtatgtgtttgctggccaggcagaaagtactttggtagtctacttacatgtcattggaataagtgatctttgtgattttaataggctgtttaaaaatcttacaaagtatggacttaaaatctaatcaaatatgtttcacaaaggttcattttggttaaaacattatgaggcacatttacacttaattataatctttcacttagaaaaagaacatgaattctgttactctcaaagtttattttcatgaatgcattttttaacttcaccccaaggtcagaactccaaagaaaggtttaatcaagtaacatagtacatagtaacatagcttaacacacatttgaaagaaaaaactatcttcaccctcaaaaaataaaaatgtaaaaaaaagaagacattttgtacttttaaaatacttagtagaaaaatgactcctagaaatttttttctggtgagatgtaacatggttatgctgtacacagaaattttggttattaactttaggtattctataaattgtacaagacagccaaacctagaggaacaagttgggtaagagagtatattgaagtttaatttaacagacaatagtagctaactataaaagcacagatgaatgaacattgctgtggcaaatgagtttgaagtaatttgaatcagcgagctgtgaagacagaaaacatgcattttttaatggctagattagtttatgaaagaagaaaaatcttaatcacagaaaaattctggttgttattagcagttcacctggtttgaatcaagatgactatttcttttaaatgtgatataatctcatttcatgtatttttaaaatcttacaaataaacaactatattaacctactggccaagattgttactagaaattactaccctaatgttacaaagctaagagtcactgaagagaaatagcttgttatggagggtgtgttgatctctttggtgcaaataaatatcacaagaatatagacttgatttcaaacttaatttggtaaattcgaccattagctgaacagcctcagaaagtgttattccgttattccgttaatacttgttttacattatttttctatttagagtaatcaaatatttatgaagcactctctaaatatcaagcgaagtgctaagacctgcaaataaaggtgagcaaagccagatacatttcttgctcctgtataaaagttacaatctagtgaaggtaaagaactgaaggacagtactacgttccttgaagaagtgatggaggagctgtccatggtgagtaagggtaacatgagtgaaatgttagggtagaagggtgtggaatgacaggaatgttccagaagaaagggatgacacaacaaaagaaagagcatggaacatcaaggaactagaaagtaggcaaggtaaatggttagagaatggtgagacaggtgaggtattgtagaccatattaaaaagtgtggttggtatcctaagaacaattgaatggttagaaaaagggggattacataaacacatttgtgtgtttaaaagtcttctctggctgtagttaggttggtatatggagaactagcatactacaaagaaaccagatagtaatggttattgtcataaggtaaaaaactattctaaagtgcagtagggtgatgataggtaatttgaataatagtagaaggaagccaactgatttagctagacccagaaagaaaaaagaaaggcattgttcaaaagacttaaaacctgttcacccattgaaaaaacaagttaagaatggtttgttgatattcagaagaacacaaatctacctgacacaattgggttcatcactggggttagtcaaggaaatgacagaaaaagctgatgtcattggaattcaagaaaccatatattaaattaaaataaaagtatcagagtgccaacatttctcaatatttgaaatgttaatttgtccaatttcaattgtaatgaaaaccatctattattagggtactatatagcaacagtacatttttttcataactagtatgaaatagttcatatcaccatatgttttattgcctttgaaatgaaaatataataaagatatttgttaggctataatattaaattatgtctcacagatatagtaagccttttatatttaaagaatgcaaatgaatttggtccccatttacttagaaaatgttcgcacatatgtccccaaaatgctaggggatttttaatgatcagcctgatttgttataaacttcagcattaatatgtgaaaaatgtattttcactgatgtaagaatattaatcataaaaaactctataagaattgtgtctcagtttaagatatggtagcagcccaacttcaaacgcaagttttaggcaccagtgaacacaattaaacagccacaagcactaagattaacaatctgaggctgggtgtggtagctcacacttgtaatttcagtattttgggaggccaaggcaggaggatcattagagcccaggagttcaagaccaccctgggcaagggagactatgtctctacaaaaaattaaaaaaaaaaaaaaaaaaaagacaggcatggtggcacatgcctatagtcccagctacttggaaggctgaggtgggagaattgcttgagactgggaggttgtgggctgcagtgagccagatctgagttatggcacactagcctgggtagcagtgtgagaccctatttaaataaaaaaaaatctgaattttcatgcaatatgttaatacagaaatgtaatttttattattaagaatagtagtaatatgtttggtttatcccatttaaaggcattaacttttattttttctcaagtgttccaggcagagaagaggactctatcctgctttctgcatttgctttgctatgaactgaattttatctcccaccttcaattcataggccgaagctgtaaaggccaaagtgactgtatttgaaaataggatctggaggaggtaattgaggttacatgaggtcttccataaatctttctttagtaaaggctctcagatcccttaaaagtatttaaaaattggagtgaaattaatttgctcttctgacaagttcaagatcaaggttccagcaggattctgtttttggtaaaggctctctgttcctggctccaggaaaagggaaaggtgggtgggcagtggggggcagacagagagagagagagagagagaggcttaattctatagaattaatatattaatgttctatctctctctctccccccactgtctttctgcctcccactgcctgcctcactttccctttccctggagccaggaagagagcctttaccaaaaactgaaccctgctgataccttcatcttggaccttccagcctctaaaactgttaatgttaataaacttccaagaaacacgctgtccctgatataaatggcataaaattgacaaaaagaatggtaaattaatttcactccaatgttgaaatattttaaggaatctgaatgcacattaatttgcatactatttggtacctttattgcagtatgtaatgtatctgaagaatgtacgtgattaccacacacactttccctttaagtagtaaattttaatttaaaaagtgctttaaaattcactggagaaagttttgcctttaacttattcttctgtactgtcactgatgtcattaatcttatatgtttcatgtatgttccttacaaaggctgtcctaatattataaaggagatatacaatatcctgggaatcttctgaaaatacacattctgattcagtgtgtacggggtgaggtctgagattctgcagatctattaagctcccagttaatgctaatgcttctgatctagtaattacatttttagtacagtatcaaggtcttctaatttcttgaaatcatcagtactaattgaagttacctgatttctttgttgatggcatccaattgttcctgaagcatcatggctagcgtctgggcatcggaatgaccacttggagagagaagatccattgagctaaaaattgtttctctgtcatcatcatcaatatcagacatttcagtgtcactttcaaaagggtggctgcttagtactccaatctgttgagttctattccactcgtgatccccaagagatttcacctgaatggtgaatgaaaaaatgcagaatatttatcatattgctcattttcaaagcattaatctcaaagacagcaacaacaacaggcatgcttttacaactgaccttgcaaaaactgaaccaattattaacattttaatttatttgcttccataaaatagttccttgacatcttaagtaatgtgagggattgtcagtataaatatcaagattttagtagaaataaagatgataaacttctatatgttttatagttcaatcatattccaaggtaacaattactttaaagcatgtatttgtaatacttttccttatttccaaatataacaatctatttatttgtactcaagcactcacgacttaaactaattagtcttcctatattttcttattataagctcagaccacaaatattatcacataagaaattacacaggaattctcttcccaacatttatttacatcgattctaacaaaatattatttaaaatattgcaaaatgatgtacaggtatactccacagagatttcagggttagttccagcccaccctgataaagtgaatatgacattagagtcacacaaatttattggtttcccaatgaatatgaaagttatgcccattctctactgaagtctattaagtgtataattgcactgtgtctaaaaaatgaacataccttcattaaaaatactttatagctaaaaaatgctaatgatcatctgagccttcagtgagttttaatctttttgctggtggaaggtcttgccttgatgctgatggctgctgactgataagggtaatggttactgaaggttgggtggctgtgacaatttttaaacataagacaacaatgaaatttgccacattgattgactctttctttcatgaaagatttctctgtagcatggaatgcagtttgatagcatttaacccagagtagaacttctttcaaaatcggaatcaatcctctcacaccctgaaactgtcttatcaactgtgtaatctaatattttatatcctttgttgtcattttaacaatgttcaccaagagtagttaccatcttcactgggagtagattccatctcaagaaaccactttctgttcattcataaaaagtaaatcctcatctgttcaagttttatcatgagattgcagcaatttggtttcgttttcaggctctacttctaattctagttctcttgttattttcaccacatttgcagttatttcctccacagaagtattgagcccttcaaagtcatccatgagggttaaaatcaatgtcttcttaactcttattaaggttgattttttttttttgagagggagtcttgctctgttgcccaggctggagggcagcggcttgatctcggctcactgcaacctctgccacccgagctcaagctattctcatgcctcagccttcagagtagctaggaatgcagaggtgcacaaccacacccagctaatttttgtacttttagtagagatgagatttcaccatgttggccaggctggtctcgagctcctgacttcaggtgatcacctgcctcagcctctcaaagtgctgggattacaggtgtgagccattgaacctgatcaaggttgatgttttgaccttctcccatgagtcataaatgttcttaatggcgcctagaatgatgaatcgtttccagaatgttttcaattggctttgccccaatccatcagaggagtcactacctatggcagttatagccctgtgaaatgtatttcttaagttataatacttgaaagccaaaattactgctttatccacgggctacagaatgaatgttgtgttagcaggcacgaaaaaaacaatctctttgagcatctctgtcagagctcttgggtggccaggtgcattgttaataagtagtaatattttgaaaggagtatttttttctgagcagtaagtctcaaatctgtgtttaaaatattcagtaaaccatgctgtaaacaaatgtgctgtcatctaggctttgttgttgcattcatagagcacaggtagagtagatttagcagaattcttgaagaccctaggattttcagcatagtgaatgagcattggcttcagcttacagtcactagctgcattcattcacccctgtcctctgagtctttgaagccagtcatttacttttcttctctatatatgaaagtcctagctggcatcttcttccaatggaaggtggtttcatctacattgaaaacccatcgtttagtgtagtcatcctcatgaattatcgtagctagatcttctgaataacttttaacagcttctccatcagcccttgttgcttcaccttgcacttttatgttgtgaagatggcttccttccttaaactttatgaactgaacaaccctctgctagcttcaaagttttcttctgcagcttcctcacctctctcagtcttcatataaatgaggagagttatggtcttgctctgggttatgctttggtttaagggaatgttgtccatgctttgattgtttatcactaaatgatcaaatttacgtagaccactaaaacgttctccatagcagcagtaaggctgttttgttttcttacttgcgtgttgtttcttattttccttcaggaacttttcctttgtagtcacaacttggctgtttgatgccagaggcctagcttttggcttaactcagcttttgacatgtctttctcactaactttaattgttgctagcttttgacttagtgagagatgtgcaactcttactttcacttgaacacttaaggctattgtagggttattaattgatctactttcaatattgttgtgtcttggggaatacaaaggcccaaagaaagggaaagcagtgggaaatggctgttggagcagaagcacacacaacatatagattaacttcactatcttatattggcatggttcatggtgtacccaaatgattacaatagtgacatcaaagatcactgttcacagatcaccataacagatataataataataataaaagtttgaaatatttcgagaactggtaggtgcagtggttcacgcttataatcccagcactttgggaggctgaggtgggcagatcacttgagcacaggagtttgagatcaacctgggcaagatggtgaaatcccatcactacaaaaaatacaaaaattagctgggcatagtggtgcccgcttgtggtcccagctacttgggaggctgagatgggaggattgcttgagctcaggaattcaaggctgcaatgagccatgatcgtgccactgcactccagcctgggtgacagaataataccctgtctcaaaaaaataaaaaaaaagaaatattgtgaaaattgccaaaatatgagacagatataggaaatgagcacatgcattgaaaaactagcatccatagacttgcttgaggcaaggttatcaggaaccttcaatttgtaaaaaactgacaaacaaacaaacataatgcttgtgaaatacaataaagcaaagcacagtaaaacaaggtatacctgtaatttttaagcccaaggcatgctaatttacatggttatgttttttaaatggatacaagaaatcttccatttgaagtaagcaattgaccagtgtttttcaagctgttatctgaatgtatgaggaggctgagcataaaagacagatcctagatctcttttattctgcttcttaaaaaattggtttttatttttgtgatcatataaaatgatttctatggaagaccacatgatacttccctgagcattgagttaagaattgagaaccagaattagtatttgtgttacaatttgttttggtatcaagtagcactaattaatttgtcacataataatgagaaaagaattgagattaacttaatttagtcttcatttgctcatttatttattcatgtattcaacagatattgaatgcctactatgatggattaattaatacatggcatactggtgccagttcaaacccaaaagtcatcaagggcctgtgtacaaatatggacaaatggattatatagtatttggggtgaataaaagtggttgaaagaataaactatgcttaggcaccaaaggactattttacttctctgtaaaatacaactacattattcaacaaacagcttgcaaattttaaattaagttactgactgaatggaaggctagcactgccccttatcattaatagttctttatgaacacaaggaatagtctatgtacattttcttcaaagtgtttttaaaataccaattttaattaagttaatttgaatgaacaacatgaatgccattgctcaagtgcccaagaaaatcaaaagactacatgtttggcaatgtagcataatagttaatattacactactaatagtactggaaactacacaaacataggcccaagttttgactccattactttgctacctgtgcaatgttgaacatttagcttttctgagcctcagtgtttttatgtctgaacttagtatacaagtagtacccacttcataatgttatatgaataaatacatgggaaatgcttattcaactttgggcccatagtaggggctttatgttacttatagtttttttaaaaatgtcatactctgtgtttcaaattaataaaaatgctagcattttctaattatctcagtgttaaaattctatcaaaaatgaaactatgtatttaaataaaactagagaagagttgaagttaaaagattaacctttggctcatctcttcgcacacccatgcggcctctccttggtcttcttattactttagttgttctgtaatcagactggctgtccactagggatcccactgagtaccgcaactcagctgaggtgtctagatgagttctggaaaaaaggaaaaatataaaataatccaatctcaaaaattaaacttaccaggaaattactatctgctgttttactggcaataaagcagaaatcctcaaggaaataaacctcaagaaagataaccgataaattgtcatgactctctgaggcctctttagagacttatgtcagaagctgcagtcttaggtccattcctgaaagtcaagtgcactttcttcttttagaatatacagtgcttataacctttctgtttattatcattttcaaatgcagtagtaaaatgaatcataataagactgataatcaaaatccattaggttaaattctggcaatttagtttgagctcttttgtgtatatcacagtatgtgctattgattactgtatttgttttaaatatttcttatacatctagctaaaaatgtctgaaatttgagggtcccagaacttttccaatcttaaaatttttggagaaatttattcacattgtctatttttcacattctatttttcaatttagagaatcaacaaaatgcttaaatttagatggacccaaggcttatggtcttatttttataaaagaaaataggatatactaccaaaaggattttttaagtttttaataagacattgtttcaaaaggatgaagaaaaatcttttcataagcacatttgattcttaaatctgcttaaagatgaaagagtcggaaaattttagttggaaagtatcattacactagttttcaataaacatggtaataaagtaccctataatcaaagtgcagaaaaggcttctccaggcatattacttatatgtagatttatagcaaattcattttattgttacaataatgatgataataacagtgacataatgctgtcctataaaatgaaataacagatctatcatcagtaggaaatatacttaaagctgttagttctattgaatttgaggctcctgctgattgactatactctctttttcagttattcttgtgaacaaagacaagcacttccaaatatctggtaacattaaaaaggggaggtgaggtttgggtgtttgcaacagcagaagacactaacttaagaaagttcttgttttgccaaatggggcattagaacaaatgaactaaaacattttccatcaaataggtgacagctattgtttttgtagcaatgtatttgagacttaatcaagtaaacaggttttatcatggataagttacatttaaaaaaaaaaacaactaggccatattcataaaggacacaactctgtctttatctcttgggcagaggctctaagtttcatgaagaacaaagatcagattttagtcaccttcctatgtccaggaaggcgttcctagcatataataagcacttcataaatatctggcaagatgataaataaaagaaatgattataagacaggcttaaactgtcttgttgtgatcagtctgggttcctttttcctgtggctgcttaccttaatgtccctttaggcatcagggtgaagtttctaacattataactcatcatcctaggagcattgttttcttgttgatttatttcacagctccagataatttattttaaaaaaaagcaaaacacagatctaatcatatcaatttcctgcttaaaattattcaatgtccttaaaggccctctataacttgggcctttgccactttccagtttcattttaaggtactctctgcctagcttttcatacagctgtactgaccttctttcaattccagtaactcacactttcttttcatttctttgaacatgcttttgtttttgtttgtttgtttgtgttctcctgaaaacagtctcaacacatgtggttaacagttttaaggtctcagtttaaaagtgctattgccatctacccttctagctcctagtattcttttttattgtaccagtcctcaaactcatctctctcctcttttttccagttctctgagctagttctctaacaggagaaaacagaggcaatattatcatactagttcaatttttaaatcattctaggtgttcagtattttgaaaggcttttggaaggtctaagtaagtcacaaaataggcatcagttcctttaagcaatgaaccctgtagcttctcctcctgaatctcctgtgactcttgcatgtaatctcattaaagaacttgcataaataagccaggtaagaatttttttagagaaaacctattacccatcgctctgcttcctggagtgttctctgttgtcctttccaattacccagagtctatcttttttcagagttgagccaaatcaagccctttgtagtcactctggaactcattttactttcttcttagatgagatattaagagagaagagtggtcactgatattcactcaccttagcttatctctcctcacctctccacctattagatcaaaacttagtagactgagttctcatgcacctcctatttccattattgtttttacgaaattacttgtcctcagaagcatgaatgttctataaataattgttgtttaataaatattcagttatcctgtaacttattataataagttctgtttagctagcttaccttaattatttctataatactttatacttgtgatatgatttactatacatataatccctactgcttgtcttattttatctgcaaaccaagcctgtgatataatcagaaaaatatcatttatgcatatttaggtacaaatatgtatttatttagaatgttattaaggaaaacaggtttccaaaatgaagcagcttgtaattatctgtgagtcctaggaatgtggattgtcttattcttggtctagggttccttccactacaatctgttgatcaaagaataattgttctatataggccaaatcatccttcattgtagataaatgtcacattgttaggctgcccataatgactcagtgcagtgatagacttttagacaacactttgaaactctgtattttgagacataaggtcaaaaaaacaaggaaatggccatttattcttaatcaaatatatttaatctattgatttgataatgcttattctatgcattgactcccctgatattttaccagttcttctccttctccttctccaccatcctcattataatcatcataaccatgtgaacacataacattgaaataataatttcagttcacatgtaaaaatcagaatcttaaaaatgtgaaaaataagaacgattttctcaattaatgacttacatatgtaaaagttctttgagtgtttttatgcctgccgaactttttctcatattcaattgagtatggaagtacttaaaatatcaaatattgtttttccttacatttatattgaaaagaatttaagacacttcaggattttttcaatttgaatttttatttgagaatctgaaaaatgctttaccagatattcatttattcattctataatatatcttgagagcatactatatgcaagatagttttttaggtgttgagattatggtagttatcaaaacaaatacaaacccatcctctggtggagttaactttctaaagatgaacataacaccaagaaagatgaacttctactaaaagcctatggtagtggaaagtttcaaacggctgctattattctgtgttgcctagtaaataagtgactaaatgagtgtgtccttctagggtttctaacaactttaaataaaacatctcaaacacaaaaggaaattatgtgtgaattattaacatatagatctatctatgtatctatctatgtatctatgtatctatctatctatctatctatctatctatctatctatctatctatgatctatcaagtaagctgccatccattgcttctttttcttaagatgagatagtgaatcaaagtagatgagtatggctaaatttatttgaagtttttgttttcttttcttttatctgattcatttctcttttcctcttttttttttttgcaattactttaccgaaataggtagatgctaagtgaccataatcaataatatttgtttagtcacataagcattgaacatatttctgcatgtttctacactgaacacatatagaaaattttatgtcgaattcaatttctgtattgaacacatataaagagaagggctgacgcctcttcttgaatgagatgcaatctccctgtacacagttcaatttcttcaattaagaatcttttaatatatttatatatataatgaaatgcagaatacaaaagttaacattttaattttttattgattatctacagaaataatctctaagttaaaaagttatttttgaatgtaaaaactgcaaatcagtgaagagtcaaaacatgataatgactagtgagcaataggaagtactgatttattttagttgaggacatatgaaaccataagggaattcatgttgattttcagtgaattatagataagcttttagtttaatgttaccttggtattgtgggttcaattaaagagccagttctcattttcaattggtcaagttcagatctcagcttttcaatttcttctgctaatctttcctaaaaaatcaaaacagtgttactcagatgccagtaatatcagcaagcaattatgataaatgagtcttaatgattttttttaaaaaggaaaaactgaggatatatttttattaaaggttattacacataataataaagcacgccaaaattttccccttgtaataaaaaatgtggatagcagaaattaataaaaatttatctacaatctctggcattcactaatcctgaatatttgaaaattcgtgggaatattaaaattatgactagctatgtagatgtcacttaaaaatgcagagtagaaatcatatgcagttttgaaaataaagaaaatgtcttatttatgcagtaaatgaagaactttcattattctatgagggttaaaggacatatgggtgaaggaaaaagatgattggattgaaagaaaaaggaaagtaaaccctctggcttttactctgcatgagataggcaacaattggaggatttttttaaaaaatattaattaattaattaatttatttatttatttaaagacagggcctcactctgtcactgaggctggagtgcaccttaaaaagtaaagttaataaccaattagcttgatattgtcaccattatttgtacttaattataattttctcaaattggcattttctggtctataaatttatgaagataggggttgtcttagagctttaattaactgctcatgtaagcattcaatttggttttaatgattataactgttatattgttttacaggtctaaatgtatcattctagatttttctattactgtttttccccttcccagtggccagtgcttgatattttactttactcaaacttttctcaccacatttttttttgttaatgtggcctttgcaatgtttctcttttctgttctttttattctcactacgtcactaccatcctactctaagccctttttatctttttcctgaatgatttttaccagcttcagtctctttcctacacatttctctgctagacatataatttcaaaacacatgtacaataaactaatgtgttgctttaaaatgttcaatagtttcttattgatttgtaaatatctttgttcattattttcacaaaagtgcgctgagtacctcttgtgtgtcaggcacctgagatacagtagtgagctgacaaatgtcttgccctcatgcaatttagaatttagtagaaaagatgaataataaacaagtagtaatatagaaatatagcatgttgttagaaaggagaaaacaggggagtcatggaagggtttttcaataaagtgatacttggacaatgacctaaataaaggagaaattaaaaaatgagactcttaggaaaaggcatggcagataaaagcaacaacacgtgcatacgcctcttagtggaaatggagtagagggtaaggagtccagtgtggctggattgcagaggttaaattgacaaatagaggatactttttaaaagtatgattgcagaactcaggaatggtagtcctaaaagaggttgtaaaccacttcaaactctggcttttactctgcatgagataggcaacaattgaaggattttaaaaaattattttatttatgtatttatttatttaaagacagggtctcactttgccactgaaactggagtgcagttctgtgatcacagttcattgcagtcttgaactccagggctcaagtaatcctcttgcctctgccttccaagtagttaggaggactacaggtgtgcaccactgcacctggctaatttgtttttaatttttatttttgtaaagatggggtcttgctatgtttcctggattttctagcagagaagtggcatgatcattctaatggctgtgaaatagattgtcaagttgaattgggagtcagaaaagagaggaaattttgaggcaagagagtaatggtttggacaagaatggtgttagggtaagagtggctatattttggctatatcgtgagagtagaaataagaggatttgatattggactagatgtgggatatgaaacaaacataggggtcaagactaagtccaagttttttagcctgagtaactgaaagaaagaaagaaattgtaattatgattgactgagaagactgctggtgtgttaggttagatggtggtggtgtttgatgtgtgggagtggggtgagaatagactggcatgttacatttgaggtacctaggtgtccaaatggagatattgagttggcaatagaatatataaactctctcagggaagaggacccagtaggtaatctaaatttggatgtgctcaatttatagatggtgtttaaatccaggagatcagatgaagtcactaggggtgaatcagagagaagaaaggaaagctacctagaaacttcaaattgtagagataaagatggaaagggaaacactgagaaaagagtttgagcctacagagggttttgctgataatggactgtgagtacagttagtttagtggaaatttgaggaattatagaagatgtggtcagattagtgaatgtgcccatctaaatgggatgatagttcagacatgagatatgatctgggatttactctctctggagactgacataagcaaggatgcaaagcatggcatgattagtactcttggttgcttaggcagattgttggagttacaaggctttggtaggtggtgggggagtgggttctggggatattgccaggagcacacagagctttggataacataacatgcataacagcatcacgtccaaaattcacaatctgctcaaaaactacttctttaaatacataccagtcacagtaaacttctgatgattcatcaaatcaatcatcttgattttctttgtgccgttgcagaggattcatcctctacttagaatgctctacctttatgaagatcatatatgtctttaagaggctactaaaaatgtaatctctgtgttgtttttgtgaactacctcagaaagaatcagatactatattctaggccccacattacattgttctaaagacctatctttcaggagattgtggacaccttgactgtagaattagttatttttaattgcttcataatatgcagcatccagtagggttaaatgtataattgttctctttcctctattcttcatcttttccaataccttctatatcccatactatccctccctccctccctccctcccttccttccttccttccttccttccttccttccttccttccttccttccctccctccctcttccctttccttcccttcccttccctcccttctttcttccccctctcccttctttccttcattctctttttcccttccttctctctctccatttcttctatcttttctcaacatacagttatagatcacttcttaagttagcaatcctttcttctttaaaaaaataagataaaattgctaacaataactttaaaggctaatgaagaaggaaaatactattagcaattaccattaaaatttcacaatctgcccttagtttcctcttctaccacataccctacaacaggaataattgattccagccaaatagttgtgcctattatttaaaatgtcacactcattacccatcccctcaccccaccaagcacctgtgatcatgccacatgcactatgtttgaaagcctggggtcagagtcctactttcccttaaatcttcagtcaagtccctccttcctgaagtcttcttcacagcagcaatatatcatggtctttcctacctgtagctcttactgcctacttcactaatttggcatttggcatctgctaccctgcatcctcattggtttgtaagggctgtgttctctctcctcagttagatttttttagctcctttggaactaggattatgtttggacatatataacttagcataattctatttataatagtatttaatgtatttctgctgaaagaatatctaaaactgacataaattagcgcatatattttaattctatttatataaggcataaagcaaggcaaaaccattttttaatgttataagtcaagatagtgattatcctttaatggaagagtatgagtatagactaatttggggggagtttctgaagtgctaatttttggtgaatttgggttacaaagattcatgaagctcttcctctctatgtacgcttttctgcacatattctaaaaagttaaaattgttttacaaagatagcatactaaaattattttttcaaatttattttacaacaaaacattcatcagtggaatagaaaataaaaatagaaaatgggcccaaaacataagtttccattataccttatcatgtaaagattcttcaagattctttctgaaagtttctgattcttgaattaaaacattctaaagaaaagaaaatagcagaaataattaataaattaaacataaaatacttaaaaatatattgattaatatcttatcactcaagaatcctcttagattccttccttagttcaggtatttcttggtttccatggaaaccatgctttgatgaaattttcaaatgtgagaccttcacatttaaaaaatacataatttaaatgggaaatgctattttgtaacacttgaatgaacaaatgaaataaatattgcattttaagctacttctgtttgccttttctcagaccacattttaaatcagaaactattggttattcttcaagtaagaaaaagtgagcaacaagctaaatcttagaggtgttataaaaaattcagaagaactcacttctattgtctgaagaaagaagaaatcatgaaatcatattttttaaaatttcactttctggacatctactgcaatgtggaattaacaatttataatgatacttaaattattagagaaataacaaactctagctattcagaaacctaatattacatgtcacaaagtcagtggaaataagttggcatcatagatacttaaaataaaccttgccagaaaattatttttgttgttaaaaattatttatttttctacaaaacacacaagtactataagacattatttaaaataatgtattctttttcaaagttatagaataaaattaaactaagagtgtagtaattgcataggggccatgtatttgaagttgtatgagaggaagtcatgtcttattactttctaatgggtaaattaatcaaactaactttttgtcaaaacattttccctattttggtttattttatgtactaatggaaaatgtctagctaaaatagtgattggcattcaatctagatttctaaaatgatgtgatcatccgggttttataccctaccttaatttatgctctggaattggtaaccagctctcataactcttgctggtctggtagctgccaactatcaatgagacatatataactgtaaatcacattgcagactgtacagaagcactatttctgaaataatgcagctgaaaatactgggttcctaaaccctctactgggattgatactagttcttttgatgatataaactcacttacattttgacttttagactggtgtgtaggtatcagtcacttgacacgtgaatatttcaaatcaccttccccccaaaaaagtattgacttgtgtctcatcacttttctattttgcataccaggcaaaggatatataaaatattttcatcataaaagcacagcatattttaatacatttgcctcatatgaacatgtgaatataaaagatttatatatcatgcaaattttttattcatcccaaatttgatcttacacttttttaaataaaaaatatgcattcctttctaagaatataccaggcatttttaaaaactaagtaaatggatcatctgaccattacaatgattgcagctgtatataaaacaaacatgagcattgcaaaatattcatgtgattttacccttctatcgttttaccttttcttctagagcagccattctttcctttaagtgtagttgtaggcgttcattggattcagtcagaagtctatcaaccgtatccgataatctcttgttatgctcctcattcattttctctctttgcctagccttacattttaaaaaatgacataaaaatccattcaaaaactgtttgagattatttttatagtgttgctagttttaaattgaatttaattttacatctgttttgattaaagtggtggaaacattttattcaagtcaacaggtcatatttgtaagttttaaatataacccatactcagttaaaggctttcttcttatatacagaatacgaattcataaaccaatgattggggggtaatagttcttaatatacatactctttgaagttcttgattcttctcttcaagttgaccctctaaatgtctcatacgttcttcaatatttccatgtctctcttcagcctgttaagaaatatgaagaatacacctgaaatgtaagatttggttaacacttttcctctaaataaattgaaataaaatgtaaagcaagctactaccaactgcaaacatagtttttaaaaaataaactttcttcaaacaggcagctgaacagcattgcttgaaatgtgtcagctacaaaggcctgttacatccaagcatcagcaaaacattggagttatttatgagcaatgaaatcagccaaatgtaacatgcagactgtgcatggtttgaacacaaacctgccattgtccaatcttaagctcctgaagcactgaactgcacagatggttgattatcaataaataaaagtaacataatttttataaatgaaaagaaaaacttagatggattctatttagcaatagaaagtaaagtccagtaggactaccttcctacgtatggagatcatttcttgtagtttagcttccataacatattgataatcatcagatgaggtagaagaggttggatcagactaacgagtcaaggaaaaggagagggacaaaattgaaaaatcagaactaaagacactgacaccaaacagaacatagcacagaatgcttaaaagaaaagtgtgacagcaaatttaatactttaatagacagaattttatgtggaaagaactacattgatatttggtgaacacgatgcagttgatggttttaaataaaaaacaataatatactaaaataaaaagctatcaacctaagatatgaaaggttagtgatggctggcaatgaaagactactacagaatgaataaagcaactctgaaagagttatataataattggaattatgggaaaccaaacaccagaatatgtctctgatagattgttaaaagtttgtattagggtttgtttgtctatattacttaaaaataatggaaacagtagtttcacaatgttgaggaaaatgctagacaatgactcaggtgtaattaatttggaacaaaatttattctaaaccttgctctgtagaaaaaaagataaaaaaactaagcctgggggttattgtgagtagtccccaattcaagcaagattgagtttcctcagcaacaggaaaacttatgaaatgacttctggtctctgaatgcacactatggtcattggtctagaatctaatggcctactctcagatacttggtctcaaatattggtctaacggtccactctcagatattggtctagaatttaatggcttactctcagataggtttaattagaaattttaaatgaaaatgattgaaagtcctcaaattatcaattgacaacaatgctgtgagaacaagaaatcttgtttgtgactctcctaaatgacattaggggccaatcccaaactgttcctgcattgatttgttgctgtggaaacaaaatagtgcctaaagtgaataggcagcacagtttccttgtaagctcatgtttgcccagtgccaaggttagatacatgtcttggaggtgaccgtcaggttaccacaggtgcagagtgttcaacacatgtgacattgctgatagcaaaattgttagtatgttatgcaaggattacatatgaagttatatcaacattttaatcattgcaagttaagtaattattacatttaaaggactctatgtcaggactacaaatttaactccacagcatattctgtcacattttataagctcattctaaaacagtgaaactcactttatgccaatatagaactatatataaatatgtcatgcagtaactgaaaagaaatagtaacctattcatttgattcagatgcatatatactattttatgcaataaattcaaatttaatctatgaaagcaaacatttaacatttcaattctggtgtgcttatgcaaactacaattcaacatttacattttgtaaggctttccttctgatattcttattttataaatgtggaagataataaagacatgataaccaattcctttcctccaagtcgtcctcaaatttccaatttagaagctatacagagttaccatggtccccaaatgccataattttttaaataatattatttaaaaatatattttattaaaaataaaaatttaaataatattatttaaattttagagtaagtggatcaaaatgttgttgaaattatataatctaaattcataaagatatctgtgatccttcaaaattacattttaacatgcagttagtagtgtttaaattaattaggtgactgactcaagacacttgagacatgaatatttcagctgccaaaactgtgtcttcaaaaatacaagtttttagaggtctttaaaacttctagttgtttctgtttacttattaaaaacacatcaaacttaaaaagaaaaaacacacaaaacaccaaaattgtgaaaattcccttcagagaaaaaaaaagaatttggtcctgtttaaattcctattattgctgatacattttattggtactagaaataaataaaatacctcattcaagatgaattatgtccttgctaaaggaatatgcattttaattaaaaagtagatattataaatcataagactgggagcccaaagtaatctttattggttaattgcgtataaactcgccaaagcaaaacttttagttgtatccataaccattaatcaatcattctgactttctaaaagacataaataagctttgcctatacacacacacacacaaacacacacacacacacaaacacacacacacacacaaacacattagaaggagaaaaatagtttatcaaccaaagaatgcattcagacatcccatctaaataatatatactgggaccaattttcaaccaacactactgatttgcattctatgtgaaaactatagttttagcaattgttgtaaatacaaagatcacacagaaacagtctgctattttttatactccttggtgaaaaactgtttatcttagtttcactccttaatatgatataggaaaatttaaaatatactaaagttttaggatgaactacaggcagaaatggttttgagaacatgaataacctcagaaagggagaagaaattaaatttaaagagaaagacctagaaaaaagaagaaaaaaaggtgacagtaaagtagaaaaacgtatattggtgaaataaaatgtctgaggggttattaagaatatcattcaaaatataggaggaggaacccatgtttaagctaagaagaaatatttttactttagtgagtagtcaaaaggttaatgaacagaaaaagactatgatgatccataataaggaaatatcagaaacaaattgaaacagaaaaaaaaaaaaaaaacagatataaaaatagaccctaaaggtcttgagaacagagtacaagaaaaagtacaaggctgttgaaaccacaaaacttgggaaaaggaatgaaagagtgatcctcaaatgtttaaaaaaaaaaaatgacaggcaaaaggaatgtgttcaggataaaatctcagtacttaaggagctttcataatgaataaaatatggtcataatataaaaagtatatatttaaaatatgttgttgacaaagcaccagtcagaagagaaagtgataaaaaggagagtgaatcagagcatttgaagactttttggaagaattccaattttctgaaaaatgaaatcaaagaggttcagggacagtaaagggaggagaaagctgaggggagctattttttgtgcccaaggtaatattgtgcccaagatatatatatatcaacttaacagactagacaagataagaggaaaaaatataaggcacctaattccagttatttttatatattctaaatcaataattcttgggagtatttaatatagtgttttttatgtcaaatattatattttaaattgtttttattctcagtctatcaaaggttaatgtggggcagtgattttctgaattgtaaattgtgttacttgggggaaattgcagattttcttgtgttttagtcaagataatattgataattattttaagctacaattttacaaaagttatttttcttattcagtaactcatctaaccccccaaaacagtgcaattgaaaaagataactctttttgaaagtcctttatgttctttagatgaaaggcctaattatgcatatcttagtctaggttatagtcatttaagatctgtgtttgcaagaaaaaatgaaataatatgaacatgtttaaatattttttcaaattaaatgataaattaatctttatcttagaaatcacatattcctgaaattgccagagtggtttactggcatggtttgtgactacagaacgatccaaattataatcccatcttaatcagttttatccaactagttactccaacactctgtaaacaagcaactatttaaatgctctctaatcctgctctacgcagtcaaaggtttgtctttcattacctggttaattgtcctattttaaccaacaggaagatcagtccactgttcatttttaattatttgcttttttagaaaatcagatgtgtgtgtctacttcattgctgcatcaattattttgggtaaatcctaatcccgtaattttaaacttgaagtccagatacctatcatactcacttattgtagtggccttgaaaacttagcaaatattaatgattgtataaaaatataaattgtgtgattatttttgaattcatattaaatgtcaaacatgcttttagtgacaaaatgtagttttatataacttgtgacatatacatacactttgaaatgatgccatttccgtttgattgtcagaggtcagaatagttctttttaacattataatgcttgtaaaattctaaaatattcagatagttgcagaatctactggccatattatacagaaaattttgaacactcttcagcgtattattgattttaattttcagatgaaattacaactataaaactgctttctgatttttaattgttttagacctcagacttttataagtctaacttcccacttctaacaagttttatactgtagttggagaggaatcaagaagttatgatattctctatacttctaatagcaattgatgtgaagcctgttaaattgttatgtctcatataacattatcttttttgtttatctccaggattattatacaaatattaccatggaaaattaactataacaatgacatgaaattttacttgttttgttaatgtttaaataggcagggggatcatcacatttgtataacaattattcctgctggcataaatatgtatgacaagaaaaaaattgacttaataacagctcaatataatagagattaaacttaattttcataaagcctatagaaaatctttacacattccattttgattacaagtcctttctacaaatatatctaggttgaccagttgttctagtgcagtaccttggttagggctgcaattctctgagccagttcagcctctacttcaggcaaggtttcagcctttctcatggtctgctgcaacttttgttcagctagctcaagacgttcttgtaactgtctgtttttctcttccatctgaaatgggaatgggagcagagacacttaaagagtcagagtttggatagcaaacaccagtcgccaggggctttgcacttcagccatgattctagatttaaatcagccactaccacacctaaatgtgcaaagtgttgattgttgtcttgttatcatatattgcttatctgtttccttcatacatttcagcacattaaaacaatgaagaagctcttaccactggcagcaaaaaggaaagaaattactcatgagtatacattttaacaaagggaatatagctcagtactaagacatcagatataccaccgtagcaaaatattgaaaatcatggtatttagactggagttggagaggtaatgtagcatgatgatccaggctctagagataaggttgacaaacattttctgtaacaggtcagatagtaaaaatgttaggcctcctgtatcatatggcctcaatcccaaatactcaactgcgttgtagcacaaaaacagtcatagacaatgattaaatgattgggcatggctgtgttccaataagactttattaacaagagcaggcaaccaaccagctttggcccacggctatagtttgcctgtttctgctctagagcccaataaacttagtattccattattggctctggtgtttagcagatgtatgatcttgggaaagtctgactgtctctgaactgtagtgtctttactacaataacgccacctacttcataggtggtggttagaattaagtgaggtaatacatgaaaactgtttagcacagattctggctcatgcctatatgaaaagtaaatcagagtcattatttgtattactattaagataaataatttatctttctggaaagtaaatttcacactgaaaatcgtatttgttttgctagagaatttcaaattttagagaatgattactcaaacatctgtcaagaagtaccctattttatttactccgttttgtgagaatgatgagaacgcacagaccagaagaaaaccaagacagagatactgaacctgccgcaggatagcttctttatttgctaactcattttctagtttatcattcatgtcatgtatggaggtagattctctctgagcactgaggtaacgcttttcaagggttgtaattctttcttccatatcttccttttgtgccatggcctacaattaaaataatttagaaaaagcaaatcagattctcagattgtttaattattgtcttgttagttaaataaaaaagaaacataaaaactattgcattcttgaagtaaatactcattcctttcttttcattgaacgaatgtgagattgcaggtgcatgttcccaacttagctatcagaattatttttgtatcttcggttaaccaaaagctttctgctgtctaagaatgcaatggagtagcttttgaaactctctactgtagaattggcattcttgtaagacaagtggcagataaattagttcattatgcagtaaaattaagtacaataatgagtagagttgcaaatcataaaattgttaaaatggtggctacagttctaaattgtaaagcagtcttcaaatagataacaaataccatccgtattcttacctttacattaagaaagaggaactctgtggttaaaaggccaggccaaaaaaaaaaatagtacatttggatcttatttataagtttaccagctgacttagaaacttagccatttacctagttatatatgtttcaattacataagattttaaagaagtccatgaacacataaatataggaaaaaatcaagttcaagtggagaaaatcatggcattgataatattttaaacagtaatttttaaataatagaatttatagatagtaatatggagataattttacctcacagcttacatggaaatttattggtagttagataacctactttattgacaagatgttgggtgaaaatcaagtgcagaagtgaggctcattggcctggaattgtttcctgagaatgtgggaagcttctttgtataaggatcctggaattgaggaaatggctatagtttccatatcttattatccagaatcatttcatcacttattcttaatcagtgcctttgtcactctcctacagggtccagagccagtcctgtcacatataataatcagataaacagacagcctttcttccaattttctttcttttttttttcagatgataactctaatgaaaagataggttgaataaaaagtaaaataagaaataaaataggtaatgtcctaatctaatataatagcaagacataaattttgtttaaataaagagagaaaataccagaagtagtggataaaagggttgaaattaagaatttcagggaaatgggatgaaaacttgaagtgagatgctgtgtgtgtttatacatgtaccatatttatacgtgccattatttgactttgagaatttttgtatatataaaaaattaaaattaattaaaaagtaatagatcagccagaggcgatggctcacacctgtaatcccagcattttgggaggccaaggtgggcagatctcttgaggtcaggagttcgagaccagcctgcctggctaacatggtgaaatcccgtctctactaaaaatacaaaaaacttagctgggcatcatggctcatgcctgtaatcccagctactcagagaggccgaggcctgagaatcgcttgaacctgggaggtggaggttgcagtgagccgagatcgcaccactgcactccagcctgggccacagggcaagactccatttcaagaaaaaaaaaaaaagaaaaaggaatagatccaccatgaaactcatcatgttgtccctagtctcctgcccacccacaagttagctctctctcttgtattttttgtcttttattctccttacttttcctccacgctgctgcctgagagatatttctaaatgatcatattgcttcttggtttcaatacttttatttcttcccctccatcttcagggtaaaatctgagctacaaagcctggaataaaagtggttttgtgacctgatacttccttacttcagtgtactggggctaataacatccccccaaaattcgtgtccactctgaacctgtgaatgtgaccttatgtgcaaataagattttgttgacataatcaagttaagatgaggtcacacaggattaggataggccctaaatccaatgactggtgtttttacaaggaggggatttggggacacagagatataccgggaagaaggaggaagtcagtcagagaattgcgttatacggagttgtactgctaccagccaagaatgccaatgactcccagtaaccattagaagctagaaggggggaagaagaaatctcactagagccttcagagagaatatggccctgctgaaacattgatttcagacttaaagcctccaaaacagtgagtgactaaattatggttgttttaagccacccagttggtggcaatttgttatggcaggtttacaaaactaatgcactctgacatcatgtctacctggaatgtgtgctgtcttctttgtctagctcaatcctactgaccaccaagacccagtcaaaagctacttgattaattatgttgacattaaagtgcaaacataaaaaattaaatttaatctatgaattcagcaaaaaatagccagactaatttttaagaaatattatatacatactcctagattttagatatcctaaataatgcctactatttaaaaagctatttattttcacttttgactttttctactttacatattttttatctcaatgatggtagagtttttatcttagaggatcttttcagagtgcttaatattgtattctgtcagtttcatttgcaaacagaactctgggaaaattttgtggtctgaagagaaaagtctaaagctaacctgtgtaaataaacttcttactaaattttaacagcaataaagtcaataaaagatatacacacatttctcaagaacgtgagcactgaagtagtacatacttgctccaaatgctagtttgggacacttattaactctgttataagggatcagtattggtcaccttttccgtgcttcaccttcttcatatattgtgtgggttgagattctaatatgtagcacatagcattgttgttaagaatcaggaagtgctttgtatggtgtctcatgcagaaaacaccctcgataaataatagctgttatttattattaattactattatgtacacaattagatgatctcactctatgacgtagattacatgcaggaatttttgcattttgtaattttggtactgcattttttgattcagtgattcatgtgggagattcaatttttaactgcaggctgtgttgccaaaaataaactggatttacaagtcagagaaatagcttttccctctgtcatttgaaaaattctgaaagaggaagctttttctagtccctaaaacttgctacctacaaaaaaaatgagaaaaaataaagattcaatgatctcttgacctgaagttcatgtataaattggattttgttcatatttaataaatataactctctggtaatttagatctattaaagtgaaaaatataactacatgtttcagataacagaaaaggcaacactgagatgtatttaattcatttaatcacatagtgaaattctgaagaactgttaataggaagttggaaatacaggatggttttattcacaaaacaaaatgtaattaaaatactccactgaaaattttagctactggcacagctatgtatttgatatatcattatccatacacaattaataatccttttgattaaaaactggagagataatccacttgtatgagattgtctatttttctaatttgagtgctgtgtctagctttaatccaactcacgtattcttcctagatcaaaatcaatttaaggagttttgtttgaagacaaaatgtaaaatgaaattaaattttggataatttcttttttgacaaagaaaaattacaaaagtatattctgaagccatcagtggaacatatttataaattagattggtgcaaaagtaattgcagtttttgctattcaaagtaatagttaattttagataccttagaatgtcctcacatgcaaagcaaattatatttctgttttttattatatggttgttttttcttatttcctaatttttactcaattattacaacatacatttattacctgtacaatttataaatcatactatgctagcaatgctataggagtatcaagaaaaacgagcttatttttttctactaagaaacttgcaatccgtggcttatgcctataattgcagcccactgggaggatgaggtgggaggatcccttgaaccaggaatttgagaccagcctaagcaacatagtgggaccctttctctacaaaaaacacaaaaattttccagacatcgtgacatgtgccctgtagtcttagctactccaaaggctgaggtgagaggattgcttgagcctaggagttcgaggttgcagtgagctgaaaacactactgcacttcagcctggacaacagagcaagactctttctctaaaataaataaataatattttaaaagaataattaagaaaaggaaaagaaacttgcaatccagttgactctatgtgaccataacccggaaaaatattattcaggaaaataaaagctttaagtgctaagtaatttgttttttaagtacgtgattttcacatcttcctgcttattgaaaaaaaaagatccaaatattgattatttagaggacagttatgttgtagcttcattttatgatagttgctatcactgaattatttattgtgctgtgttgattttggaagcagttcatagtggaagaagcacaggttttgaagccatgctgatcttatttctcttccgtgctgccgaggagggaactgcatagatctttggcaagttactttacctcactgaaccttgtgggtctcatctgagaaaaatggagataataattagcattgccccttttgccagttgtgaggaatttgagactttccatgtaatacacccgtaatagttttcacatgtgactcgtccttaaaaaatctttcataaaccatgggcctgggtcttgagacctgaatatttcagaattcgtttatttagctttcacagtgctgtgtgtgtgtgtgtgtgtgtgtgtgtgtgtgtgtgtgtgtatacaaaaaaaaaaaagtgatgcatgcagtaacgcaggctgagtgtaggccatttcacaggtttcatcaacgccatcagttcctacagtcttgcacctggcactttacacttttccattgccagcctggctctgaaaacatttgtgtttgcaacctcccttcaaaggtggatgatgagagatattcctttctcaggaaactcttctaaaatatatacatagaaacgatggggctgataagagtagttgtattttaaaataattccacatgaaaggagaacgttttgcccattagaatggattcttaataaaagaacacctggcatcataggagtgacattttccatctgactgggtgttttgttacctacattcagaggctattagtatcaaggagttatttttaaataggcagttagaaaatggggattgaatgttgggccttacctgtaagtgatgctggattagataagcattaatagagcaatgagtactaagatgaaaggaaatcatctaaatctccagggccaagagaatgaagatggagagaatgaacaacagaccaagaagtgagcccggtgatttgatagccagaaatcctagtaattccttaacagtgatacagaagaggggttaaactgcctttactttatgaattctctgagtttgaattgtggggagtagtgaagagaagagatgcatccatgaactattatattaattcataaaaagttgtatcattatctgtgctgcagtggagcagtctaccacttcatggttcatctatctcttttttttgttttgttttgttttgttttgctttcaggcattgtcgtagtacatattctgatatcattcacaccttctgatatttacttataaatatctattctttcagcaaagattttttgagtgcctattatacaatcaatagctgcgcaggttctctgaagacagcagtgaacaaaacaagaaaaaaaccctagctcttatagatgtttacgaatagttggggtgggaggcatatgataaccaagtatatcagtaaaatatacattgtgtcaggtgatagaaagtcctgtgggataagcaaacaaaagaagagggagagtgtatatgtgtaaataacaaggtcaggggacatttcactgagaaaacaacattgaacaaaaggcagagagaaaagaaaatgtaacaaaacaggtctggcttgcttaagaggtcactccagttgagcagagcatgttaggatgagacagtagatgatctccaagaggtcaggaaggtggtagtagagagattgtacatggcttgtagaccactgtgagggttttgataatagtgtaagtagaataggtagtcactgaaaagttttaagcagaaaagtgacatgaactgacttataggcaggctgctcaagctgctgtgttgagcacagactgaggtgagctgaacgcatgagcaggaagaccaggaaacagatgaccattgaaataatccagtgagagaaagtgattgtgtagaaaaagcaaaagccatgaagattctgagaagaggtcccattatgaatactttgaaattgtaaataacaggatttactgctgaatcaaagcaagtgtgtgaggggagagatcttaaggacagcttcaagattgttggcctgagcaacaataataatggataaggaagactgcaggagggtctggtttgctgagaaaatatcaagaaaagagtctgaagtgctaattttgagatatcccttagtgactgagagagaaacatctggaaatcaggaaagaaggacaagttggagatattaattgggaatcctaagatgatggtggcttttggagccatgagactgcagaaattcaccagggaaataaaggtaggtagagaagggaagacactccaaggtcggggaggagaaatagaagcagtaaaggagccttcgaagaggtaagcaagtaaatacggatgaaaaccagaagaggataatgtgctatgagcccagtgaagaagtcctctggaaaatggatcaagtgcttcagaagactgagaattgaaccttggattcagtaacatggaggtcagtaatgacttttatgagaagagttttggtggaacagtcagggaaaaagtaagatacaattggcttacgagagaatgggaagaaaagaattggacacatagaatagggccaacttgatgaacaactagctagttatatacaaaagatacttttaaaagataaaaatacatttaaaagaatatgtaaaaatggaaaaggcaaaaagtcagaaaacgcaatttccacaaatataattttcttttcagttgtgactgaaaaggtgaaaaagtgaaaagattctaaactttcaccttagcaggtaaaatgatttgacagtgttacaaattaaacatctcctagtatttttttttagtaacttaaagtactctcttcacttgatattagccaagagactgagaaatgactaaagtactcatttttttaagtagaaaaagggatgttatgtctaacaggaatttaatatatagacaaagaaaggtcatgttatacatatgcgtgtatatgtatattaacagagatacattccccttcatgacacaaaaccaaaataagcaatggaacaatttaaggcatttttgtagtattcctatatgctaagagtatagcaattcatgattcatacacatatctagagttatttaaaattaaaagcttacatttaaaaaattttattaacagcttcagaatgtctttgttatatctgacccttgatagcacaaatttctttccatatatcatgggcatttaaaatgctcatgaagtaaactatgtttgcgctattgaacaagtttcataactaatataatgcatgccaaagtatggtcttttgagaagtaaaaagtgtatggtcattacgggaaattatggaaacagtatctcagaagcagcattcagaaatcaaagactgaaagtggcatgaatcacttacctccctaatgtccctttgatacttggtgttcatttcttctgttttaatgagatcctttcttgctgtctctgcttcctgttccacctctcccactcgggaagaaagggctgctaaacgttctttcatctgggccatttcatagttttgcttttcaagcaattcttgtagttcaactatttgactagtttcatcggttgagtctatagaaccattggacaaacgctgcagaaatagaaaaagaaatggcacttaagaattttcatctttaatttaaaatttaaaataaacttaaagaaattaaactgacactgctttcacagtgagaaataagaaattctgaaaagaactagttttgccgaaaaactaagtttctaaggaaactgttaattgacattaaaatatgaaggtagatcagtaattttcaaacagtttaatagatgtatttgaaatatgctatgctatgctctctctatatataaaacatagcataaaacattgatgtatcctaaacatttaagtgttagctactattttataaattagatatataatttattattaatttacaatgctatgatataacaccatacattatttttaattaatgggtaaggacctataaggtgtacaattttaaaatttttcttcaagatcccttgtaaatttttaagttttattttcaatgatgcccagaagaataacttaccaaatattttttatcaaagattattcctgctgtgaatctgacctagctggaacaaacatatagtatagaaaagtttttatttctatattgctattaacataaaatcatgtgtgcacacaactcacaggaaggaggttgaaaggggttaaatattttgagagctgatttttcttctttccgaaaggactgcttagaaaccagggttttctaaaaatatgtcttcagaagtatgccctacagctaaagtccgaaatatataaacaactcaaacaactcaatagaaagaaaataaatccccagataagaaacagggaagagacctgaataaacatttctcaaaagaagacatacagatgaccagcagatacatgaaaaaatgctcaataccaacaacgcatcaggaaaatgcaaattaaaaccacgatgagatatcacttcatacctgttagaatggctattagcaaaaagccaataagtgttggtaaaagaataagaatgtggtaaaatggaacccttgtatgctactagtaaaaatgtaaattagtatagccactacagaaaaaggtatgagagttcctcaaaaaatcaaaattatcatatgatccagaaatctcacttctgggtatataaccaaaggaattgaaatcactgtgtggaagagatatctgcactcctatgttcaatgcaaaattatttacaatagccaagaaacggaatcaacctaactaagtgtctatcaacggatgaatggataaaagcgagtgtggcatacatacacaatgaaatcctattcagtttctaagaagaaggaaattctgtcatttgtgacaacatggatgagcctggaggacattattctaagtgaaataagccaggcacagaaagacaaatacttcttcacctcgcttatctgtagaatctaaaaagtcaaactcatagaagttgatagaagaatggtggttgccagaggctggaaaaaaaggatagctgtgatgagttaatgggagatgttagtcaaagagtaaaataattcaattatacagtaagaataatggtctattacacagcatgatagctacagttaataataaataatacattgctagaagagtagattttaagtgctctcaccacaaaaatgataagtgagtgagtgatggatatattaacttgattgaatcattccacattgtatacatatagcaaaacattacattgtaactcacgaatatgtacatttattatttgtcaattaaaaagtaaaaggcctggtgttgtggctcactcttttaatcccagtgctttgggaggctgaggcaggagactgcttgaggcgatgaatttgagaccagcctgggtgacatagcaaggcctcatttctagaaaaaaattaaaaaaaaaaaatagggtgtggtggcatgcacctgtagtgctagctgctcaagaggctgaggcaaaaggatggcttgagcctaggagtttgaggctgtagtgagccatgatcatgccacagcaatccagcatgggcaacagagccttacaacctttaaataaataaataaataaataaataaataaataaataaataaataagaaaagaaaagaaagtatgggctgtatgtggtggctggctcttgtaatcccagtattttgggaagctggggtgggaggatcacttgaggccaggagtttgagacctgcctgggcaacatggggagactccaactctaaaaaataggaaaattagccaggtgttgtggcacgcacccatagtcccagcaactagagaggcagaggtgggcgggttgcttaagcccagaaggtccaggttgtagtgagccatgattgcattagcgcactccagcctgggtgaaagagtgaggctctgaccaatagtaataatgataataataataataatgataaataaaagtatgctcctcagcctagctactttggagaagttttgtagtgaggacggtgcagcaatttgggagaaataactaagagaaaaagaacataagtagaaacaaaaagtatggagagaaaatacagaaagtacagtcatttccgctcatgttttcagcacttgtttaaaaacatgaatttgtttcaacatgatagatatattataaaacaatttcaatgtaatgcaaatttttttaatatgcaattttgttcctgagaagcactggctaaatacagaaaaccacacctggctgaaacaagccacataggaacacataaaatgcacacatgcccattcctcaaatatctaaaactgacctcaatgccccttgtatgtcataaatttgcccatcgacacctgtgttacaactttctgatttcagatacctttccttctaccacttcacaagaaatgaaagcctttaagtcttctaacacttctacaagcaaacttcagctctttctcggggaaaaaaaaatacttatcactgtatttgtgctatctccaactatttaacaggtgtaaaattgtgctaccatttttattagcttttttacttttattttaatgtgacactgataaagtttttagtgttgtgccataaacttcattacccccttaagccctgtgatttttattgcacaatattgcatagttcatgatatttaggaatgcaaatgacacatagagtagaatggactatagaagaatgagaagaacagaaagcatcatgaaagcagtgagaaagataaaacacagagaaaggaaatgcaggcaaatggcaagaagtactgtaagtccaataacctaaacaatgtgagagtgtggagaaatagctgagagaatcaaaattaaaagagcagagaaagatagagacaattgcctttttaaagttgactagaggaatttctcaatgtgagaaggtagaagttctaataaatcttatggtggtctagttacttgtagactttatacaggatttgaagatatttaaaattatggcaaaacccctctaaaatcagttatcatacctcagttatctcaaatttggaaataactgactggcaattggttccacccatcttccctaatccagatcttgggtgctgcctaatgattataaactggcctttctgagttcagtgtacagatagttgtgtactgtagaagttcacaattccctccctctaagagcaattcccagagaaatgttcagctctgatccttcaaccagcaacatttccagcagaaaggggaatacagactctaaagggaaatgtgattaatgaactgcagtatgcactccaacattcccacatattcgtagcagcacttaccccttttattaaatagaatttggcacccaaaatacaggagttctatgttcagatatggaatgatatcttcaaagaattaggtctgtagattcaacttgtatcttaagagacaatttagtaaccaacagggattccttggaaataacgtttacatactataaataaaagtacaatgcaatcatgctaaataattaaattcaaacacacttcttaaaaatagaagaaactattgtactcttggggtaaacaaatataacttgatatgcttgtacaatgaaaacaaacatattactgatctctccaatacaatgaatgaatcacaaaaacattaagctgagaaatagaaagtagatacaaaagagtacataatgtgtgattcaatttatttgaaattctagaaaagatcatcctaatctatcatggcaggaaaacagattggttgttgcctgggctgggagttggaatgggggaggtggggttgacttcaagggggcatgagagcacttctaaggtttatggggatgttctttatcttgatttgggtgtttacggaggcacatatatttatcaaaattgacagaattgtgcacttaaattgtatgttacttgtacattaatacatttgcttaaaagcctataaaaaccttgaaaaacaaatttttattttgaaaaatgtttcatagaattgaaaaatcatatttaagattctagagctctgaagaattttggagaaactgagactcaggtaatcacatagaggtgatctgaattaaaatgcagaacttttattcccagttcagttaatttacgctttaccacattgcctctaatcagaacatataaatcaacaggataaaattatatatgacgcatggtataggcatgtaccaagcaggtaccaagcatccacacaccattatatatatatatatcactcacacaccccaagccccagacaaccactaactactttctgtcacacagattcgctgttctggacttttcacagaagtggagccgctgaacatgtgttctttcgtgactagttttatgcactgagcatgatgtttttgaattttattcaatattttatatatatatatatatatacacacacacatatatgtattcagtggagtttatatatatacacatatattatatatatataatattgataaatatttatttggtgcaaatgaacgatatttattttctaatttgaaaaatgtttgttccaattctgtgcacctgcgctccattaaaatcttgttaatgcacttaacaagaaaattgcatacttttaaatgggctcaaggtaagagaaatttaactaactatagatagtaatcaggcaattaaaataaaacgcttttaaaatgttaactttttaaattccattaagcagtaaatgttcactgcatagtctttatgctactgtgttgggattacccatgaggagattttaaaactctcaatttttattccatagtgtttatgaaacttgcatttgcagaaaatatataatcttttatttgttctcattaccttaaatagattgtatcgtgagcttactgtgtgtcttaataatatcagaataaaaagtcatattaaaactgtgatttatatcttagaaaaagatcttgtttttgttccaaaccattgttaacttgacttacctttaaaataaattgtggcactttaatttaaatgacaaatggctgtattaaaagtcagtacttattttaagcagctctactgggatataatttacacgccataaaacgcaccctttaaacataaaaagttcagtggagtttagtatacttacagagttgcgcaactatcaacattagttaatctcacattttttcacccttagtggaaatcttataattattagcaatcactgacacacccccagccccagacaaccactaactactttctgtcatacagattcgcagttctggacttttcacagaagtggagttgctgaacatgtgttctttcgtgactagttttatgcactgagcatgatgtttttgaatttcgttcaagtaccgtagcatgttatccacacctcatttctacattgatgaatagtattccatcatggggatatattacatgttatttatatattcatcagttgagggacattaacgttgtgtccaccttttggctactataaataactgccgtgaacttttgtgtataagtctttatacggacaaatgttttcagttctcttggatcgattcctagagtagaattgatggaccatatgacaattctatctttaacatgttgaggaaatgttttccaaagtggttgcaccattgtacattcctaccagcaatgtatgagagttctaattttccacatcttcaccaaaacttattattgtctatctttttatttcagctattctagtgggtgcaaagtgatatttccttatggtttggatttgcatttcctaataactgatgaagttggacatcttttcatgtacttattgttcatttgtatatcttatttggagaaatgtctatttaaattatttgccttcatattaattgatttacatgtatttttattgttgatttacatgaattttttacatatattttgattcaagtattttatgaaacatatggcttgaaaatagcttttctctattctgtagaccatcttttcactttctttcatgatagtattctttgaatttcaaatgtttttaattttaagaagttccagtttatcatttttttttctttgtggcttgggctcacggtgtcatttctaaaaaatcaatccccaacagaaggtcataaagattttcaattttttaaagcagtacaagtatatatttgaaattattaatgatcaaatacaatggtgtctcatatgttaaattttaaaatatatatttatatttactcattcatcaatatttattaatcacctactttggtgtcaagtggaagataataagttttagaatgttttaaaaggtgataatacttttctgacatcaaggcaattctatcaagcaaagaagtaatacacaaataggcaaggatatgcattgcaataaagtattatcataaagttttattttgcttcatatttatgtgtgggagcagaaagcagagaatatctttgtgatatcctttgagttgggtcttcaaagatgagttattatatttcaagtaaaggaaaggaggggagtacttattctaggagcagaaaataacatgagcaaagggagggggatatccctgaagaataattgtaagtcgtcctgtatgcagagcagaaaacatgtgctataaggaaatggtaaaatatgagacttgacagggaaggccagcatagattacgatggcctttgtttttccatactgaatagaataaactttgggtaccagatagaatgacaaggagccatcaaagttgtttgaacagggaagtaacatgtaaaactgtgcaagtaaactgttactctgtcatcacaaacccggtaattcagataaagccattcctatctgtaatggataatttttgcttgtttgttcaatatcctcacagctagggttgccagatgaaatataggatgtacagttagatttgaattttcaataaacaatgaaaaacttgagtgtaatgatgtcacatgcagtatttgggtcaagcttatactaggggaattgataatgaaaagaaagcattgagctaaaccctgcaatacaagcataaatcatgcagttttctggcagaggaaacagaaagatcaaagacaaagtgacacaagtgggtttaggattttcaaggagaccattgtagctagaatggactggactaaataaagcaagagggtgggagtggatatagatggaaatatgatgtgtgttcttgagatcattttaagactggcttttgctcaaggtgatatgaaaactataggaaggtgttgagcagaggagtgacatgatttcacttacattttcgatggattcctcagtcctcttataaaagacaggacaaaaaaaggaatttaagaaaatgaattaagaggtgaaaaattacgttggcttagaccagggtaataggactaaaggttataaaaggggtcatattctttgaatggattgaatatgatatgggacaaaaagcatagactcaaggatgactgcaagatttgtagtcttcgattagaaagatggagttgctattttttgagaagagaaaatctgtaggagaagcagatttgtggttaggatggggcaaaatcctggactgggttttgaaaacaatgtttgaaatgactaattagatgtcaaaataaaggtgtcaggcaagctattgtataagcccacagtaaagaatagtgaatatatggatgttttctgcaagcagctataacattggatgagatcacctgtggagtgaagtagggggtcgtcaaagatgactaataacgtctttgtagaactctcttcaattgttactttatcagaaaggcctttcacccctgccatattatatatttacaaaatatgtttgttgtctttctcacctaccaaaatatatattcctaaaatttttatctctattaaaagtttaaatcttaacttatatattattgtacattcaactgcaatacaattttcacacttggctgtcaaacagactttccaaactcaatatgtttaaaatctgtgttcagaacgtgcttctcccccaaatatgttttgctttaattcatccccaactcaattagtgagaacttcactttttcactttctccaaaaacggtggagtcatccttgagttctctctttttctcccatcttttatacaatctatgagaaaaacttgttggctttcttttcacaaaatatgtgaatgtgacccactgtcatgacctccaccattgtcacccttgtctgggtcatctactctcctttgaattactgtaacaatcttgtaactggttctttttttctaaccttgtttcttattttcattcttatagcagtcagactgattcatggtgatcctgttacattgcagttaagtgaatattcccatgataaatgttaataattatcagaaatataaaaaatagctaggtcccacattacagcatgaaataaacatgttaatgattgatagagaaaaacattcatctgtgaaattcttactctgtatagtttgaagagatgagaagtgtgtatattgagtttattttgtgtatattgagtttatttttttctttagagaaagtcatcaaattgaaagctttcaaatgttttgttgctattgttgttcatctataaaataaagaatcaacactagagtggatctttcttcctggatgaattaccaagtagtccttttagatgtgtaaatataagtcaagtaggctcccacatcccaaggaagaatatttaatagaaccctgacaaaaagtgtctcctctactgtgtcttgatattaagagagtggaggaggaagatatttgacataaaccaggaaacttcaggaaggagaggaaaaaacagattgctcccctttcaattgtgaagttcaatgtttttcttaattctctggtagactgacaattgactagatcacaaggagtaccaagagtccacaaagagaacttaccatgagggaagtaagagtatgaatttgaactatggtccaacacccagtggtggttctggcatggaatctgaaagaccttcctggctcagtcatcttgatgaatttgggaacatgagtatgaacctaaacttcaactggtaaaacttggagaatggaaaattcttcctgaagaatcactttggtagaggttgtcactactgctggtggaactagtttggaaaaactaggccatttattggcataagatggtttaatttggcctgtatgacagtgggttattgcagtggtgcatggatggtgttggattttgagggaacacttgtttcaaaagtgatactttgagggctaaaaatatgcaatagcagttttttaaaaatttactcacttgttactttatcacattttccagttatcttttcatgaattgtaaacaaacaaaaaacaaaaacaaacaatcaaacaaaaaaattcctttttggtctgatcaagttttgaaagtttttagataacttaggcagaacaacattggccccaagaggctggtaccagacttactgttacttggattacttgggctcttatatattttagatagtcaaaaaagagctcaacttgcctgtatccaggtcacaaaaattatgtatgtaaaggattaatggtaggcatagaaataatgaacactaatcaagtacaacagagtttaatttattttctatttttaaaaatttcacttctgtcagagaatcatgcatacaaaaaaaaaatcaagttgtttatccctaggaaaagaaaaacagttccaaaagaatatgtgccatcattctcagcaaactaacacaggaacaaaaaaccaaacaccgcatgttctcagttataagtggaagttgaacaacgagaacacatggacacagggaggggaacatcacacactggggcctgtcagggtgttgggggcaaggggagggagagcattaggacaaatacctaatgcatgtggggcttaaaacctagagacaggttgataggtgcagcaaaccaccatggcacatgtatatctatgtaacaaacctgcatattctgcatgtgtcccagaagttaaaaaaaaaaaaaaactgtccatgaaatccactacttttgaaagatgagtatattgtattctgaaaatacttcttagcaaacttgtaaatgaaattccaaacctgataaaagctatctaccagttactatgataagcatcacattaatgaatagcattattattaaagtctatacttttacaagctttatatgtcttggacaataacaataaatgaaaactgaaaaggaagagaagagaaaagtaaatcctcccaatctgtgtaattacttagaaaataccaagagtatagcaaactcttagaactaatagttttgcaagtttgctgtaatccatatcaatattggaaaatcaatagcatctttatatgccagtattaatttattaggaaaaacatataaaggagataacaatcacagtaactataaatgcctagaaataaatctaatcatatataagatctctatgggaaaaattaaacaattttattgaagaacataaaataatacacaaatgaatggagacataagccatatgtacacatggtaaaacagtatacaatagaggcaataacttcccgaagttaatttattaatttaagcaattgcagtaaaaatcttgttggggcacagaaaacgattcccccaaatatgactttggcttgttgagcgctttgaaaattgaaaggcctcagaaataatccttagaaccaagatctgtctctgaccttcctctcctccctttctctctctctctctctggaatttccttatctgactgaaaacacttctttccacaaggaatgtaattgtctcaagattcccctcttcaggaatcctgtcagattaaccactagagaagagcagaaattgggagtcgtcatgccaagacagatttataatctgttcttcagaggacagctcccagagattacccaggggacttaatctgcaataataaagcaatatttattcctgcacagtctttccccttactttcctttaatttgtcagtcccacccagcttccaaaaagaatcatttgcaaaatgtctgcctcctgaatccatacatatctcctatgtcgagaatatttaagcatcagccctctggcccctcttccagtctaatacattgtaaatggcagttatatccatatgcgtgttaaaataagttttgtgtgccttttttcacattaatctgccttccctcaattcattttcagcaaacctttagagggtggaagaaaattttctccttggcccctacaatctcaacagagttgaaaaatggaatttgaaaagttgatattataattaagctctaagaatcaagatttataaagttaatcattaaaacagtgtgatatttatttcttattcttgaacacgtatttattaagtgttcatcatgttctaggaactattctaggtacctgagcttcatcaggaataaaacaaggatcctaacttttatggaggttattatctaactgggctggcagacaatacattacagacattataaataagtaaagcatataaacacatgctgtgctataatacattactatgttagaatatgttatgacatttgaacaaagactggatggaagtggggaagttagccatgtatctggaggaaaggcaattcagacaaaggaaagaggaaatcaaaagtcaacaggaggccagtgtggctggggtggatttggatgtgaagtcagaagataaagacagtgagatttatgtagagccttgtgtaagtggaaagaagttgcagagttttgagcagacgattgatgtgttcagatatatggtttaaaacatcactcttgtatcaaaatatcacatgcaccatataaatatgcataattagaatatatccatagacatttttttaaaaatgaaaatgaacagattactctgattcatgctgttttaaaaatagactggagatggcccatgggagaagcagagagacctcataaaaagtgattgattacaataattcagctgagagatgacagtggttcaaaacagagtgatcaatggaagtggtaggattctggatatattttgaaggtagagtaaatcaaatttctttatagttggatgggaggtgtgagacatagggaggatgtgagagtaattccaaattctttagcttgagcaactggaaaggcaaagttttcatcatgtaaactggagatgatggatcaaattttttaaggggggatatcaaatacgtaagcttttgatattttaaatgtgcaaagtcttttagatatacaagtggagatgttcgattgtggctggatatatgcatttggttgtagggtctgaactagaggtaaagattcataaattattagtatatgaataggatgagattgattggaatcatggagagagtgtaggtagagaacatgtggagggctgagccctggggtgaagaaagaaagagaagaagagaagaaactgggagttgtcatgccaagacagacttatcatctgttcttcagagagcagatgctccaacattcagaagtcagagggaggaaaatagatggagatgtagccactggtaagtaagaggaaaacaatgtagtttcctgtaatgcaagtgaagaagtatatgaaggaagaaaactattaactatgtcatatactgctgagacatcaactatagcaaggcctgagaattggccttatatttagcactataaatttagtgatgactgtagcaggagtggcttctgtgctatggtggggcaaaaccttattgaaataggtttataagggattttaaaatgtggggccaaaagataattttttttaagttagggaaactttgtatattataagaatacagtcgaccaggggtgcccacgttccaagccatggacatgtactggtctgtggcctgtttgggaccagacttctcagtaggaggtaaaggtgtgagcaaagcttgatctgtatttacaaccactccctatcacttgcattaccgtctgagctctactttctgtaagatcagcggcagcattagattcacaaagtagtgtgaaccctattgtgaactgtccattcgagggatctaggttgtgcactccttatgagaatctaatgcctgactatctgtcactgtcagacaggaccatctagttgcaggaaaacaagctcagagctcccactgattctacattatggtgagttgtataattatttcattatatatttcaatgtaataatttaaataaagtgcaaaataaatgtaatgtgcttgaatcatcctgaaaccatccccaaccacacccccagttggtggaaaaattgtcttccacaaaactggttcctgttgccaaaaactttggggaccattggagtagacaaagaaaagaaaatgatggcaaaggaaagagcagtaaaatttgctggggaaatatacttgattaaatgtttgctgaagacattacacatggtgtaacaaagttttctttgactaggcttttttgaaatttttgtaagcctcatgctcagtctaataaactcttccatcctcttagaaacatggacaggtttaagactttgcttaaagtaaataatcttatattttgaaatctataaaatcaggtagtttttatgctgccttttccctccatagttcacatttattctttacttacttgttacctgtttatctccaatccccctgttcatgagctacattactttgagccattgatccttgctctgcaaacctcacagggttgttgttacagagatcaaataaaacaactcacataaaggactttatgctggttacttatctcattcttaaagacccgtagccgctttgttaatgaggtttccagacaagtttgaaaaacaatttggctaactttaaaggttaagcaccagcattccttaattccatattaaggcatgtcctgttgaattctcattctgggatactcttatttccctgtgggtaaagagcgtctctggaaacactacatactgtgtttctttcttgacgctcgacaatactaagagttaaaatataaatactgtagtacttacaccagttaaaaattgtacacaacaatatttcctaatctgcttctcctgggaatttcatttgttgggtgagtgggtcctatcaaacacccactaaatttctggggagcttgtgtttcatgagaaatgatgaaatagataaattctaccaaagtgaaaaaatacaattagatcaactgaggaacttctgaatgaaaaacttaaaaattctcctagccttgcttaacagatcgcacaaaacaaaacagaggaaaaagaacttattcttgtgtacatcaccaaaagacaacagattccttggcacaaaatgaaccctccaattatgttaataagataaaggtaactgaacaaatttccagtcagtcagtcttttaaagtctttggaaatatccttcttcacaaaaaaaaaaaaaaaaaaaaaaaaaaaattctgagtacctcaaatcctggctaatacaaatgatacttcttactgaagacagcagagtggatttcacttcatctttccatctaacaaggtcttagttaacacacaataacccagtcactgcacccagagcgatttgttttgaacctaatgagtttccacacagcattagaagacttttatttttgccattgcatatagaagattccagacctttcgttatgtgcttcctcgccaactcagcttctagaaaattgatacaacttcatgtatatatggataagccatggaagatcctaaccttactcttttggtcccttttctagccaatcattgaacctctgggccagtccagcccatgtatatctttagacctgctctttccaagttggcaaattcataaactccattcagtttggtgtttcactgcttgacaattcaattgaagaataaaggagaaacattcaagtcgttatgttttgtaaggaattagaatacaatatatggaatcaatacacagaagaaaatattctgtgagtgcaatccatttgtaaataagcccaattatatttttgagagagggaatcaataatgcataaaatgagctacagttgacaagactgaatctttgaaagaatggttgttggccgtagttaacatgtattgatgaacacaaaaaaatgaacaaaatatagtcaatatattgaagacatgcctgtggatgatgacttttagtcagaacttagtgagaatgattaaaagaatggcatttgtgataaatgatgtttattagtattttaaaataggatgagatattgataagccaaacttttaactggacagctgacaggtttgcatgagagtgtgcaaatcttcacactatgatatctcaatatttcacaatagcatgatggaatgaaatactttgtctccactgaggatcacattgcttgtagagctatgttggcttgttctaagtacctatttttgtcattggttgttcattctaaaacagcattgtattgctaaaagtccacaaaacccttaattttgataaaggcacatcccgtattccatttttatcactttggctcaatattcttcatgaacagtagttctataataaaaatactagacaattatttattaaatttaccgatctgaggattattcttgccactgattcttcattttgctttatgtacttttttgtccataattcttctatctgacaagaactaaagaactgaaaacatgcaaacaaaaatctatttctgattttacatttattcagctttcacatttccatattactgttgcttaaattgttatgttgcatttttagagaacagtcacgaataaatgtcagattcaaagaggagagaagaataagagcaacaacttaaaaaaggaagctttaacttagttcacttagtaattaagctcaaagtgggaatgataagcaaacaggcctgggaggcgagaagaggccagccagcttgggaagaacctcatgtgacatgccgaggatgtgcctcatttgttgtatggtcattgaaggatcagtcaactccactcttcgatctatgaagaactagtgtctcagtcactaatacatgacacgtataaaaattcactgcatatagttaagtgtgactactgttttgtgaaagtttttcatattgttgactcctggtactttttcaggcatcagttcaaatcccaccatcttaaaaagatcccttctttaatgtcttcaccactcaccttgtacgggtcccttgatcatatctatgcccttttacactgtgtatatttgtttattgcctgtaccctcaactgtcttatcatcattatattcctaccacctagaatagggcccatttcttagcacctttaataaggttgccactaaatatttatttgattgaaaacacaggattaataaatagaataagcatttattgcttctatacaatatgcctaagatgatgtaattcattgaatatagtgtttctattcttataactctgtaagttggcaagactattttatctgaaactcagagtcagcggtgttaagggtaaggttcatacagctggtagctggcagagacaggaacttcaaacaaatcgctattccacattgcctctctgacacccctcaatgaggattaattaaccttgtttttaaactctaatattatttttgataccacaatatttatcatgttttatgatattaatttgggcatgtttatttctcactgtagattcttatcaaatttattacagactatatcttctgaatctctaacatatctaatattctactgattcacatcagttagcaaatacttgcagctgaaaaaataattagaagtacagattatacaagtaatgagcattattataaactttacaagagtagcatgtttactttttaaaattcaccaattaacttccatctagaaagaaataggaaaaagttattagagcctggttctgaaaaggtggaatttagtgttatgaaaatttgtattatccttgaatatttatattcttctcaatcagttaaatttaagaccacacagaaatatttaaattcgtttcagttaagtgtattttttctttttattttttcttttaaaaaggctgataataattaccagagttttccatgaataataaggcctatttcagattgtgcttttgtgaggctatttttgtcaactattttgtcaacagagttctcaatccaccgacacaaaacatcttctttgggctaatcacccaccctgactgtgtaacttaagcaaattaactgccctaaacaaagggtaatccttccaactaggatttagaagtcactttcttagttctatcagtatctaataatagttttacatttttgtcctgatcaaccacttttcaatttacacactaacactacagtcatcgttgataatctgccaaaataataatttcttttcttttgtttgaatatacctttttaaaagttctcaataaaaaaaaaataagtattaggctttaaattacaatcctttgacaacttgttttatggcattaatataccttgaataatcatgtcatggaggatgattttgataagaaaaatgctctataatattatatgtgtgtaacttgggagtatttatataaggacaatgaaaataataatcaggatactgttttatgttttatcaagaaatgtcaggtaaaaaaatgtggtatagctgagcacggtggctcacacctgtaattccagcactttgggaggccgaggtgggcagattgcttgagctcaggagttcaagaccagcctggtcaacatgatgaaactctgtctctacaaaaattaccaaaattagccaggcagggtggctcacgccagtaatgttagctacttggaacattgagatgggaggattgcttgagcccaggagaaggaggttgcagtgagccaagttcatgccactgcactacagcctggactgtctcaaaaatatgtaaataaaaataaatttaaaaatgtggcataaataaaacttcttattacaacactttattggaacatcctgagaaatcaatcacaggattaatataaattgaaacatgtttacatatttttaaatttagactaaatatatatgatacattatacacattttaggtttacaccaaaggatatgggcatgatattatgcatgataataatatataattattctaaagcatttagaaatcactgttttagaaattcaaggaagctgaaaaaagcaaatgaataccagtaatcataatgtttaaaaacctttagttacaccaacacaagaagtgaatgacttagcattggcacacaatttcttttctccactggctgaaatgccttcactaagaactggaagtcaaaaaaagttaaagacaattgctttgggtcaccaatgtctcaaaatcctccatatgtgcacttatatctgtgaagaccaatagagacaaatatcaattatgcataaatcctcatcctaattctgtaaccagttcccgaaaaataatctgtcataaactgtcttacattctctaatgtctgcatattcaaatatttagtggttatattgttagagtaggtagttaggcaaccaataggtgatggtcaggtggttgttaaactctctctgtaaaacaattattggttgctgccagtgccagggaagacagactgtaataaatagaaaacattgaatctggtgatcagcagtttccagataagatctcaggagttgggcaagtggactcaagcatgtgcactgagaagcaaaatggcagcatttaactggtataggaatagaacattcctctaggaacactcaactggtaagggaaaaatgcctccagtaagcatgtataggacttcagtaaacatgctgtgcatgcggcccctcccaagtgctgacaggccaccgtgcatgcagacagcccaccccaaaggaagaatcagggcagaagtaccacaactccagaagcatgccagtgtataaaaccccaattcagaggtcaaattgcacacttgaatctctcaagttgcccatttggcccttttccagctgtactttatctcctcttgttcctgctctaaaactttcctgccctgaaacttgccttggtctctccctttgcctcatgccccacagtcaatttctttcttctgagaaaacaagaattgaggttgctgcagacctgtatggatttgctgctgctaacagtaccttgatgaaaaaatatttgaaaaaaatatatatgtatgagcattccctgccctcctcctccataagaagaacacttcaagtatgaaataacctgttaggggataaaaaaaatctgaagttgttcatgtctgagaaaggtatatttcttcatttctggagtagattagcataaatacagcattattatagaaaacaataatttgtagccttttatgaaaaagactagatgaccataaaatccattttttataaccagccaattgtgattctataattctctgaggagaggtatactactaatgacataattaaaatgaaagagcaatatcaaattacatgttggtttcctaaactgagtgctgagtgaaaatgccttattaaagagcttggtggtgtatctactgaagcagtatcagtttatttagttgaaggaaagataaataatgttattctaatctcagataaagctaatgaaatacgtcaaattgtagtttatgttttatatttagcttaagatttctataaaatacatggataaaggctaaattcgtggtcttatgtgaagatctgttcatttgtcagccaccagaattgaagcttctttccggaaattcatctgatttacttactttattttgcttttctacttgaaggaagaaacataagaagtccctctattttttctaaccacataagtgaggaaatgctaaacttaatttatagtaagaattctagtgctatttattgtattgtccagtcacttgcttcttaatcgctaggttttagaaactcttgacattttcaattacagcaatttagctagctgattcatgtggtcttcatttaggagcttaagaatccaaagatataacttgttacaggcaaatgattctcctgagtttccaacacaggatgtgtgaatgcctccatgtaattttcatctgattctagacctaccaataacttaccttcttcctcttctgttggaaagaggtggtccagcacagacaccttttgtcttttgctagtggagcaacagagcgctagtttcctttgtgtgggactaaacttcacccaaaaggagaatcattccattataaaaaatgtaaaagtcccatgacttcacatttcattttatgttatctctcattaacaagagtactgctgaggcctcaaacaatgcaagaaaaatactaatcaaataaaagattaccaacaattttcgcagtcataaacaacaaataagttaccaattgtatattatatcacttacaattcaaaagtgttgttttgcacttaaaatagtcctgcctatatatgtacatatatatacatatgccatatatacacacaatgtgtatatatgtactttaaattatattctttatacatattataaattcaattctatataatttaaatacttttaagaaaatcaattaagagcaggtaaaaaatttgaatatgtgtatatgcatacacacaacatatacacatatgtattatatttaagagaatcaaaataagaacaaatattagaaaggaaataaccataaaccttgaacctttgaccaaagaatcaacaaatactaaaaaaatgttcattatgtggtttttatatttcctgtcaaatgatataagaagtaaacatttccatgtaagagcatgtggggtgtgtcataccttctcatggactttctgtccaggttccatcccttcaagatgttctgactctgtggatccctcgcttgatgccatttttctttgtatatgaacattttgttcacgcaaggcaacaatctgcaaaataaaagcactatgcctttaaagtctaaatagggaataaaatataaaaagaaaatgaatttacttcaatgtggttaagaactaatgaacactaacaaataaccagaaagtgaacattacattttactgaattattattcaaaatatgtgtttcaatgtaggtcaccattttgaacaatatttacaaaaattcataatatctctactaagaagaggttaaagcactgtaaaatttacctaagaaaatattttcttgttggaaatgtatctaaaatcaatgatatatttgtattcacgtgatgttaattcagaaattattttttaaattaatttgtaggatgtaataaaaatgtttttttggtctgtatttttaaagtatacaagaaacataaaagattgaaggttaaagactaattatgagcacagcaatttcgcctacactgatagcccatctgcaatttaatataagcagacacacagctgaacttaaaaaaaaatttgtaatgctgtcatgagcatgtattaaatttgttttattattataattttaatgtccattattttaccaaatttagttaatttgcaaacacaaattaagaaagcagttattcttgcaaactttcagctcaattttaatgacataattatttcaattaaaaaacaaattctcgggtacttatagcataagtgatcctagtaatagagtgaaaaatagtatttcagtctttttaaaatgatgttttaaaatacatttgctaaatatatatatatatatcactttgaaaatattttacattatattaatgctgtaacttatttattccatggcatattttattgtattatcaactcagatagtagtcaatattagttctgggagaaataaaggtacatagtatttagtgcacaataagatctgaataatattaaacttacatgtggaaattacaagaccaacatgtcacaagacgaataatcattaactgaaaaaaacatgatatcaaggggttgggtgtttgccctgctacttgacactatttcaatgccatattaccaccatgtgtccatgacatcagttgatctagctatatgatctctggtatttgagcatttggtatatccttctctaggtatatgttcttttctctcgtataactgtaaacaccaaataattggctccctcacgcttactcttgttcatctacaatctattatccacaaagcagccaggtacatctttcaaacttaaattagattgtgtaacccttcagctttctaacaaaactaatgtttggcccagcgcggcagctcacgcctgtaatctcggcactttgggaggccaaggtggccagatcacttgaggtcaggagttcatgaccaccctggccaactggtgaaacctgtctctactaaaaatataaaaattagccgggcgtgatggtgggcgcctgtaatcccagctactcaggaggctgagccaggagaatcccttgaacctgggaggcggagattgcagtgagctgagattgcgcgactgcactccagcctgggcgacagagggagactctgtcttaaaataaaataaaataaaataaaataaaataaaataaaataaaatactttaaaattttgttaaaaaaacctaaagttttcccagcttatttagccaaaatttaaacttcttaacaaggtctatactgtcctacttgagccctttgcttcagcgacactggcctcctttccatccctcaaacatatctgtctctttcttacacagaactgaggaatttgatgatcttcctgtctaaaacattcttcctcagctatcacaggggacacaatcccagctttaaaaacagttgagatacaactcctcagagtgaatgtgtgttgtcatcaaacactttgtacaatatatccctatttatttttgtgcatgtagcactcaataaagtttattattccatttctccacttcctcatttgcttatttatttagctagcacaagtcctaataatatctcctgagaaaataattttcaaaagaatgcttcattgaaaacagcattttcatatgaagtagcacatcaaattattatgtgcagggtattcactaaaaatgtgttgaattaaataatacatggatatgggaaaacaaagaatctaaacctgattaattcaaaaaataacaaaagataaagatttggagtgtaaaaaaaacttcagaaacattcttttcacattagtcaacatggaaatagattacatcaaaggaatgacaagaagaataaaatagctcctagatatatcatttttatattacactcttaacttattgctttttgcataaatattacaattgatacatgagattttatgaattataaattttaaaatattcaagtatcatttgttgacattccactaagaaaacatctatgactaacagaaatgctaatacaaagtaccaggccatttaaaaattatatgctttgttctattattaatctactcagaagtgaagggagacatttaaaaaatatttaaagaacaaatttaactctcagcttacagattagcttacatttgtttaataaacagatgactttcaaatatgtcctggtgcctgaaataaagcaggccatctataaaagtttattgaatgaatcagtgaaaagatgaattaatgtccctattaaaaaataatcaaaaaatcaaattcattcagaaaaaagtacaaatataattgagccactatgatttttaaaattctaaacttcaagtttgctacagtgtatacatgacaattagttccaaaaatgacataattttcaaccactaacatgcaaactttgttttgtaaaaatgaatcaaggctaaaaatgttggctcttgatacagaagaacaaatgtgacatattctatattctctaccactgtaatatgctattttctccaataacaaattatcctgggtagttatgaaaccaaagtttcagcacctgatttaattgtgggtgttaataagtggattatttttgacactggggaaagggggaaagtttgtagttctcttttaaaaattcccctttgggtgttaagcattttcttcaatctgttttaaagagtgaagaggtcaccaataaataactggagcctaaggtagcacagacttctttaggaaattctcttagctggtttgagaagtgaacacaagagatggctagggaaccagcttgggacaataaatagaatgaaaagaagctaatggcctcaaaatattccctaggctctcactgagagggaatgttgtcagaaggagggcccaagcaaattgcctacaagaaaactaacgtaggtctggatgcctcaccactaaacaacatggcctacttgctatggtttaaatgttccctccaaaacttatgttgaaatgtaattgcctttgtaatggtattaagaggtgggacctttaacaggtttttacggcatgagggctttgctctcataaatggattaaggctgttatctctggagtgggttatttatcattggagtgggttctggataaaaggatggagtttgcccctcatcctctctctgtatcatctcacatgcttttatgcccttccatccctctactatgggataaggcatcataaaaactcatgccagatgccagtgtcatgccttggacttcccagcctccagaactttcagaaataaatttattttctttaaaaatcatccagtctgtgatattctgttatagcaacacaaaacagactaagacactactccaaatatgattacatgttgagtaggaggaaccacttatgtacaagtcctgttgtttacccagttcttatataactgtactgaaaaactcactatgtacaagtactgtgctaaactatttttatctgctaagggggtatgattcatatttaacaaatgatcagattaagataaagaaagattaatggggacaactgctatggtttgaatatatgccctcctccaacccccaacatttgtatgttgaaacctagggctcaatgtgatagttttgagaggtaaggtctttaggagacgataaatggaattagtaccaatataaaaggcctcaagggtactagctaattaagccttttgccagccaccttctgccatgtgaggacgcattgttcagggtgccataatggaagtagaaggcagtccttccaaatctgctgatgccttgatgttggactttcctgtctccacaactgtgatacatatacttctattgtttataaattatgcagtctcagacattttgtcacagcagcacaaatggactaagaagtaagagtcaaataaaacttaactccgtatccttatacttcctaatttgtaacattggctcaaatggctccccttttaaatttggggtctactaaatcagaagttaatagcgggctgggataggaagcataatcattttatttccaagggctgatacccttgctggaatcctttgtatgtcattaagattggacgtctccctggacagattcatatggaggcaaagttttgcatatattttcagtgagttagcaacccactgaaggctcatggaactctgttcaagataaatatttcacaactgtttttaatgttcaatcatcatttatcaagtgtctgttgacatttgctttcaggtatcccttcacatttctttgataataacatcttatattttcactggagacttttcctttcttattctaatcccacagagactgtcaatgaaggaaccaagagcccatggcaaatgggtgggcacatgacccaagccagggaaatcagaatattattactttacatgtttctggctgagctatgggaaacgattctctctatctactaaggaaggtaagctggtagaatatgaaaggggtactctttgccattaattcctattcatgcagaaaacacatggaagagatgaggccctaacaaattgcttctggtcctgattctaggcatccttaaatcattcctacccttggcattttagtaatatgatccaagccccaaatttccccttttgtgccccaactcatttgaaatggttttctgtcacttgcaactaaaagtgacttgcaaatgcagcaggaaacatggaagacaatacagagtatgcaatacctaagtgaggattttggagaatggctaagaatttaccagacagacatggtagaagacttttttaggtgtgtagaagatcacaggcattttgtgtttctacaactttgtgttcctcgcactgtaagttgtttaatattcctgtggcaaaaagtacctggaaaaagttggaggaatgatgggactagcaaagctaaagtgcttcaactaaatctcaggcatctgtgtgctttttctctctggcttattgctttgtcttgatccttatttgtgttttctggttgctcataagcttataacagcctgatccattccttctaggcactctcaaacacgttatattttcaagccaatcttctaggtttcattcatatccttgcctctgtcaggttgattttggctctgacaagctctgaccctacacaatagacaactggtagtcttggcggctgggcctccagtctgcaaaattctttagccttcatttttcttttctaccagcttgaacactactatgtcttgcaacagactctcttctagctccttgcctgtgaacaactgtttttctttgatatcctggagagattcatttatctcaaaaatattcattcagcactgatgacataccaggcgttagggaaacacaatgggaggaaaaggcagaaatccttcctaatggaaattgtactctcattggggaaaataagttataaacaaacataagtagagcatatttttaaatggtgttaacagaaaagagaaaatcaaaccaagtgaggaatgctgtgaggtataatttgattacaaattaggtgatttctgagtatgggcttgaggacaagagggaacagcaatgtggatatctgggagaataactttctagaaaatgtaaataactattgaaaacaaatattgagatttataacaatatttcagggagttctttcaatgatgtaaaatgtcctccctaaaagagaggtaaaacatcagtgcaagttgatgccttggagacttaaggaaacatattatcatgaaaaaaatgatttgggcaaaaataacaaagaccattaaatatctttttatgctaaaattttaggatttcttgagggtttaataaatattaatacatttattcaacaaatattcatttgatcactgttctaagtatcacaaaatactgggaaaaatgcagacagtttccttctcttgtgtagattacattctagttaaggaggcaaaaaaaaaaaaaaaaaaaggaagcagtaggactacaataacaaaatagcaattatttatttagctcttataatgtgccagaaactgtgctaagtacattatataaatttgcttcttttcataaactttgcatctacattatcttttctttccaggtttgagatttcttggtaaaagaccctgagactattatatttaatggcaacaaccacaattgcttttgcaccaacctaataataatcaggtacaagtagtttgaaaggtgattcctggaagtgaaacattccttaaatatgcttgaaaggctgaggatgaatcctggcccatgtagttgttgctggttgtacgatcttgtacaagctatttaacctcaagttcaggttcttgttatatcaaatggagggcaaataatatctactttatattgtatttgtttgtaaaatacttagtcaaatttgatgtacattaaacacttgctatgtaatgacaatgacaataatgaattgacttccacttgcctcttcaattttatctttctattcatattgcgtgctctagcttactgaaaggcttcgatcacacatataaaaagtgccgtcttggctgtgagtttttatattcacctgggtaacctttgttcctctttaactgcctcttagtcacttagcttttaagtctttcagatgaattcggggacaatatcttcccaaggagttacagaatgccttagtaatctccagtaactcatgtcatgcaagtgattatcacaactggatgttagttttctcaccaaccattttgacacagtgccttgagactagaaactgtttctgattcattacttattctcagttcttaggacactgactgacaaacaggaggcactctagaaatatttgtagaatgtcaaaaaaaatgatgacaggctacatgaatgaaaaaaaagcatatgaggagttggaaaaattggacagaaatgttcacaggatgtatacatggagaagaaaattagttatccatatagaggaatataagaacttgaaggtctttcaaatgttcatattataggcttcaaggttaaaaaggattctgggtagagctcactggggaaataaagaaataaaagaatgggaaatactgcaatggctttgtaggaaagtcactgctctagcgtgaggaggcagataaagtagaaggcataagcaactgtaaaggaggctagcagcaggatcatggaaggacagtttaatgaaagtcatcaagagttgttttgtaaactcaaagtaataggcaatttcattgcatcttaaaatataacattaaaatgtattctcaagtatactgcagcttaggtaatatgattcacatgcattgaagcacattgtgtatttgctttagatttagaatgaatcgttgtttgtggacagaaaaatggaattctaagagtgtctaagaaactaatttctgccaatagaattttccaataaaaaaggaaaagcaatgtaaattgatttagtattcacttcattttcctttgtctttctgaaatattaatatacatgaagaaatgggagttgagaaattaaatttctaattaagaacttctagctgtaataatagctatgtcttgaacatttattacatgccccatatgaaataaaacaatttacatacattacctcatttaatctttccagtaaccttgtaaatttggtatttttattttcattttacaaatgaggcaactaacacagaggaaatatgtaatatacttgaagtcatacagaaaaagacacaacagagatatttctgattcaggtctgattccttcaaaacattttaaaaatattatgctgtaatgccttttggtaatcagtgaaatgattcattgcatacacaatttaaatatttatcaaggtcaggactacaagtttgtggtctgattgcagggggcttttcctgacctgcgttggcaaacaatttagaagatgtcttcaaaaacatttaaaaggtgtcttcatatattccccaaaataaaaaaagtcatggtttttaccttactgattattttcatttataactcgtatacagcataagcacttaaacttaccctgaaaaaaaattaactactttttaaaataaactacatctacataaaatctttcatgctatttctacagggattttcattctcatgtttttaaattaatatttgtctctacttatttaacaacttccagatagtgcccacatctaattaacaaagattcttttcatctatttttatcccaaattcaattaacaattcccagggtgacacttattgaagtctcactacaccaacacataatttgcttctacacagatacttattctacttctagctgaattccatgcttagattataatgaagttgaaacacacacacaaacaacaagaaaaaactagtaaaacagtagggatttacaatttaaacttaagcaactttcagtcacaatagtttgcatttgtatcgctatttattaattgggaaaccataaaggttgaaacacttatttaaatagaattaagaaacccaagccagtaactatttccttttctagctctgcatttggaaataagatttataagcatcactgaagcacgttaaaaccaatggagagcaacttcatgtagtctgtgcagtttgatcagcttacatgtaacattcaatttaaatggctttcattaaccatgggcagattttgaaagcttgtgacaccaaactgttccagtgaataatcaaattgctttgaggtaagaatgagaggtttgcattgtgagaatttatcttggttcaggtaaaaaaaaaaaaaaaaaaaaaaaaaaaaaaaaaatatatatatatatatatatatatatatatatatatatatatatatatgtttgtaagaatttttactacataaaatacttccactcagtcaactaatatttattggatgaataagaatattctacatttatttattttaaacttcccaccccaaatttggctgactagtactcccaattcctatacagataaattacctaagtgctaaaatttaaatgcacattaccagtaagtttctggtgaccttttaattgaaaatacatcatataaaaagtacataaatttggctatttccaaattttacatctaaactagtctttcttgtatctaaatacacatggaattcaaactcagttagtttataatgattaaaaaatcctctttaaattaatatttaaagggttttttaaaaaagaaatcttcctaaaacagtaactggaatgcaaaactgttatttttagttttaagtttaaaacagaatgattccaatagcaaaaaaaaaaaaatcaaatatattctcaggtagaaagttttgcttttttgcaggagatgtttacactatccatttaacttagaattataatattcaacaatagtaattttgacaatagctatactttgtcattgttattaacatgtaattctaatgaaaattacaactttgtactaacatctctcttctttttgtctaatcagtatttcagtcaatacattttctgatgcttgataatgcatcatttattttaaccatctatgtagttccctaataattaaaatgacaataaaataaaatactagcatcttcattagaggcatgtaaaaggctacagaatatacaaaacaatttatattggtcagaagaattagtggacattgttaaggcaagactgttattttactaggttagcaactaagagtggcataatatggaagaatagtaagaaaaatagccaaggaagctgttaatacaggaaagtgaaagaattaatccagagaatgaaagcaaacaccaatttctaaacagtttttcaaaagtgttagtggtaggaaaacacattcttaaccacttgtatgtatcactgcatgaaagcaagactcaatttagaatatatataagcagataaataaggaagggtagagagtattcattaaggtaaacagtactgagaagtgccctaccaaagataaagaaactgcaataattcagtgttgagtgctgacagtattggcagtaattgcgttaaaagttttgaatttcataaagaaaatatggtaaaatctccatcaccaaggaagatgctattgctaataacttctcacctccttgaacaagacagaaaaatcctattcaaaaagggaaataggtgtctcacagtgaaaacagcaaacagaacttactgaaggtattgattattataaagtacttctttgtacagaatggaggctatcttgattcatactggttcctcacaatcactcccacagggctctttgccctctaaagtcagaggtatcaaaatctgctaacttggtttagtttcagctaagggcataaatgacaactgactgcagtaattaattatctccccaactacaataaaaaggaaaagcaaaattaaagatactgagttaggctgagaagagagtgaatgcaaactaaataatccaatgtgtgtgtacgtgatcattttataaagcaggaaacatgctctgtgaatgagagcatttgttttcaaaagtctcaataaatatttatttttaaataaaatgaaatgttaatatatgactaaaagtttatatttcatttactttatgtatgctaagaagtataaaaatactttgagcaaacactgttaatagtattaaatttaaaaagataaatctgccctattctaatcatgtctttgtcttctgtttattcaagtgtattccatttgctttcgggaatatttggatgttttagaactaacattctgctttaataatccaaacacactataattccatcaatttgagtctcttaaaatgttacactgaaatgaatctctctgaagatggacttattgatttctatattcttcctctagcatcatgaaatttgacctcttcagccgtgcatggttaacactgtaagtatacatgtgtttttttgttttttctccaatcatggcaaatgtgtcgaaattataggctgtgtcctagatctattattttagttctattatggcaaagaagagagttttagggaaaagcgtttcaaagtgtttgaaaagtgcttgaaaaaaatatagaaagcagaaacaatattcattaatcaatcttgcatataacaaagcaagctagggcaataaaaaggatttattcatttagttcctttcttagaaataacaaaagcatactaaacccattgttctggccaattccttttaaagtaatccatttacttcagttctaatggtaattatcatgttacatttatctgtacccatttccattttatttttatgtgatttttaaatgtgcacatatcaaaataatgtcagtatgagaaggaagcagaacttaagtggtctttacacccttactattatgaataaagaaaatgagatttacagagaatagtgataattctatttgtctccaacaaattgccatctagtcagtctcactgtagacaggacactctgcctccctaaatctcagttcaattacctttaaaggagatggatagtatcatatctaaaaagaccacaatgacattaccaaaatcaataataagcataatatttactgaaagactctttatgccaaccacagttttacgttgtttgaatgtattaattaatttaaaactcacaacatcattataagttattattatggttcagccaattaaggtaaaaagaaaaaggaaattgcctatggttacaaagctagtgaatagcagaatgacttagggagaaagtaagtttcacttggtgggcgttatagctcctctttggagtaggtttgtctctttccttagccttctatttccagagtagaatatatttactggaaccaagtaaatactctatttagaataaaggtttttttatttaccacttttccttacttgccaacgctaatttctaactactcaaagctatccactttccataaaatatttcatacttttattgctccttatttctgtttttgtcagacctgcaagctaaaaattgttttgacatttttgaatagttgaaaaacattaaaagagaataatattgtgtaaattataagaaattcactttcagtgtccatgaataaattttaattggaaaatggccaaactcatttgtttacacattgtctatgattgttttcactccacaatggtagagaagttgtgacagagaccatctggctcataaagccaaaaatatttactagttggacttttaccgaagtttgctgatacctggtctagtggttcttgtctatctctttaaggaaaaaaaaactgttcaaatggatacagttaaagtcagaactataactaaaattcctgagttttaggtttatacgttgtttctaatttccttcacataagtacaaagaaaaaattacccctgaaaatgaaattatttgatagtgataatgtgttttttcacatgctattttgtctactcatgtctaaatagcagagattcagataatataatgatgttggttaatattaaaatggaaacagttgagagaacacagaaaaaaaacagtttaaaattgaatgtcaattgcattttcaatattctccttctatagaggtgaaatttatttcaccgaatttatcagtatataaaaatagttttaacttatatatttctaatataagacccttaaggaaagcagtttattctttggttactgatatgcccttgacatccaaaacattgcttggtatccaccaagtagacagtataaagtactgattaagattatgatttgtgcggtagaattctggttctaccacttactaacactgaaattaaaccagttgctcaactacgctctgcctcaattttcctatctataaagtaatgatgtttgcaacatcagtctgaaatgttattcatgaaaaaaagaaaatcagttaaaatatataaagtacttacaagagaacctcacatgttgtagggaatccataagtgttattattgttgtttttataaatatttattgaatgaatgttcttacaataaacataaagtctcatgatattgcccttgtatacacgttttgatttaatcatgttacatggtattcatttttttctgtttttttattgtaataaaaattttaacttttctaagatggaatcccagtttttcttttgctataccttgtattgtttgaaagatgtcagtgtattatttcaatacaaataatatttcattccctagttataatttcactttttatatttaactcatttttcaccttatttatgttggatattcaagtttgagaaggaataaagagtatatacatgacttctggatataaattagctttaaaaatgaagtggtttggccatgtgcatttgcatccatatccaaatccatagccatgccatatgaacctgcattccagacctagtaccaccattgttcgatgtatgttcacagttcagacacaggcaccaagaagaatcccctctaccacaacttctcctgtgggtgaaaaggaaagcaggaggacttcaaaagctttcatgactggggaccctgcaagtcattgctgcctttgcagacactctcagccttgtctactaaaaacgctgtagtcttcaccagtgctgacctcagctgatggaactacctggagtctaactgctgcccactcctggagctggaacagccactgtgtccttcagagaagaagctaccatacccacccagttggtggcttcataccttcccataggtgaggtctttccttactgaagccagtacataaagtttaaagaggtgacaactccttcaaatgtgcagacatcaatgcatgtctatgagaatatgaaaaatcaagaaaatgccacaaaaggaacacaataattttctagtaactgaccacaaagaaatggagaataataagttgcctgacagggaattcaaaataattattttaaagaagctcagcaagctacaagcaaacacagatacacaacttgaaaataatcagcagaacaatacatgaaaaaaataaaagttcaataaagaggtaaaaatcataaaaaagagtctaacagaagttctggagctgaagaataaaatgaaaactacaatagagtgcttcaatagcagacttgatcaaacagaagaaagaatctaaaaattcaaggacaggtcttttgatcttaaccagtcataggagagaaaaatgaaaaaaagggaagaaagcctatcatatctatggaacaccatcaagtgggccagtttatgcattatgggagtcccaaaaagagaaaaagaaagaaagaaattgatagaaagcatatttagagaaataacagctgaaaaatccccaaatctcaggagagaaatggcatgcaaattcatgaagctcaaaagttcccaaataagatcaaccccaaaacactgcaccgagacaaattataatcaaattatcaaaagtcaaggacaaagagattagaaagccaaaagaaaaaagcaactcattatgtgaaagagaatccctgtaagactattagtagatttctcagcagaaacattgcaggccaagagacagtgggatgatatattcaaagtactgaaagaaaataactgtctaccaagaacaatatatccaacaaaattattctttaaaagtgaagaagggataaagtctttccaatacaaatgaaaattgaaggagtttttcaactatagacctgccttaaaagaaatgcacaaggaagttcttcaaattttaacaaaaacatgctgagtagcaacatgaaagcatgtaagagtataaatctcactggttaaggtaaacatacagagaaatggaggttaaagtaacattataattgtattgtataaattacttttaatcctactataaaggttagagatacaaaattgttaatggatacacaatataaaaagaaactctaactacaagaacacaaatcgggcagagtaaaaaggggagtaaaagtgtggaggttttgtattcaattgaagttaagttgctattaacttaaaaaagactgttgtaactacaagatattttatgaaagctttgagctaaccacaaataaaattcccacaatatacataaaatatacaagaagaaaaaaaatcaaagcaaataactacaaaaaaccatctaattaaaaagaagacagtaagagagcagagagagaaaaatcaatggcaaaatgtatagaaagcaattaacaaaaagaaattagtaattcctcacctgtcaataattactttaaatatacatgaattaaaatcaccaatcaaaaggcatagcatggctgaatggatttaaaggaaaaaaataatataacaagatccagtggtttatttttcataagacactcattttacatataaagacacacacagtttgaaaatgaggagctgaagaaagttatgttatgcaaatggtaaccaaaagaaagctaggggtagttatgcttatatcatgaaaagttatgccatgcaaacggtaatcaaaagaaagctgggaatggctatgcttatatcagacaaaatagactttaagtctagaactgtctctagaggcaagaaggtgattatataaacaggtatatatatatacatatatatatacgtgtgtgtgtgtatatatatgtgtatatatatgtgtgtatatatatgtgtatatatatgtgtgtatatatatgtgtatatatatgtgtgtatatatatatatatatatgtcattttcatgagatctcagatgaaaacgagaaacaaggtattggaaactaaagtaaatgccatcctgttacacctctgcaaagactagtagaattgtgtctatattattggactttatggaatgaagaacttaagagtgaggaactatgatatctggtgaaagaaatatctaagcagcaaagcattcaccctgctgcatgactacttttaactgtttacagtgaagtgtgacagaaaaggattgtcttaagggcagaatttataattaaaaggaaagcagagtgaaaaaccttggaaaattcacagcatgggaaggtaaaatgtgaaaaaatgtggccaagcaaccatttgctaaagaaattactacagatggaagggagtcaagggctactctttaagataaacaagtcacttcttacatggacggcagcaggcaaagagagagctcatacaggagctcttataataaccctcagatctcatgagacttattcactatcacaagaacagcacaggaaagacctacccccatgataaaattacctcccattgggtccctcccacaacacgtgggaattcaagatgagatttgggtggggacacagccaaatcatatcaccactcattaggctctacctcccaaaactgttgcactgggattaagtttcaaacctatgaacttttgggagatgtattcaagccatagctttctgcccctggttcccaaaattaataaatttaataaaatcagacatgaaagaggagacattacaacgaatgcctaaaaaatataaaggatcataagagactactatgaacaattataacccagcaaactgcagagccaagaaggaatgggtaaattccaataaacatacaatctgccaatactgaatcaaaaagaaatagataatccgaacagaaaaataacaaataaggggattgaatcagtaataaaccaacccaaatatgtccatgaaccaatgccttcacagatgaattctaccaaacactgaaagaggaattgataccaactcatcttaagctcttccaaaaaatagaagaagcagtaacacttaaaaggtcaggatcccctaattccaaaatcagagatactacaagagaataaaattacaggccaatatttctgatgaacaaacatgcaaaaatcctcaatataatactagcaaacccaatgcaacagaacattaaatagatcacatatcatgaccaagagagatttatctctggaatgcaaggatagtttaacatacacaaatcaatcaatatgatacaacacatcagcaaaattttttagaaacagaattatctcaacagatacagaaaaggcaaatgaaaaagttcaacatctatttatgaaaaatattctcaacaaaattggtatagaagaaaattacctcagcacaataaagatcatgcgggaaaagtacatagctaacatcttaatccgtggagaaaaactgaaagctttccttctaagatccagcacaagaaaaggatgcccacttttactacttctttttgacatagtactgaagtcctagccatagcaattagacagggaaagaaaataaaaagcaaacaattggaaaggaagaagtaaataatctgtatgcaaatgacatgaccacagacataaaaaactgtaaaggctcactgttataactaatatctattttaactaataaacaaaacagtaaagttgcagaatacaaaatcaacattcaaaaattagttgcatttccacacacaaacaacaatataaaaaggaaattaagaaaacaacccccttaataatagcaatgaaaagaatcaaatacttagcaataaacttaatcaaagtggtaaaaaactttaaaatgtattttaatatctgtgcattctagggaaaccccatactcaacaatcttttaattttcataacattattaaatgttttacattaatatttaataaggaaatttcagaattattttatttaaatctcaaaaccattatattagaattttgattgaattacacctataaaataacttgggaaaaatagatatctttacaatatctagctccagacacaaaaatgaaactgttgtttccatgtatttaggacattttgtatttcctaaaacaatgggatttgctactttagctaaaaatttctaaacataattcagtgtttacatataaaatacatctatatatctatctttatagttatttgaacgaaatatgcttttcactaatgctttctatttattgctggtgtgggaatactactgatatttacatatacatttttatattactttattaagttcattaataaattccaaacattctttatgttttgtgtgttctagagtctgctttttgtacattaatattcattctcacattctttagcaatagaacttttgtatatggccatgaaaatagagattgcatgtcctggtctcttttacagcttagagtgatgtgagaccaagttttcttcaatggcatgtaagtaagagtcatgtgtgctacttcctgatctcgcccttaaaagttttctttatatgtttattagctccctataatacctgctggctggaagtagtgccatctgtgacaggcactttaacccatacagcgtatttttatgtccctcagcccacttgttctggatacaacagacatatcagtgcaggtgcaaatccatctaattccatggatagatacaaatgtatgcttcttggaataagtgttgattaaccaaaacctggagaaaagattttaaaaggagagattagaagaaatgaatacatccaagaaaagggaaatggctcaggcatttactaactatgtaattcaggtgaattactttaagcattagaaccatattttctgcatctttaaagtggtgatagtactccctgttttaaaggtgattagataatcgcaagatctcaatacattttcactgttaataacagcaataacctcgtaatgtggggatccatcaacttgaaggtagggaaaggtaagtaagtggttggagctttctgagaacgataaaacagcacttacataaatatacttgactcagccttatgcctcaaaaacaccagttgcctttcccaaacttgctagtgacagtattttatttttttatttattcttttttgagatgaagcctcactctgtcacccaggatggaatgcagtggcgcaatcttggctcactgcaacctccacctcccaggttcaagcgattctcctgcctcagcctcccgagtatcggggactacaggcctgtgccaccatgcccggctaaatttttgtatttttatgtatttatttacttatttttagtagagagggggtttcaccatgttagccaggatggtctcaaaggtctcgaaatcctgacctcatggtcacccaacttgggctcccaaagtgctgggattacgggcgtgagccactgcacccagcccctacagtattatttaattgttttgtaattttcttttaaaagactctctctctctctgcactggctttacaaaacttccacgacacattttctgattgtactgtaagttattttcttccttatctcccaatgacactgttttctacatgaaaaataccattttggctttatcaacatgttattaattcataatatgagagatctatcagcactatttgtaaaaatattcaattaaaaaaattaagatgatttatagttgtgtggtaaagaatttgaccttacccaaaggaggtcaggcttttgccctcagccttaaggagataatcttgtcatacccaataaaagtgttattttaaagtgaggctgactacacctgataatccagcttgagggacagttatgccagtttgaccaactagatgatttagggagctttctctcccaacttcaaagctgtgatgaatcaaacaggtaattaatcgatcatgcttatgtaatgaagccttgattgaaacttcaaagattgattgacgttccttggttggtaatactctgtcatgtgtcaattctagaagggtaatacgtcctgaggataacagaagctctgtgtttggaatcatcctggactctgcactttgtttctcctgctttggctgattttgatctgtaacctttacctataataaaccataactataatataatagatttcagtgagtgctgtgaggctttctagtgatttattgaacctaagggtggatgtgagaatttcctgaacttgcagttggtatcagaagtgagggaggtcctatggaggactgtgccctcagatgttgcagtttggctaaactcaggtaatagtatatggtaaataccaactgatcaagttatatttgttttttgctaggaagttttttaaaagtaaaatcattagcagtcaattatcaattaaaaaattaagtcaattaatgtatatctttttcatccatcttatttatttatttatttatttatttagtgttccaagagttcagttatttggaacttccacagttttcaagacttgagagctattgcactttcttgttaaaaatgacatgggaacaaataggtactgcagaaatcctttcatcttgtttaatatgacctgaggtgtcacattttctatatttaaaacatagtggccactgcaatgttctcatgctatttattactattatactgaagtctatactgtgatataataatcaaatgtatcttaaaaactgtaaatatctggatgctttaattaatcttttatgtatagttaaatgttaaattttatcaaagtatttggcatttttaaaggtagtttaatttgattaattgattgaatacatgctttattgatttacacattttatgtctctttcagtgtaatggagttataaattttgagataattcatgtatatatactagatatgaagatatcatgatggattcaaattactgaaagatgaggaaactataccagttttatacaggaggaaatattgttgggagaaaggccaggtgacatagtaactacaccgaaattgaaagtcagacatcttggatttggattcctgtcgactagtgataacactcagaacaattcacttaggttctatatgactcaatttcttaactttcaaaatgctagtaataattatccttttctcatacattaattatgataactaaaaaatgtgtgtgggttcggggtattgttacagtccttactgtagtaccaagcacacagtaacctcctctaaaattgcagatgctattatttttatcaaacatgtgaataagtgaaatgcaatatcatttataaaatgcatatagtgctacagaattattctatgaacaaataaggtatttgtttattcacaagaagaagatttcaaaatacaaaaaaaaggagatgtagtcgtgggtataacataaagtacagagtactactatcatttcattttttatcacattcaaagtatcaacagaaaagtattttcatttgctcaactaataactaatgtttacttttgagtccaataatagcaatacaacttcagtatgccaagtttacaaagtgcttccctgtatattgtctcatccaaatattacgacttctttgaaagatacgtccaaaatttactaatacattctatttcatggatgaaaaagaatgaggcactgagaagttgaattaattgccaggtgctatggaattagtaaatgatagctctataattcaatcttgaatcttctgacttaaagttaatattctttaactttttatcttgcctctcaccaaagttcaatatttcatctaaatttctaagcaataagtaatctttctcaaaatgttagcttaaaaacaataagaataaatatgggtaaaataaaataggtcaatttatgatgcttatgatcaaagtattaatatcaaacacgatcttactattaatagagaaaaaaagcattcaaaatctccacatgcaacaatagaactatgtctgctaccacaaataaaaaaaaaccttatgctctcatcaaagaaaatattctaatcaaaataggagagagtctggaaagatttgcaaacaaacttcaaatgtcttatacacagtaggtgacacttttaacttctattttagataattgcttcacacaagacttggaactagtaaaattagtggaagtagcaaacagcaattttgttacctatcttctttgttggattttaacaggtattgttataaaacaccttgattttttttgtctgggaaagattctttgtattataacagtacaatcatcaacagcaaaagatacattttctattcatgataataacttggacaatttacagtttattcatttatctttataatacaatatcatcataaaggataatcaagaggtacaataagaaatcataggtctttgtaaataactactggtttaacaatactgaaacttttagtttaccaatctaaaattaaaaaaaaatccattgttcaaccattattcaacttttctaggaaattaaaatctatacaatcttctaaccaaaaatgatacatttccaacaggaataatacgttcccaataagtgggtcttttggaatctcacaactgttggcaggcaagctaaaagcatagcatcagacagttttgcattatctttaaggaatataagttcagagctccaagggtgtcactgtcctatgcaaacactgttgtcattaaacgcatactgtcatctggtaagtttagtcatggcgacttgtttcaattgttaataaaacaaacaaacaaaaaatctcttttatctgactttctgttcgaatgttaactgaaaattggtcatggaatttactaatatgattcctaatgtttaaaataagctaatcagtggaattagaatatgtagcatgcataaacatgtggaaaattagaaagtcattatgagagtaatcatttttataaagcagtgatagacatacaaaattaaatctgctttcatctcccagaactgaggaagagatagaatttaaaaatacaaaagtgagtaatttgcaaaggcccctcaaaagaaatgattcttatttttaggattctgaaataatttaacttaagagattttgcagtggtctctttttctacatctggagctttctactcacagatatggcagttttaatttgaagagaaaactgacttagtcacttgattaatttttcaaataaacgatcctataacttcagatgagtatttctattacttccctctaggcaaattccttaatagagtattgttcagcaaatctcctactttctccatgtttttctgcataattatcagctatttaagtttcttttaaactattcaaatatagctgaactactcatggatttcagaagttccctaatttttacccgtgtcaaattttagggaaaagttataacactgattttattctaagtggccaaagcaatcaaagacaactttagctcaatatttgtatctcttccttttgaattatgatgaataaaataactttatagatttaaataaggaaataccattggagaatccatgttgtttcagttgataagagctgtgaaatactggcttttatttaatttgctggggtaacttaatgagaacctcatctgggtccaccatcccatactaaaatttattcgcttagtcttattggttccttgctatgttctatgttgtctcgtttacagtctccttagttcctaaaaagtaactctgttctcactttccttagcagataacccatctccttgagaagaacccctgatgaaaaagaaatcctctccaaatcaatatcttcattcatcactacactacatgttctattttccttcctccatttctcagaggaaggagttctattacttgccattgatcttaaaattatagttatcctccactgtgctgccatccataatttcatgtccttcatttgtggctttgttttcaatggctataagcattttcaattttgtcccattataacaaggctgtcactcaatactgtctggaatcattcagcatataccctctccttcccttcgttgctgaatttctcaaaagagtattaccttctttcatttatctgaactcatacatacttttaatcgcagctattctactttcattagagtttactgcaactatctctgtaaacatttccagtgacctcttaagtataagtgaaatcatttcatatcagacataatcctccatgccttcaagaaacattgaacacctccaatctttatgcttaaaactctctctctctctctctctctctctctctctctcaatatcttgctatctcactacttctatctctaatttggttcagtgactcttgacttgcttgagtctcatatctctccttccttcattccagccttttgcttttagaatagcttccacctttgcctgtatctattcaccttttccagttttccatttaattccatgcatttaacagaatactagttgttaacctaactcaaaggatttgggggatgattacatggaataatgtgtatgatgcaatggctatgatccatgggcctgtaatgcccccaaaatgtgtgttgctgcctctatctcctttcaacatcctgatgcaatatttttctaaatgtgaatattacttaatacgcccatgcaagttctttaatttttccttaggaaaatagacttcagagataaagctgattgtagatgaggtacaataattgttaatttccttggaaaattctaattgaaaattggtaaattcagtggttggaataagtatgcacagagtaaaggcaataaaaaatatagttcagcctgcaactacacttgccagttctttttatgtataatgtaatcatgtggaaaggcttttaaaataagcacgcctgtgtattcactgcaaattagtctgtcaattgaatttttacaggtgcttctgaataatccatttcgtctggcttaattacataattttaaaagtgtacaggtttctgataaaagagaacacattgttaggatgtaatctatttattaccccttgtacttccctttattgtgcttttttttggctttccaattttaagcaataacaataatactctgcaaaaaaataaagactttattgtattttctgtgtctaaattgtctgggctcacttttttaggacaatggcctggaacatgtaatcaacattaacaatccaatctgcctaagtggggccattcaaaaaggcctaaaattacaacacattttcattatgtatatatttatttacaatattttgtttgatttttaaaatttatatttgccattactaaaagaacataagaaatgccacactaaataatacctgtggtctactcaatgctgtattttctgacactgtccccttgattcttttaagatcatgaagattcttttaaatctatccttaaacacagtaccttgaccatctaatacatttcttacctttaactttttgagataccactagtctataaaaccgaaaatccaatcacatctcttctcttcctaaaaattctgttggctcactgctgtctgcaggacaaagcccaactctagccacccctcactcagatctgcctctctctgtcacctcctccccaatcctacctctacctgcttctattttctttctccaagtccatctggtgagctctttatagtcacttttgtagcaccatctgtttttcctattcatacccctacaatgaattcctccctttggtaatattactaaaccttgtacctacttttatattcacattagtcatactgtattataattatgtttactgtgataaaacaagataaataattagttttttaatcatttttaagtgtgccctttaagtactactcaatggcataaagtacattcacattgttaatcagccattaccatcatctgtcttccgaacttcattcatcttcccaaactgaaattctgtacacattaaatactaactcttcattataattgctttttaacaaatagatagggtctcgctttgttgctgaggctggtctcacactcctgagttcaagcgaccctcctgcctcagtgtaacgagtaggtaggatttcacatatatgccaccacacccagcttacaattagtttttaacattaacaggtctatctcacatactggccttcggagcagaactaactttttttttttttttttttcaatacagagtcttgctctgtcacccaggttggagtgcagtggcgtgatcttggcccaatgcaacctctgcctcccgggttcaagcgattctcctgcctcagcctcctgagtagctgggattacaggcacgcaccaccatgcccagatgatttttgtatagagactgggtttcaccatgtaggtcaggctggtcttgaactcctgacctcatgatccacccacctcggcctcccaaagtgctgggattacaggcgtgagccactacgcccggctagaactaactatttacaaatatgagtttgttaacatatttatacccagtacttaatgaaatgcctggcaactggaagatgcccaataagtatttgttaaagtaccatgattagaatcacatattatattattatgttaaccaaacgcatcaaattatgccaactttctagctctttgccacgtcagccttacactttacaaaaaacaaacattaacaaaaaaaaccacacaaaaacatacctttaatggttttcactttaacaaaaattaaaaaaaaaacagaaaaaaacccataatattacctttagtgctttctcatttcagaaagcataaaatctacaaatttttagctcttcagaatctggatcccatcaacctctttaccctcctcttctgtatcttttcacaccctgacttttatcaatgcaacattccttattcttgaaacagcagtttcagattttcttaatcattctgtctcctcagcctgaaatacttcccacagttttgaagttaaatcatagccttccttcaaggatatactcaaatgctgtctttttaggttgaagtcttctccgatcctttggcacagaatacgcttattctctgttcccttctgtattttgcttgtgcctgtattttgtatttagttagttttgcactaaattacatgttagttatacgtgtatacgtctgtctctttcactagagggcaagttatatgaaaatttacttaatacctcatttattttctttctttccatttcttcctttcagagactctcaaaattttctgcacatggtagagattaattaattaaattgaaagacgaaacaacttgttcatttgatacatatgatcaacatattgctgtttattgagcatactgaatgttgttcaaatggttcattaagagaatagtcaaagaacaacatgaaaacactagtcagaatgaagtgtagataatgcaatttgacaaacatatattgatcaagaggttcatatcactgttactgagtgaaataaatataaaggagagagatgaagtctatttctcagtaaactaactacataggcttacacaagtataaaattaaccctaatacttgttgaacagtcgtaatacaggctgaagtaatgagctttagccattaattaattagcctgttggcaaagaattataaaatagttcattaaagaggtgacatctgagcttgagcttaaatgaggaaatatgttttcaatgagtgatttggggttatggaggtattccaggaaagactttagcataaataagatttagagttaggaaaaatgttgccttctttaaaaaaaaatacactctatgacttaaggccttagaatgactcaggcagagcagtaggggtggtggagttaaagtagaatctgtaggttaggaacactgaagaaattttcgatggtatgttacaagtctatgtaacatatatcactatattgttaacatatattaatatagcataatagatcattatgttatcagtgtattaatatggcatatatcatatataagtacatattatagatgagaacatattacaaaaataatcattataattggggcttcacttagcaagtttaaccttgcagaattacacagcaaaagagataagcaataagaacagataaaagcctactgtaatatgtcaggtgagaatgcatgaagacctgaaatattgtaattttaatacatatggaaaaagatgagagtaaacagatatggggaacattatagacacaattatatacataaattgaaacaacctgaaagcagagagttaagacaaattcaaagataaatacattttcaagtaggagggaatagcagtacattaggagaaataacttctctggtctcatctgtaaaataatagtatgtaccttccagcattagtgtactgacatatatgtatttagcaataaatattaactatgattactattaagtgctccataaaatgatctagtattgatgtcattatggacaataaaatctgactctaaaacaactttattattttatttgtttataagaataatgaaaagttattaaaatttcaaacactacagaaacatatggtatatatacttgcaaacaatggagaaaacaaataataacagtttggcacttatatctaaaactttttctattcctgtcataatgaattattattattatttatatttgaaaaatattgagattattctatgcaacttcattctttttacatagcagaatgttttggggctttttccagaaaagaacatatagtagttttgtattctttttaatgaggcaactcactttattacattaatgtgccatatagaatctaagaggacatcaggaaaactaggtggcatttctgacccaccagagcataaggcacttttgtgtaaattagaaaatgtactccttgtaggtggctatgtcctctggtgcatgtctggattagcaaaccctgagctatatttcagctcccactgacctccctgctggaaatttgtaggagagaataatctatacaataattaacaaagccctgtggcaatgccaaagggatgtttgaaattttctgtagagctcagaagagtatataaactttgagctatagattttagtttcttttctacagaagtcatggttgaattcctggatgtctggggagaatagatgagcgatcaatgaaagagattatataaagaaaagatattaggaggtgataactccaaacccatccgtgagaataagacaagtggtggtggtgggaggaggagagagagaaagagagagagagagagaaagagactctatatataataatgatagatagatgagagaataaagcatattaaaatcatataatgatgatagaataaactgtatggtcttttcagattctacatatgcatatatgcgtatgtatgaatatatcaagatatcattcacaatctaaatctcttctcttaattatccgttctgaatttgggaattgaattaattcagaaaaaaatgtttggataagattttatatctaaactgtcactgtaacaaggagaaactcaagaaccaagcagattatcataatatagcacccttactcttcaagatggcaatatgaactcagaaaacaaatagatttgaatgttaagggacacttgtaaatacattttaaatttaatttaaaatctgaaacgttgctgggtgaggtggctcatgcctgaaatctcagtgctttgggaggccgagttgggcagactgtttgacccctggagttaaagaccagcctgggcaacatggcaaaactccatctctataaagaatacaaaaaaaattggctgggcatggtggcatgcaactgtagtcccagctactcgtaaggctgaggcttgaggatcacctgaggctaagaggtggagggtgcagtaagccttgatcgtgccactgcactccagcctgggcaacagagtgagaccctgtctaaaaaaaaaaaaaaaaaaaaaaaaaaaaaaaaaaaaaaaaaaaaaaaaaagttaaatctgatgcatcagataaacgtttctccagctccttgctcatttagtcatacgcaggacttttgctctggttcctgattattcggctcttaataattttttaaactttttcatgaaaatttgctctttttttaaaaactatcttcttcagttattgcctccaacattcaaaagtcacctagttcttatcctaaagctgctaatagtatgaatttttctaaatgtattttatcaggtttctaaatatatcttcttatcatcaatacatgatgctttacttacagtgatttcttataccaattgctcttactatagagaatcaacaactcaaactgcaagtgtcttctgattttttcgtaatttcattttgaaatatcaattttattaagaagttaaagttgactcttttctaattactctcttaaaagaatcactattgataagtgatttattattagaaaactaaagtaaattttctttatcactgggcttgtgaatttctaaatagggattcgagttaagccacatggacaatagttaaaatcaacaacaaaaccaaaatggaagttaataatgagcacgataattactaacagacgtgatttttacttatgcaagtgactcttatttgtacaaatgattttaagcaaaacaaatggcattcagaaaagtctgcagtagatacacaggagtgctaaaaagtaaaaatttattttatctatgtaaaatcaatcaaatgtaccacactgcctataggagattataataatactcgagggataaaactctattccagaaaacagtcgtaaatctttcctccacttttgttctcaagggctgctgttcaattttatgtataattgaagtaactacttagttgctattcctggagcaaattttcagagcctcactttgagacagagtctggctgtgttgcctaggctggagtgcagtggcgcgatctcggctcactgcaagctctgcctccagggttcacgccattctcctgcctcagcctcccaagtagctgggactacaggcacccgccaccaagcccagctaattttttgtatttttaatagagacagggtttcaccgtgttagccaggatggtctcgcttgatctgcagacctcatgatccacccgcctcggcctcccaaagtgctgggattacaggtgtgaaccaccacacctggcctatgggacacttttatttcagcttactttagccaagtggtctcatcacacctttgtttatgacaaacagaaattctatcacgttcatattaagccatgcttttataatagtagccaccaaactttttgtttgtttgcccttatcaataaaatattttgagaaatgcatccaaaatgaatgtaattttatcacatataaaaatcacaattaacattaataaaatataatatgaatacacattttacgtttttttctgatagttccaggaacaagtacaccccatcctgaagataatttatcaaccccatctctttcaaagactgtgtactccttctcattacctattattccagaggttcttttcttctatgatgactgagaggtaccaatctcttatttcttttttttttttttcccccaaaccatcctgtttactaagctgaatctggtcatcaaaaagttttctttcctttttaaagatggctatttcatcatttatggttttaacactactagcctttaattcacatagagtttactctcctactagctgaaagtccattatttctaaaggttaaattgttatggctgggacaaagaaaagcatatatacactcatttaattaatctagcttattttgaagaacaaaagagtggctgggcgcggtggctcacgcgtgtaatcccagcactttgggaggccgaggcaggcgaatcactaggttaggagttcaagaccagcctgaccaacatggtgaaaccccgtctctactaaaaatacaaaaattagccaggggtggtggcacatgcccgtaatcccagctacttgggatgccgaggcagtagaattgcttgaacccagcaggcagagagaggttggagtgagccaagattgcaccactgcactccagcctgggtgatagagcaagactccgtctcaaaacaaaaaacaaaacaaaacaaaacaaaacaaaaaacaaaggagtttgtactgagaagatttattgagtggtttgaaaatgtgtatttgtctgtatgcataatgtatatgtaaacattatcttgttataaatccctttataagacttatctttactgatattagcctcatatatttttataaatctatttatatttacttattttttattgatccataatagatgtacatactttgggggtacttgtgataatttgatacattcatataatgtgtaaagatcaaagcaggttatttggagtatccaccacattaactatttatctttactttttactaggaacatttaaattctgtcttctagctattttgaaatgtatattagattaatgttaactataatcaacctactgatctagatctatggaacactaggtcctatttcttccatctaactgaaaatttgtacccattaatcaaccctcttcattattccctcccctctacccttggttatttaagagtaagaagattttgctaatttatattagtatgtccaatactagtaataccaatattacattactggaataaacttgtaggaaaaatgcagccttataaatgtcagagaaaaagagagatgggactattttaatggctgacacaggttaaacttctctctctctctctctccctctctctctctctctctctatatatatatataattttattttatctatgtaatatcaataaaatgtaccacactgtctataggagactataataatacttcagggataaatatatatatatatagttttatatcttaggtattatatacatacatatttagagagagataaatatagatagatacatgtatatataaacaaatttatgtactctctatatatacctaattatccaagataatttgtgcgttaaaacccaagagaagtaaaatcttccgaagataaaataactctttaaatcttaaaaagatgattgaaaaaacttttttgggggttgtgaatagtagcagaagtggattcagtgacgtcactaaatatgagtacagtgcttttagaagataagaataggcaggacctgagggcaagtatatctctccaaggagttcacttttatttgtagcattttctaagtttaacagttatttgatatgtgttccaattttgagctgtgttttccttcttgaaacgactgacgttctgcctgtagtctttctaaatcttcatctccctagctcacatgtcactagcttttgataattttcctttggtctagtagtgacacatataaataaccaaaaatcagaaaacaagactccggcaactaatttcaacaagccttgttcaatggcatagacagaatgtaatttattttttgtgacagttataataaaagtgacgtgaaacacaagggatgtaatgtcagcgatattgcacctcaaaagaggagaaagtgtggcaggttacctcctgattagcagcagctagttcttcttccagtgcagagactctttctaaagaaaccctcagtcgctcccttacctagaagaaaaatcaaaatatgtgcagtaatgtacatcccatacatattaaactgtgctgaatccataattaacatcatcagagacagtcaatttggcaaattattaaagtatttatatccctgcgtgctcagaatactaaatctggcagaaatacaatgaatgcattgtcacctcgtattgtcactgtatcaagggatttccttgtaagcaaatgcttttggtagttccctgatagagcttcaggtggggttggagattgacttgtcttgctctgaattctgattcatagtaagtggagacaaagtttaaaagtatattatgaattcatctaaaaaatagtcactgtttaagcatgacaaataggaaaaaaaaataccccacctttttctctacttctgtaaaataacaagtgaattttcatttggtacttagtatctaatttcaaaaattatttgcctgaaggaaaggccttttagaacctgaaaaatgttcttcgcttctctgttttttattaattagaggtctactttgtttttgaggaattgtaaactacttaagtatcttggaatttccaactagcttccagataccaaaggttaaaccattgtattttatagaacaaaaatctctgtatattttagtttgaaagtcataatttatgcttgtttcttacataactgaaactcgaagaagtatttctttgattcttgctttcttagaactttgttttagttgttttatgtttagatctatatatatgtcctgatatatatatatatatatataaaacaattcagagaaagaaatattgctgaattaaaatgaatgactatagcagtttaattttccttaaaaaatcaaaaaactttatagctttaacttaagatgcaattcatggtgggttttcgattatttataaattaacttagatttttcttgggaatgctatagtatttgtgcagttaagatgtgttttaacatataattatattcctatgagctttcattttattaactgacagcatattttaataaatggtatttttctcctctaataagatttaactgggaatatagattaaatttataaaatatgtaaaaacccagatacataaaaattaaattggaattataatattatttttccagttagcaaacaaacaaaaagtcagtaatgtcctattaacctagaatcctattaggaatttttaagaatctaagtcacattttagtattgtattacaataccatgtatattcagatgaatggatgcatttaattcctgaaatagaccttgaatcagcaataaaaatatccaagtaggggttttaatattaattatattttgttatgcttaaattctctaaaaacaataatacacacataaatggagacttgatttctaaaagagttgcacaggatctttcatcatattgagctagagattaactgccaagtatcattcctgttagacaaatatccaattgttaacaaaatacataggattaatgctgattaataaccaaacactagttacatagcaggaaatcttcgatgatttgatttggagaatacttttttatgaattttgaatacatgaaaaagaagcaaatatcccgaagccatgaaaatgagcaggacagctgatgtgtggaatgcatatatcaaaaaacgtttcaacagacgtgtgatgtttaacagggattcccatattctaaaataccaactgtaaaatacgggtgtcctgaagaaggcctagtaaacctagttgatgagaacagcaatatgaagcaatctaaatatgttaataatctctccatacacaacgctgatcatatcacacttaagctgctgtagagagaggaagttaccatattttaaaatatcaacacattaaaatctttctaaaagtcattcgcataatataagaaatggttgaatctaggctacatggtaggttaatatatctttctttctttttttaaacttaaactcttagaactgttccaaactgttttctatttactacaagttaagcatttatattttcattatagtgagtttttaaggagtaaaagttatcgaatttatccaacaatatgaaaatgaaataatcatctttcatatatttagaatagtggtttacaaattgagattatgttgtccacgaagtaataaatctaaaactgttttacaagaaaataaaaaattctgaatatattttgagttatgttataaattgaaaaattgatgctgtgaatatcaataatgcaaactgaaattaatataaggcagggttgcatttggggaattatcactcctacaacagaaaatattcttgtggaaatctcctcagaccagaagctctaattcattccttgacactaagatatttgataataaaaatatatagggaaggcatatatatttaatttgttttggtttacatttcccatacatgtctgatatgttatttttaaatagtcaatgatttctgagtaattgaaaaacacaagtatatttctcatgttctccaacccttggaattggtaaatatattgtagagtaatttcaaaattactgatggtcttagctaattatgaatattctatgctacaacttggtggctgtataaataattggacattaatgatgaaaattatgaatcactgcaactctctacagctatgctcaatccttgtagagtttatttagctctgcatatgtactaatccctctatgataaagttgtttgtttcctgtccccaaggcatggttaattgcatctttttctgacttcatatatatatatatatatatatatatatatatatatatatatatatatatagtattacttgtttatatatctatatccacatccctcctcatccctatgagaaactgtgagttactcttagggaaattgtctatgaaggcacttagacacatatgagtccctcgacaactaaatgaaatgctattgtaaacaagcatctggatcaacagtaaaaccaacatgtttacttggtttgaaagttttatcaaatgctgatgcttactcctgctaataataatattcataaacgttcactaaggacttgccatatgctaagcactggctgaaagctttgcatatcagatcatatctaatcctcatgatgactctgaggtcagtactaggattatcttaattcaagataagaggtaattgatgctttgagaatgaatgatcaagtcacttatccagatctgtctgactccagagccccaattcatttcttctttaggccactgagcattacttgttgataatcagtccagttgtccctgaactcaccaatgttcagaatacctatggtgagttaatacatattattatagctcctagggtcatacgatggaacaactcatatagttatgctaaacccactgaacttctataaagtaaattatttctagattacgttgtacaacaaccatttttttcttaaatgtactcacacgaccaggttatttgtcttaaatgctgtttattacctctattctgataaagaatcattcttttgtaaaagcatccctcaagtgatatgggaatgcttatgggaccatctcaaatcatacattctctagtaccttcatttaagtcacaaaactcttgaattttctctggataggtccttctcttcttacagctctgggttattttctgtgtgggtcctgctgcttagagtatctttctctgcttaaaaaacccttaatcattctttaatacctagatcaaatgccaacctttctttttttttttttttttttttttttttttgagacggagtctcgctgtcacccaggctggagtgcagtggcgcgatctgggctcactgcaagctccacctcccgggttcacgccattctcctgcctcagcctccccagtagctgggactacaggcgcccgccaccacgcccagctaattttttgtatttttagtagaggtggggtttcaccgtgttagccaggatggtctcgatctcctgacctcgtgatccgcccgcctcggcctcccaaagtgctgggattacaggcgtgagccaccgcgcccggccatgccaacctttcttgaagacatccttgtctttgtcattactcacacagtcacagctttttctgtggctacatattgtgatggaaatacatctgttttgagttgtttttcattgatatgtgaattcctagcactaactctgaacttctcagtcataatgagcatatcttatttatctctgtgtgtcaaacatgtgctatggagcctgacacatactaaaaattctatacatataaactcttgcaaattcttagcacttttataaaaagagaggaaatataatatgaaactaaatattgaatattaaataattatttgatgtcatatttagcaagaatttttatataatattcatttctgttttattcaaaataattcttatactaattgcctctcgttgctaaaataaaaatgagatacaatttcttcttaatactctagaagacagaattatagttatccttacatacacactccacataatcccctgttctcagaacatctgaaagaccaatgataaaaatataaatgtatataaatattaaatagaacaaaaatatttgcatgcttaaaaactagatataactgggaaataatccctagtttggattttaatgctcagaacttgtcggatactttacaatgaagtgtcccaatttccactctaactcctaaagatttactaatttttaaaagttcagtctttgaaatttcacgaaattgaaatacgtcataagccttcctaatctcctaaggatattatcatcatattggtttatatatgtcagtagaacttattcgagtaacagctaagagaagcttacagctacttttaaaaatatctaaacacaggtttttctactaatactttgtgatgttacatgcagagaatattcaaatgaatatttaaaactatgatattagagacattagaaaataagatgcttctaaaataaatgtctaaaagttaaagtacatcaatttgcatatcaaaatatacataattttcagttagtggtctcttattttggaatctataaagaaagaccaaggtgggggggggggaggggggagagagagagagagagagagaggctcaataataatattaaatgatataacattttgaatgtcatctgaagtagggttataatgtaccataatagaagtctaattctgataagccatagattcagtggtttagaaaaagaagatgtttatgaatattaccaacatccacacagtaatccattttcacttttaaaaaatgatttttcatataactcaaaagtgttcctcaactgactgactttaggagtcaggtgagtcaatggatgaagacaaagagcttgatgctgatgacagaagtgtagttaagcttgaactctttttccatactataccttttcatccaaggccttgtggtgctcaaacaaagatttcagtgccttgagaacttcaacttcactggatactcctgagggagactgggcttgccgttttaccaccgtcattcttagtgatctttcatgtcgtgacacaaggcactccaaatgctccagtaatagctattgggtttaacagaaaatgcaattatcttatgaatacaagtcataaatacttacaaatgacttcccccttaaattattgcaggcttacatagtatctaatgttagctgcaggttacactgcaagcagcaacaaagaagcacagacctgtttaaaacagggtttataaaatacattaaagataaattgtatttgatcatttaacaagttactgaatttaaaaatgtaatgcaaatgtaatgcagtcctttagcaaatgtaataatttcagtacgaattcagcagaaatagaacacttggaaaaatatgtatgataatgatgaaagaacattgcttgatgcatcatgatctttttagaggatcatagtgacagtcaaaatttatttcatttacatatggccattaaaataatttgaattgaataaaatgagcataatcattaaaatgttactttaacttaatcacatggttttattcacaattagtctttagattaattatagaaaaatatatgcaaccaattagaacatagtaactgagattctcaattgtcagttcagaaaaggaagttaaggatacagttttaaattgcctgtgttagaatctatgatttcccagagtagcctctggggccatgacagaggtggagggaaagtccctgaagactttccaggctgtttcaggctttacactcttagcttttgccagaggagttctgctttgaaatgttttgtgaattggggtttcatatttgctttcatttcaaaaggaagttctactgctaaaaaacaaagatacatgagaagaaaatcagaaattgcttgattattttcagttattataattttactagtgaagaaccacacacagttggtgagcattataggaaaggtcttcggaagcatagtgaaaagcataggctaacaagtggtgtctacttatgcaaaataaagaagaaaataaagcagaaattacccaaacaaaagatttaaaaacagatataagacactgaaggtggaaagaataaagaaaacaactttatttttttcttttcaagatattttctaaaagtttaactgtaatgaaaaattttggttttcactataccactgttagattcattgtcaagtattagtatcatattttttggttgatttctctacatttgctgtcactaattatgactcaaaatgttagaaaactttgccattattgggcacaaagaacaccagtatctgagacactaaacatgcataaatcagtagataagagtcacatttaaggatcaaactaatcgccgggcacagtggctcactcctgtaatcccagcactttgggaggccaaggcaggcagatcacgaggtcaggagatcgagaccatcctggctaacacagtgaaaccccgtctctactaaaataataataataataatagtagtttttcagtatgaaaataacctgaaattttcaaggagccctttaaaatttatcaatctctgattatattatggtattctattctctcaaattctttagatacatgtattcattgcataaatccaagctgttttacataggttgtggagatttgcatgaacttaataatgtctgtttttccagtggcatctgatgtcaatctttcgctggcaaactatgttccagacttctgacctacttttagctcctcagtatgtcaagcctttgcttatgctgtaccctctgcccaaagcactccttctttggttcctcatttaaccagctctttctcattctttaagtctcagcttaaacatcatctctcaacaaggcatttgctcactactgtctaaagtaagtttctccttttccccacctccgcaagtctctatttcaatcccttactaattttcttcagaatattttatgatatgcaatttaaacaaatttttctaccaaatttcattctattttcccattgcaataaaagctccatgagagttggcacagtgtccgccttaatcctcttgatcctctctggatttgggtgttagctcaattcccaacatctataggtatgcaattaatatttgttgagtgaactgaaatgttaaatgagttaaatttacatacctcatatagttttatatatctcatacagatttggcctatatgaaagctaagcctgtggccatggttaattggcattatttcctaaaagcttaggctaattaacattattatgtacatctatccttcaatctgatgacaaaaataatgaaacctttacaacacaatgaaaactgtttttttttctaattgtaaattagagtcatcttgcataatatagtcgttcaataaacatatcagcatccaattttgcacaatacagtgtaagatttagaaatataaaatatccaccctctaggaaaagaaacacaataatgatgctataaaggatatctgttattagagactacctaaatcttttgatcacactcttcacatttggcaagtggaactttttaactgcttctccctaccctcatgtcctcattgtctctttacccagcttaaagttaacaattcagtatttgtaagcactctctttcatgctccctcagtttctagaatctgatcacttgccactacatccactgcttacatttgtgtccaagacctataatctccccctggattataatggctccttaactggtcctcctcctttcagcctttcatcttcaggctattctcaaaacactatttcagttaaaatgtgagttaggtcatttatacctctgctcaaatttttaatgtcttcttattgagctcaagtgaaagtcaaagtccttatacatcccaaagggatctaaattttctgaacttatctcctatttttcttcttgctcattctggtatagcttcattggctgccttgcagttttttgtttgtttagttttgttagttttgcttttaacaggctaaacatccatgtccccacaacaggggttttgtacttcttcttttctctaactaaaacattctctttcagaaatctgtatgactatctcacttcaccttcgctttcatattttaactcaaatgccacttttcaatgaggctttccctggttacctacaacattggatatctccttcctagcatattaaaatgttgctttgtgtcattaagtttttggatagtttgtcatatcatgataggtaatcagaaaaccttctcccaaaggatctgtaactatttattagagtcatagtactatggacaataaaatatcaaagtttcttgaatattacctctgagctaggagtaattttctgatcctcactctgtaagagtcttcagtaacctggtggacaaactgattcaccttgtagatatcagcctatttcccttgccaccatgtcgtatttctcaatgtgcataaagaagtgaccatggtttcagggttataaacctgacaaaatgggcttcccacgattaagactgatggagacaccaccatggctgaacggcccagtggcaagctgcagcaatctaacttgagccctgtcatgataaagtacagctggagaccagctattcaccatgaagcaagcatattatatcaaatactttttattaaagaggaggcagtttttcctcactataataaaccccctttttggatatagatttgctttctctaatgaccatacttctaccagaaacaccatcttaccgagtttttgcttacagtcatgttatgatatacaacattacttcagacaaaaaaaaaaaaacaaaaaaaaatctgattttacagtgaaaagagtaatgcaattgatgggtgctcccagggaccccggattttatcacaccattacatcatttagaagtagctgaacttatagaatggttaaataagccaagacttttttttattttttattattatactgtaagttctagggtacatgtgcacaacgtgcaggtttattacatatgtatacatgtgccatgttggtgtgctgcacccattaactcgtcatttacattaggtatatctcctaatgctatccctcccccctccccccgaccccatgacaggccctggtgtgtgatgttccccttcctgtgtccaaatgttctcattgttcaattcccacctatgagtgaaaacatgcggtgtttggttttttgtccttgcaatagtttgctgagaatgatggtttccagcttcatccatgtccctacaaaggacatggactcatccttttttatggctgcatagtattccatggtttatatgtgccacattttctcaatccagtctatcattgatggacatttgggttagttccaagtctttggtattgtgaatagtgctgcaataaacataagtgtgcatgtgtctttatagcatcatgatttataatcctttgggtatatacccagtaatgggatggctgggtcaaatggtatttctagttctagatccttgaggaattgccacactgtcttccacaacggttgaactagtttacagtcccaccaacagtgcaaaagtgttcctatttctccacatcctctccagcacctgttgtttcctcactttgtaatgattgccattctaactggtgtgagatggtatctcattgtggttttgatttgcattcctctgatggccagtgatggtgagcattttttcatgtgtctgttggctgcacaaatgtccttttgagaagtgtctgttcgtatccttcgcccactttttgatagggttgtttgttttttttcttgtaaatttgtttgagttctttgtagattctggatattagccctttgtcagatgagtaggttgcaaaaattttctcccattctgtagcttgcctgttcactctgatggtattttcttttgctgtgcagaagctctttagtttaattagatcccatttgtcaattttggcttttgttgccattgcttttggtgttttagacatgaagtcctatcatccctatgtcctgaatggtattgcctaggttttcttctagggtttttatggttttaggtctaacatttaagtctttaatccatcttgaattaatttttgtataaggtgtaaggaagggatccagtttcagctttctacatgtggctagccagttgacccagcacaattcaagcttggacataatacattgctaagtaggaattctatcatcctggaattagtatatcctcagaactactgatagaaataagatagagtttctttcttggaatagctatggatccatgtatgtaagtccagaaaccaaggtttataattggaattcataactgccaactaggacctgtgactagtggagaaaagaggatcattccttttttgttgacacacatacacacgctcacatacagacacacacactatatatacacacacgcatgcatgtttgtgtgtgaatatatatatataatgtacattaatacattattctcttttctgttttctgtaccctgttaccatcttttacccattaattatccccattttctacccctccccctgactgtttgatagttcctcacaatccaaatcccatcttcccagtaacatttcttgggaatgtttaccactaggtggcagacctgtgacttaagatcagtcaaccagacctgaccaccctgggagttagcctgacggggcagagaggaaccatgctgggaaggggtagtggcagaggctgcgtgtttctgggactgggcttgtgagaaaaatttacaaagctaagaaatgtggtcctagagactgtctgaaagctcagtttagagatttcttatatgctttaattaatgtctttatttaaacagccaagctatatactctgttttgtgcaattaggaactctcatctacatgataataaaaaccaaatatgtttttattaatataaacagactccttaagggatgaacgatttcacttatccccaataccaaggaaaatattctacataataagtacttaatacttgttgaattgggttaatgataaacatcaattattcagattgaagaatatggacaaaaatgttctcatctggcatatatatatggcctaatttaaggttaaaaataaaagtaaataaattaagagtacaaaaagtgatacttagctaagataccattaacaatctactaattacacaccttcactgggagctacaactttagcctaatatttaataattctcacagaaagtacaaatggaactctctttggtatactcaaaggattgtagagactatgtgaatggccatgaatcctatgtttgaattttctttaaatgaccacaggttctatgtgtatacacacatatgtatcatatattcacacacagacacacacacacacacccacacaaacccacacatcatgcgtcattgggaattttttggactaagttttgccttgaaaagcaagatggcccaggtaatctaaatcttttattttactatgattctgtaaggatttctaaaactatataacttcctattagatcttaattcaacaaaaccttgtgaatagttatttccaattataaatggcactgaaacagaaacacattcttccctgtagactaatgtggctgctgtaatatggtcatatagcatgacattaacatctgaaaacgaaaacctttaaattggttgccttcttactcaacccactccatatcttttaccctcaaatatcgtttaaaatcccatgtttcttatgctcatgtttgattatgaaattgaaatagctgttgggagggcgtatgtcctatcctatttactcttgtactgatcatatcctatcatagaactttcataaataactatatacgcacatgcatgtacacatatgtagaatctttatctgttttcagctgagaaggtcttccttttctgaattggaccgtattttctacccattgatgaaatacatttggatgacattattaactcgtacaggcagagatttgtcaataagaaaaaatttttctttagtagtgatgggtgtctaattgtatctcaatatctgttaagataattcctttggctcaaaacaaaagtgagggcatggtaagaaatgtgtcaaatgcaattatgtcttctttttaagtttatgatccatgagattaagttacagctttattatttataactaggtattaatactgtttcttgaaatcataacaatatgaatactgtttctcaaaaccataacgtttttctttttttttaatttttttttattatactttaagttttagggtacatgtgcacattgtgcaggttagttacatatgtatacatgtgccatgctggtgcgctgcacccactaactcgtcatctagcattaggtatatctcccagtgctatccctcccccctccccccaccccaccacagtccccagagtgtgatattccccttcctgtgtccatgtgatctcattgttcaattcccacctatgagtgagaattcaaagtcacacaatagttacattctaaaacattatgaacaatttaaaacatcctttgagatcttcagctataaaaatagttgaaacaactccgacaataaaaatgttcttcacgctgacattcacaggcaataactatacaaaaattcccagtttttctttacctcttcattagttcagataactttgtcaaaacatgtcttattgatcattttgagttgaaataacatcaggaataaattattttctataaatataaccttctgtaaatatatacttgccaaagtatggtcagaggagttttaggaataacaaattttgtttcaatattttttctacatttttatcagtataaaaatattgaacaaaaacttctttgtatgtttctataaatatccactataattttttgaaatttctatttttgtataattgtttataatattataatgattttattaggatattcttaatttaataacttgaggcagttggatttaagaacaactgcagtgatgactgattttctttcattcactcaaatttttgcaatgtcaacgaggtgtttctgtggagaaaacataatacatggccaggacatacatttcagctttgacctcagaataaaaacatagcagattgactttccacatgactaacacaaaataaagtaggattgaattacaaaaatttaaataggccaggagcagtggctcatgcctgtaatcccagcactttgggaggtgaagacgggccgactgcttgagcccaggagttcgagacaagtccaggcaacatggcaaaaccccatctctacaaaaaataacagaaattagctgggtatggtggcatgtggctatagtcccagctacttgggaggctgaggtgggaagatcacctgagtccagggaactctaggctgcagtgaaccatgattgtgccactgcactccagcctgagcaagagtgagacctcgtctcaaaagaattaaaaaaagaaaaaaataaatttgaacaaactgtattcttctttgaacataatacctttgcatcacatgtgaattgtgggtgacataggaatatgatttcttaaatacatagtctgtgggtaaactgagaaggaagtagtggactctctgggtgtttcatttataagccatttataggcctgggacaagttacttactaccttagttttctcttgaattaaatgggaataatgagattgctgtgagaataaagtgagttaaacatgtaaaacattcataaaaacatttagattttaatgttagctattatattatcattattactctctatcttcattcaattcccactggaacttctattttctattttggaagatggtataattcatccaaatatcattatacagaaggactttttctgatctattgtttttgataacattcaaaattaatacaaatgaccccatccacacatggtttcatggactggctttttatgttatttagctcagttcatgaacatatcctaactactcgatgtaaagtgagccacaagttgatcagaactttggaaattggaatgctcaattacactttatattttattttcttttatatatttatttatgtatttattttttgagatggagtctccctctgtcgcccagactggagtgcagtgacacgatctctgctcactgcaatctcaccctcctggattcaagcgattatcctatttcagcatcacgagcagctgaggttacaggcatgtgccaccatgcccagctatcacttgcgctttaaatttgctcacaatctgacaccaattaaagtttctttacatgtgagaaggaaacactagcttgttgctttgtctctatgaccagcacacagatatttatagcaagaagaaaagcacaacatctagaaagagaaacaactataaaatctataaaaatggttttatttagcaacatttgataaggcatctggtgtgaagagagacatatttgattttcagctctggatatactacttctgggggatggaggagggtgagaggtggttatgtaacttaaggagttattatataattaatactgtgtacaagggggttttcataaatctgttttccttgatgcagtcgacaacaaaaatcctccacatcactgctttaaagaaggtagaaatgtattttccagccttattcatattttcaaagtaactattatgcatggttgaaatcaatggcttcaatatctgttattgttattttaaaggaactttgtatttttctaattttgactcccaaataggtacttcacatgtggctcaccttcctccctttattatccaagactcctttgcaaacacaatagcctcgggtatttctggttctcatggggttcaatatgatgaaaattgtacggattctgtcaccaaatctcttagctctctaaaattcatcacaattagatactgtggtggtctgactgttaagcaatgtcctctctagctgtagtaagtctttgagtaataatgctgatggcctcatggttagtgcacaggctctggatttagactgccttacctttcaaattcattctttgctatttactaactgtgtgacttctggcaagttatctgaccttttctgagctcacttacctggtctgtaaaattgagataattataacatctccagaggggtgtagaaaggagtaaggggctgaagaaaaaaggctagatgaacctacacagctaataaaagagtgtctggtgcattttaaatgtgagcattagttataaacctaaccaaagctttgtatttccctgcattctcagctttctgctcctacttttacacttgagtgtgctgtgttaaatcaaggaatgtagtctaaagtactaaaatataacatagtggaatagggcagaataaatgtcatggtataaataaattttaaatttgcacgaaaacacagtgttaagttaaaaaagtcaagggtaggaaatatatagagaggaagacagcaaaagaaaaaaattgtctgatacctgataatatgatctaaactgcccttgttatgccctgtttgaggcaatccatttgacaggttcatcagagtatcattgaaaaccaattcaatgtatgcatgtatgtgaattctctttaccatgaaataagaccttgataaataaggacataaattcagtttgatcatgtaaccattatgcaagcaaccctatctctcattaaaggcacaagctcccagttagtagaactgtattttatattactctctaagactcataaagtgaataggccattagctatacctatttttttcaggattgatctattatagctataacatttaaactatttttcaccaacttcagttgtatttaaattgaacttacatccacatagaagtggtttttttctacttccttttagtaaactgtactcctctatgggtaatgtggtaatttacatgtttataaaatttagtgattttttttctcaaagaaaatatagcatgtttatcaaattctgaactttaatgttacatggcatgtcatatgcttgatgaaaatacatgggtttccaaaagtagaatctagcaaattccatgagtttcatgaaatcagaatatcatggctggacattcccttggaaatttattaaaacataaaggcactcctcttttaatgggcagatttttttttcagtttttttttcttgacactattttttgtttcctttttattttatttattattattatttttttgagacagagtctcactctgttgcccaggctggactgtggtggtgcaatctcggttcactgcagcctctgcctcccaggccctcccaagtagctgggactgcaggtgcgtgccaccaagcctggctgacttttgtatttatagtagaaatggggtttcaccatgttggccagggtgatcttgaactcctgaacttaggtgatccgcctgccttggcctcccaaagtgctgggattacaggcatgaggcatcgcgtccggcctttttttttttttcctttttaaaaaaatcttctgctgggaggaggtgagaaccaaacccaggccactcttttgtagcagcccttaatttaaactcttcctcttttccaaaactctcctcttttgcccatttccaacctctgagggattaccctacccccaaaacaaccttttgaaagtttgaaacccattattgaaatccagatcttctttttaaagccaaataaagtaaaggccagaaggaatgtgaacattttgtaaagcaacatagtgatttagtagctgtgactataatttaggtttcctgtctttttgttttgagttttatagtatatcctcctttactttaagtaactgagttactatctgcttaaagtaattataaagttttaaaatgcatatattttcttcttatatgtgtgttacatgtaatgcattgaactacaaatagaattaattccaaaaaggctgctttacacttactcttgtgttgtttctttcagctttaagttcagagatttcttcttccttttctagaagttgttccctgcaggcatttaattcttttgtcagtgcagcaaattcctggaaaagtaataaaaatatttgaagaaatattcaagatctaaaagcagaaaaaaattcaaaatataaatttcaaaatgaaaagaatggggaaaaatgaccccactgactggtcaacatatgttgctgttatgaagtatcttaaatacattattcaaaacatgctaatccataatatgtgtcatatgcattttattacagtacactgcttagatgggtgtataaagtatatttcaaaatatatcagatacatcacactgagcctaacgttaatatgataacttattcctagagtaaatttaagtttggctaattttatgaacagctcccaaaatcttacactttaattcctatacagcaatgtttatacagagtacagtggatcttcagaacaaccgcaaaaaaccctgctaaacatgctattttgaaattaacaaatttatttgttaacaagatgaagcagaggaatctacctttttttttttttacaaaataacaaaataacaaatatgcctaagatttgatagcattatctaagattttcttattaatttgcgtattgctcagtctttctaaaaggtaagctccatgtggacaggggctttgacttgttcacggttacaccaccagtgtctaagacatagtgggagctcaaatggtatttatttttagttgatagaaataggtcatattgttacaaaaaaattggggattctggagtaattctgtcttcatgtggttaatgacactgtgaaggaatcttcattggcctccttcccctaaatgggatcagagatcatatgatatggtatttttaccaataggtagagagtttgttaacacacagaaaaggttatttaataagaagaccaaaaaatgcaactattctgctattctaccttataaacaaatatttatttttttaaatatagtaaatagatccatattatcaccaaaccctttagagtgattttcagtagtaacactgatgcttatcaaatatttaagtatttgggaaaacttaggtccatgctgagaagtcactcagaagattaaaaaacataaaatgaaggagacaggtttggttaacctaacctccagggaggcaaatttaataaaaagtaaatgaatatgatgattatgcaaagctggggaaggtttggagtttatatttttgtttgcttcaaatcatttattttgcttagtttctctaaagggcttcagcccaagtgagtacttcaaagatctcagagtaggcttcagggcttagattctagatgacagagtttgttgttgctttttggctgacatagggataaatgttttcttccctgattgccgcctgcttaaatgttgctaatactctgagcatattatttaggtggtaaatggaaataaagcaaatagaaaacaataaacctttctctagaaaataaaattttcttcatatacagcatagttttgatagagaaaagaagtgatacctaaagattctttattgcacattattaacatgtaggcattcagaaaaaatcttatacttatgtatattataaacattgactaagataaaacataacatctgtatatttatcatactaattataaaaaatttattcatctattagaattttaacattagatatctctaggcagtgaaattatgaatgaattttggtttttggcttccacccaagtatttctatcatcaaactttttacaatggagaaatatgttttcgtgctttgaaaataagagaaaatataaacctgtaagtgcactgaaacaatcaagtttttaaagcagaggggagaaattagtgaagatgttataggccacagaaagctcggccttttttattatcatggcactgattctgagtaggctagtgactccatgtattaagattagtcttacatttactaacttcctagcaactttcaggcactactttcacatttattataccaccttgctctctaaatacctagtgaggaggtctcactcccatcttatggctgaggatactgaataatggtaagctgtatgtctaagttcacaaaactcacaagccatagggagtgagttagctctgagcatcattctccactgcaagtttagtgcttttctactatttcactttgaacctagttgtttgttgggtttatattattcagatctggagtacatttagaggtaccctttttccttatctgaaacattaaataatattactactgatatggtttggctctctgtccccacccaaatctcacattgaattgtaacaatccccacgtgtcaagggcaggaacaggtggagataattgaatcatgggagcagtttcccttcatattgctttcctgattgtgagtaagtttgagatctgatgattttataaagggaaaccgctttcatttggtcctcattctctcttgctgccatcatgtaagaagtgccttttaccttccaccatgattgtgtggcctccccagtaacgtggagctgtgagtccattaaacctctttttctttataaattacccagtctcgggtatgtctttatcagcaacgtgaaaaagaactaacacaactacaattatcttgcatgatcccccttaattagtccaagagtgtggggaactagaaggtccaaagtatagtataccttccacacagagcaacaagtgttagacaagtttgttctatgtatctgagactgtgtagaggcagatatctcacatggagttaaccaccaaacattttaacacttttcctctgacagttctctttcctatacctattctccttactgtgaacatgaactgaggcttacatcatcttacaaagataccactaacagcaaatagggttaacattgattgcaaacttacagtatgttaggtcctctgccaagcaatttatattaattacctcatctatcctaataacacaccttaagaaactactaaaatctcactgaggcctagagaagttaagtacattgtgcaaagttacacacctagtccatgatggagctgggctttgaacccagacaatctaactcatactgggtgattacgataagttgtttgtttcccctgaccacattttcccttctgatttgtgtttcaatttttggaaaaattatatttcccaaggtcatcaaactttcagtgctttttaccttcaaatatatcaaatttaaaccaactttaactttcaaaattcaaaccacccaaaacataaccctttcataactaattagctttattacttacagaacaatagcaactattaataccactttgagcagttggcactttgttttgccatgccccaagctaaccattttacatgaataactccatcgactccctatttttcagatgaggacactgaagcttagcagtgatgaataacttgttcaaggtcaccgctcaatatgacccactttgattctaaaacgtttagatttctgcaacactgcctccttctggctaaaaatggagtctctttatcaaatgtctcaagcattctgggattatcatccgtctaactatccagccattcatacaacatttgttgaccacttaccacatatcagaccctgtgctagatgctgaagatatgaagataacatagaacagttgttgcagttgacctcatagaaatgtcagaattcacatttgaggcccatcagggatctccatcattaaccagcactcaaaacccatcaccaaagtgccacacagagtaataccagtgtatgccctttagaagtcatatgtccctcaaaagcctccttcttagatggtctatcttctgcaactactgtgaaacatttctctttcctgtttccatttctaccttttcatttttttcaactttttttcttgtttctttcacaaactacctactgtgcctcaaatactcttcatcatccctctgcctaactaattcatttttaaaagcactagttagccttcttaatgctttaaaatacctagttgtattgtttttataactgaattatgtgttcgtctcctccacctaaacagtacaatcctttaaggcaaggttgttagagtatttttatatccttaggtcttagcatagttcctggaaaattaagtaaacagtaaatccttgttgtgataataaataaatggcttactttcctcaaactttggactttgataccaaaataaatttagaagatattattggaggttttttttaaatttttctaagtgagatcactataatttgcttaacatataacagatataatattcttttttactttgtagctgttgttttgtctatattgaaatatgctatattctacacggcaatgacattattgtctgccatgcttttctaacatatatatatatatatatatatgttagaaaacatatatatatatatatgttttctaaaagacccatacatatatatgtcattttgctctttgtagttgtgactgatctaattctcttatctcactgattcaaacacacttctacagattccttttaattcagacatggtgaagtatgaataaagtttccttctaagatttctcactgctttaaccttctgataatactctgtattatatattgtattctgtttcttacctttttcactcatatatatgtatgtatgtatgtatatgtgtgtgtgtatatatatgtgtatatatatatatacatatatatatatatatatatataatatagcgattacctggaaactgccaaattcaacaaattattcagaaaatcttctctgatcctggtagtttcttcaaagagatctgcagtatacctcccacctaggaataggctagctctagtgctgaagctcactattatgaaagcataattttgtgatataaatatttgtgttgaatgcaaagatactagaatgaatgagagcatatgcacctgagagaaaatgaatgtggcaggagaaataatgaaaatattttctattccgtagtgctttgggcctattgctctgaataattcatgcatttaaatttatcatttgttcattggatctatcacattggtcttattcatgcttaaagtgaaagtatgtgtttaactaatatggtatttctctagtctagcatttctcaaattatgattttagaacagtatttccacaagattcccagaaaggaattcactgggaacaacctagacttccatatatataaaaatgtatgatttaaatatagtaaatgtgcatgatggaatattatgcaaagggaagaataaacaggttagatctttgtacagcaacatggaaagatttcaaaaatataattttgagtgaaaaaggtaagaaacagaatacaatgtataacacagagtattatcagaagcttaaagtagtgagaaatcaatgttagaaggaaactttattcatacttcatcaagtctgaattaaaaggaatctgtagaaagagctaagtgtgttaaaatcagtgagataagagaattaggtcagtcgccaactactaagcatactcaacaacttttcagactattttgttcaccaacctatgcatggcaaatactttctttttccaaagagcaaagtgactttccccactctatattttgtcctttggaattttaaagaacagtcaagatctagaccacacagtgccacaacagtaccctcagcacgaagggaggggtgcccttctctttcttagtgtgtcctcaggcacatcacaaacacatttatatgagcactcactatgtagtggaccctgtttttagtgctgggaagatgacaagcaaagaagcaagttaaagtccctgctcttgatatgtttacatgcattcagggaattaatcattcaaactacttttctctgaaattaatcttttctagccatttctatccctctcaatagtaattcagctcatggtgtaaagcaatagtttctttatttaaaaaaagaggaaaataaaataactttcttttctgttaatatcttaaaattttgaaagtatcatttcttatacaccaacataggacatctaacttctgtgcactcctgaatttgttacaagtctcttaaattacataaaatctaaagctcttctatttcagctaatattcccagttgttacctttttacttattttcttccccgctcccatcatttttttcttttaaaaacagggtctcacctgtctttaaaaaaggacaggggtcttgctatgttgtccagcttatctcaaactcctggcctcaagcaattctcccacctccacatcagctttccaaaacactgggattacaggtgtaagccactgagccttgctgtttacttaactatcatttcttaagtactaagtatatgctgggtacattgttatgaactttacctctattatgtcgtttaatcattatagcagtgttattattcacagaacacagatgagaaaagtagaagagattgtttccatcaaaacccattctattgtatggcaatgctggtgccaacatccctgaaacctgtcatatcccagagcaaagataagctgtcttgtatcttatcagtggtttcactcttttgtgctgacttctaagctaaggatgagcttgagtaattcaagtgtctgtgctgcaaatatctcaaatgacaggccttaggtcaatatgttgttcttagtgagtttaatgaaaagaggcttctcttgttttgatctctgcatatgttatttccaaagtgaaaaatacaggggcaaagcatagattcactcagttcttgtgcctatttacattcctagacaggaaattaaagagtgtataacctcttctggtcaactttcctcttgtttttaacgtatgccttttccacctggtatatcaccatagcctatcgggctacccattctcagacagacacagagcattctatttttatacaggttcatctttaaactcattttctgatatttagtaataaacataatagagctggaaaaaaaaaaaaaacttctaacttccctgactcatttcagatggtatgcttacttgaggaggtttaattgagaaaaaaaatgacatattttctcatttactaaatgcttgaaaggctttgatttaataggtaagtccccacctcaggaaagctggttaggagaagctgcatggtaagaggaaaattcagcctttcaatttcaagtcaatgacaccagacagtctccagagaaatctctgacaatgcattcatcttgattacaattttaatactctttacctttcaattaaacctgcattttctaatcttgtgggccacttaattaatgaactgacaatggccttatttctgcagccatctatctgagtaagtcctgccttgaagaatcgtgagtgcaaaccagtttgagagagaagaggaaaaataaatggtgagttggaattcagcttcactaaacactgccaacaccctcaccgaccacaaaaaagcatcttttaagtttattcttcaaccatttgtgcaaatcaaaaatagcgctcaggaaagcatatggcatggaagcatgctgatttgaccatctagcatttcaattagacaaaattaactgcttcaaaatgctttttttataatgacttccttagtctaggcccctcatttactgtagtttggtgtttcctcctttgaactttaataattcttctagcaattctatttgtaatactcagtggaaagctttggattttaaatctatttttatttgcatataatttcacataaatttacatgtaaaaaaatatgtatgtttttccccaaaccacaggacatactttctagaaccgattaataacagaagtattacatttgagagatataaacaaagcaacaaaaagataatatatttctcaaattttatatctacacttagtatatttgctggtaaaaattcagaggagtctttagaaattcagtttggaaatcatttagtttgggaagaaaggcatatagaaattaatacgtaatcattatatcactatgtatatgcaatatttttattttattatgtaatcaaatgcagtgttaatgacctctgtttttataattgccttctggtctcacatgagcccagggaatgctgtcatccaaaattactgtgcaaaacagtaatgtctcacggtcagccctgggctagacagcttgaaggtagaatcgcctgcataactaatgtaatgtgacaggcacaactggactcagaattttcacaaaaatcattgggtaagatggctcaagttaaaagaaaactgggtttaaattccatgtgcattatattttgtgcccccttgaatttttatgtatctatattctaattagaaagctttttggtctttttcctaaaactgcataatagaagactatgttaacatatcatggtgacttgggggatgcaagcctatttaaaatccaacatgctacaaaagtcattcccttggtagatgtgtacttggatacttagtaacttttgttttcaaaatcttctaatcaaggtacttagaatctttcaaaaagtggatgtttgtggaaatcaaaattgtcaagcagtctcaggctgtctgtccatcaagccatgaatcattcactatgctcctactgaaacgtacctatcttatatcttattcccactctgctttgctttgtggacaccaatttctcaatgtatatagagagctgccccaggtattaggctttctttgacaatagcttgctagagatgagtcagcttgtttttaaaccctggagagccggtactacagattgtttttaaatcctggagaggtcactacagattggttgggaacgtatttggaggcaaggtagggttttctcagtatccccacaatggctgttctgctgcactgcattgcttctgtgggccctagtcacatttgtcttcttgggcccattcatctattaaaaaatatatataatttttaatatatataatatattatattaaatataatatataataaataatattaaatgtaataaataatatacataaatatatatatattaaaaaccatgcagtttttttctttaatggtaactgaaacgtaactcgagattcacctacccaaggctcattttactcattgccctttttctttggaaggcactaatactgaaactaattttatatcagggacaagaggattatcttcaagcataataataaaaaagagagagttctactatatcattagcaaactagcatggcagaagtgattgacattagtgtgatacagtaaaaatactcagcacatttttggagagaatatatcttactgtacccctctgttcctgtgttcctgcagtaattcttgctgatcaaaaatttacattacgactacctaagacacatcaagtgacattctataatgttaatgtatataagggtagagcctatgaggaaattctctagatatcataaaacagttcttaaaagctttcttaaacatgtctctggccaggcgtggtggctcacgcttgtaatcccagcactgtgggaggccaaggcgagcggattacctgagctcaggagttcgagaacagcctgggcaacacagtgaaaccctgtctccaataaaatacaaaaaaattaaaaatatccctcagtatctatggaattagaacatgttacattatttgaacatttgatgacaccatgtcatgtcagtgtgtcctttatcttctattatcgtctcctcatctctctgattgcatctattatcactaacccagggctcacacacctctcaagatgttttctggtgtctgaaatgcaatgatagtataaaacatatttgagaactttttaatgaacccttgcattgcttgttctgagatgctgttttgagaggagcccagctgcctacaagtctgaccagaatccagggttaaagcctgaagtctttcacagattccctgacccaggtgggaaggatgctccctattgaatgaagctcccacctcaccctttgggctcctgctctaagtttgagtggctgccttgttcccatatcctgtccctctgcataatattactagaatgagaaggagacaaacccaacggcttagaaccaagactgaagttactcactccaagtttccttttcctttgacttgctccatctccccttcatttttctccaatagaaaaaaataaaacaaaaccttgttctggtcttattgtatgaaagaagagagagggaggtcatcaggaagcaattctaacagaggaaccaacctacttcttcagccaattaatgctcttgtccttaattctgactcatctttatggaggagagggaaagaatcttcaatctctataaatgcccaaaagatatatttgcttatttgatgcttcatgcatttgtacatttattaaaactcgacattctaagtacattagtacaatcaccaggcccagtaagcattgtagttaaagcatgtcagggctgagtcattgccaaccaaaaactcttttggcaggaaaagccaattttcaacagctctgacagtgtaaagcaggaggcatgtttgacaagatgctgcatattaatttaaaagactttagcatctggttaggtaacacctgctgtggcaaacactcccagacacacaaaatagcattcgagctgaatatttaaatctcccaacatagctcaacaaagctctaactctaaacaaaacaaaacaaaacaaaatcacatctctagcaatcagttataattatataaccaaaaatatttgggctacaacattgtttgctgttcactgagctgaaatgctgtagtgggtgctataaaagttgtaaaatctattgaaacatattttcctgccttgaagaatttaactgtgtacaacatttaaaattgcacactgtagctcagaaaatagcactttgtgttataatatgttatatcaatatacagctaagaagtttatcactggggggtggggggtgaaagcattaaataacagagtaaaagaagcaaaccatgagagagaaatctggaaagactcttctagccactctctctgtgaaagtacatcccagcctaagaattgtagttgtctggcaatagaggcgtatgagagttctggaattgttaggacacactaacatgacacggtgtcatcaaatgttcaaataatgtaacatgctctaattccatagatactgagggatattttttaattactcaattttttatgtcatttactgtagagaaggagcttgcccttgtcagcctagtttggatactggctcacttgacaatgcatttctctctgcaaattttaaaaactgacactttgattatttctctatttactcgacaaaattttattggatgcctaatatgtaggagagcctgtgaaatttttcagacaatacaatgtgtacaatggtgaaaaagacatcgtaaatagaagtaagtgaacaataattacaatgaaatgtgataaacgctgtgatggggttatatccagggtgccccgcatgcacccctgtaggagggtatgtgcgtgaagggggcatctaagatgaaatgtgaaaaatgagtaagagccaggcaaaatgtatgttgaatgaaaattcttccagataaagggagcatcatgagcaactttctaagatccaaaagagcctaagcatactaaacctataaaattcttacagaaatacatagaggtaaatctttgcaatcttggattaggtaatggtttcttaaatgtgacgccaaaagctcatacaacacaagttaaaatagtccagactccatatgctatgactgaattgtgtcaccaaatgcatatgttgaagccctaatccccaacatggtggtatgtggagatgggaacgttgggaaatcattaggtttagatgaagtcatgagtgtagtgctctccagctgggattatttcccattttagaagaggaagggacaccagagctctctctctgctatgtgagggcacagcgagaaggcagccatctgcaagccagaacgaggtctcagcagaacccatccatgctgaaactctgatctcaggtttccagcctccagaactgcgaggaaatatatctttgttgattaagccatccagtctatggtattttgttatggaagccagagttaattaatataccataaagttaagatgtttacacttcgagtagtatcattaagaaagtgaaagacaatccacagaatgagacaaaatatgagcaaactatatatctgataaagggctggttgtcaaaatatataaataactattacaattctataataagaagacaaataaccaaatttatacatgaacagataatctgaatacacagctctctaaagataagtagccaaaaagcacatggaaagctgttccacatcattaatcgtcagagaaatgaaagtcaaaagcacagtgaaatacaatttcacataacctagaatggctataatcaaaaacacaaataagcattggcaaagatgcagaggagcctcatacactgctggtgggagtgtaatatggtgcagccactttgcaaaacagtttgtcagtttctcaagcggtaaaacatagagttatcgtatggtctagcaatttctctactaggtatatacccaagaaaattgaaaacatatgtccacacagaatcttgtacatgaatgttcatagcagtgttattcattatatctaaaaggtggaaacaatccaaatgttcaacagtggaggaatgaatttttaaaatgcatatacttttttgttgttttatttcatatcgttttattttctgtgataagaacatttaacatgatatctgacctcttaacagatttctaagtacacaatacctaaattgtaaaccaaaggcactatgttgatcagtacatgtctggaacaaactcatcttgcacaattgtaattttatacccattgaacaacagctacccacataccccttcccccatctgctggtaaccaatgttctgttgtctacttctatttctgtaactattttagatgccacatatgtgaggaatcatgcagtagttgtccttctgtaactgacttatttccctcagcacaatgtcttccaggtcctttcatgttgtcacaaatggtaggatttcattcttcatttttttgtctttcctttatttatttatttatttatttatttatttatttatttatttatttgagacagagtcgtgctctgtcttccaggctggaatgcagtggtatgatcacaactcacaacttactgcatcctctacctcctgagctcaaggggaatccttccacttcagcctccaaggtggctgggaccatagatacactccactactcaaaggtagttttatttttatttatttatttatttattttggtaaaaaagagatctccctatatttcccaggctggtctcgaactcctgggctcaagggatcctgctgcttcagcctcccaaagtgctgagatttcagccatgagccacagtgcctggcttgggtttcctttttttttttttcaagggtgaataattttctattgtttgaatatatcacactttctttatccattcatctattgatggacatttaggttgttttaatttcttggttattctgaaaaatgttacaaaggacctaggggtgcagatgtttcttcaagattctgattttaatatctttggttatatacccagaagtgggattgctggatcatatgctcatcttatttttaatttttttgtgaaacctccatactattttccatagtggctgtaccctattacatttccaccaacagtgaatatgggtttcaatttctccacaaccttgccagcatttgttttcttttgcttttcatttttgaaaatagccattctaacaggtactaggtgacataaggaaatttttgaggtgatgaacatgtttattacctgaattccattgtggtgattgtaacatgagtatatacatatgtccaacctcacaaaattgtatacattaattatatgaagagtttttttaaacaaatacacacaaggaaatattattcaacaataaaaagaaatgtagtatacatgctataatatggatgctccttgaaaaatatgctaagttaaagaagccagtcacaaaggaccatattgttgtatgatcctcttaatatttaatgtccagaataggcaaatatacagaaacagaaaatgaattagtggttacctagggctaggggagttggagagattggaggaggtgagagctaaggagctctggatttccttctggggtaacaaaaatattccaaaattaattgtgatgaggatgcacaattttgcgaatatactaaatgccaatgaattgcatttttaatggctgaataaaatggtatgtgttgttgcaataaagctgtttaaataacagtagttcagtttggatggaatggagggtaagctatgttagttattttggtctttggtaaaaggcaataatgggcaccatggaaggaatttaggcaggtgaatgacattattaactttatcttccttattattagtttagcaaccactcaaggaaatttaaaacactaaatttctggacttgccagactaagggccagactctggacctcaccaaattcatcaaggtaatgtaaccctgaaatattctttttagtaaccagtatgcttgtggacacttaattcttttaacatcaatagcatttattgattgttgccattggacccatccttatgaccatcttaacatctccttccccagcaaaaaaacaaaacaaaacagaacaaaaaaaactaaaaacaaataatgcttcacattaaaaatatgccattttctctcctgttcctaggggacttcccttgctatgagtatcttgctggtcagtagaagcagaaagaatctcagatgactctgctttcttgggaagcactttgtaaaatacaattttcaaaaagaaaaaatatataaaattactcacatattatcttaatctttgcaattattcataagcagtttgcaaagactcatagtaggaataactcttgaattctctctatcctgtagctatttactcatttatggaacaagccttgtaagtattgaattgctacagaaacatatatgtacataaaactgcatgtagggccgggtgcggtgactcacgcctgtaatcccagcactctggggggctgaggtgcgtggatcacctgctgtcaagagttccagaccagcctggccaacatggtgaaaccttgtctctaccaaaaatacaaaaattagctgggcatgatgtgggggcgcctgtaatctcagctactagggaggctgaggcacaagaatggcttgaacccgggaggcggaggttgcagtgagccgagattgagccattgcactctagtctgggcaacagagtgagactccacctcaaacaaacaaacaaaaaaattccatattggtagcaaaatatataactgggtatataacaaattgaatttttgctattttataccatcttcctacagcttcatcagataaaccacatgtgtgataacactctgtactccttcgcctgagacatgaaattatcatgacatttttcctgaagcagccgcataatattccttgatgctggactttaggcagcaactacttaataacccaaactggcacccaagatgaattttattggccatgctgttctggaattgtaaattttttacatctccttcaaaatataaagtatagatcatagtccaagttagaaaaatatcctaccaaaaattgtccaactgcagaaccatgactttgcttattatttacttatatcaataaattacattagaatgattgactgttgtccatgttatgcacagaaatcaacataagataatcaccttatttgactgcagggccatagcattccttactcatttttatttatgtaataaataatgttacctgggaaaatggaaaaacggctatgtgtcaaagtgtgtattcagatgttctttcttctcacatttttctttaacaatatatttcaagagaaagactatatttcaagtaagaactccaatctttttttaataggaaaaaatgtttaacaccaaggtaggaaaatattctcaacatttccttcgtgtagaattgtattctttatttttaaattttaattaactaatttgttttgagatacagtctcaccacttcgtcaagcaggctggagagcagtggtgctctctcggctcactgcaacctccacctcccggtttcaagcaattcttgtgcctcagcctccccagtagctggaattacaggcatctaccgccaagcacagctaatttttgtatttttagtagagacggggtcttgccatgttttttgggctgctctcaaactcctggcctcaagtgatccactggcctcagcctcccaaactgctgggattacaggcatgcaccaccacacccagctaatttttgtatttttagtagagatgaggtttcaccatgctggctccactggtcttgaacccctgacctcaagtgatccgcctgtgccagcctcccaaagtgctgagattacaggcatgagctattgagcctggccctcttgtggagtttaaaatttttcttttaaacaatcccaaatttgtaaatacatactagcaccagtatcattttgttataacttaactgctgtgaaatataattattactttttgactgtattctttaaaaatcctgtaatacacttcataagcaaaaattgttattatttctaaatgtttttccatgaattaaagaaggtttagccttcttctaatgaactataagtttgctaattttgccctattgttttgtatagatcactcttagaatcatttaggtgataaagtcactagcagatacaaaagagggactctgactgactgaaaaatctagatagatgttgaaaatgtgaattatttataatagaataatacacaacacaaaaataaaatggtattttaagattaatgagatttctaggtgaattatttccaattttaattattcatactactctttctttgatttttgttagtaatcttggatagtcaatcttcagatcccactaagacagaacactagaagctttaattctattctgtcatacaaacctctgtatctagatgataaactctgtgagaaccagaactaaaactttctggccttcgttattttgccagctccttacatagggcctgaaatagagactgtgtatttgttaaaggaccatggtaaaaggatcacatttagtaactaaagtttgatgcagattagtaagcatttttatttaagtaaaaataagaacaaaaaatttgttcctgataaacctattggtgaatgaatcttaaaacatggcatatatgtttcattattttaaaactgttattctgtaaacattttaaacttattttatataatgtgttttataattttaaaattcgagaatacaatttgctatttattatttctcctgattctagcacaaggaaacatagttcttcccgtgattttaaatattgacttgcaagctcatatttggttattttaatccgttgagatttcttctgtaatgtccacctgaaggcacttcagagagaatatatattttccttctgctaggcactatgaatcaaggactactttaagttgaaagggttaaaaatgtgaacgctgatctttttgttattgttgttgttttgagacgagtctccttctgtcgcccaggctggagtgtagtggcgcgatctcggctcactgcaagctccgcctcctgagttcatgccattctccttctcagcctccagagtagctgggactacaggtgcccgccaccaaggccggctaattctttgtatttttagtagagacggggtttcaccttgttagccaggatggtctcaatcacctgaccttgtgacgatcatttttaaggacagcaatgtggtaactttttattgtccctccaccttagctcaagcttatattaatggtcaaactgatgtctttttgttgatgataagtttcttctaggctagtctatgtctttcagagtgaagctcctcagaggctctggacttatgctgaagttttagtttgacctcctttcattcctcaagtttctagttcctggaatcagcaaatatctacagggtgctccagctttcagaatacactctgctggtttttaatgatttggtttttcatgaaagtgatgttgagagtttaaaagcatttgtgttgcatttagtctaggtttttgtagtgagaagtctttcagactttcctatttgccacacagtctaaagcagaagttgaatatgatgaaatatttatagatgttaagctccaatactgaatattaaaagcaattcaagccattgcagaatcatccctgaaaatttgtatttattttctctctgccagttacctagtttgtgagacacatgattaaatgtgacataaaaattaagttcataaagaaaaatacaataaatctatatttatatcacataaatatgaactgtaaaataattcagtcaactaaaacagattcacatttcaatagtgaaagtgctctctgttaagaagtttggtctgcattgtggaagacagtgtggcaattcctcaaagacctagaaccagaaataccatttgacccagcaatccaattactgggtatatacccaaaggaatataaaccattctattttaaagatacatgcacacaagtgttcattgcagcagtattcacaacagcaaagacatggaaccaactcaatgcctatcaatgatagactggataaagaaaatgtggtgcataaacaccatggaatagtatgcatccataaaaaggaacgagatcatgtcctttgcagggacatggatgaagctggaagccattatccacagcaagctaacccaggaacagaaaaccaaacactacatgttctcactgatatgtgggagctgaacaatgagaacacatggacacagggaggggaacacacactggagcctgtctgggtggtagcgggggaagggagagcatcaggaaaaatagctaatgtatgctgtgcttaatacttaggtgatgggttgatgggggcagctaaccaccacagcacacatttacctatgtaacaaacgtgcacatactgtacatgtaccctggaacttaaaataaaatttaaaaaaagaaaaaaaaggaaatttagtctgaagaagaaagacaaaacctcaggattgagagaaaaggaggagagagagctactttcaattatttgaaaaggctttcacctggaaagcctttgacaaagttcctttgacagagaatgattatgaagaagtcaggaaaacatatttttacaaaatgatatattccaccatttgttcattgaatattttgaaagtgatggccatgtgtgaaaatctgtgctggtcttgtgccggtcttcaaagggaatgcttccagcttttgcccattctgtatgatattggctgtgggtttgtcataaatcgcttgtattattttgagatccattccatcagtacttagtttattgagagtttttagtatgaaggaatgttgaattttatcgaaggccttttctgcttctattgagataatcatgtagtttttgtcattggttctgtttatgtgatgaattacatttattgatttgcatatgttgaaccagccttgcatcctaggggtgaagccgacttgatcgtggtggataagctttttgatatgctgctagattcagtttgccagtattttattgaggattttcgcattgatgttcatcaggaatattggcctgaaattttttttttttttaattgttggatctctgccaggttttggtatcaggatgatgctggcctcataaaatgagttagggaggagtccctctttttctattgtttggaatagtttcagaagggatggtaccagctcctctttgtacctctggtggaattcggctgtgaatccatcttgtcctgggctttttttggttggtaggctattaattactgcctcaatttcagatcttgttatatgtctattcagggattcgacttcttcttaggttagtcttcggagggtgtatatgtccaggaatttacccatttcttctagattttctagtttatttgcatagagatgtttatagtattctctgacggtagtttgtatttctgtgggatcagtactgatatctcctttatcattttttttattgtgtctatttgattcttctctcttttcttctttattagtctggctagcagtctatctattttgttaatcttttcaaaaaaccacattctggattcattgatttttttgaaggattttacgtctctatcccttcagatctgctctgatcttagttatttcttgtcttctgctaggttttgaatttgtttgatcctgcttctctggttcttttaattgtgattttaggttgttcattttagattttagatctttcctgctttctcctgtggacatttaatgctataaatttccctctaaacactgctttagctgtgtcccagatattctgctacattgtgtctttgttcttattggtttcaaagaacttatttatttctgccttaatttcattatttacctagtagtcattcaggagcaggttatccagtttccatgtagttgtgtggttttaagtcagtttcttaatcctgagttctaatttaattgcactgtggtctgagagacggtttgttatgatttcctttcttttgcattatctgaggagtgttttacttccaattatgtggtcaattttagaataagtgcgatgtggtgctgagaagaatgtatattctgttgattcggagtggagagttctgtggatgtctattgagtccacttggtccagagctgaattcgagtcctgaatatccttattaattttctgtctcattgagctatttaatattgacagtggggtgttaaggtctcccactattactgtgtgggagtctaagtctctttctaggtctctaagaacttgctgtataaatctgggtgctcctgtattgggtccatatatatttaggatagttagctctacttgttgcattgatccctttaccagtatgtaatggccttctttgtcttttttgatctttgttggtttaaagtctgttttatcagagaccaggattgcaacccctgcttttttgtttgtttgtttgtttccacttgcttggtaaatattcctccgtccctttattttcagcctatgtgtgtatttgcatgtgagatggttctcctgaatacagcacaccgataggtcttgactctttatccaatttgccagtctgtatcttttaactggggcatttagcctttacatttaaggttaatattttcacgtgtgaatttaatcttgtcattatgatgctagctggttattttgcccattagttgatgcagtttcttcatagagtcgatggtctttacaatttggtatgtttttgcagtggctgatactggtttttcctttccatatttagtgcttccttcaggagcgcttgtaaggcaggcctggtggtgacaaaatctctcagcatttgcttgtctgtaaaggattttatttttcctttgcttatgaagcttagtttgactgaatatgaaatctgggttgaaaattcttttctttaagaatgttgaatattggcctccactcttctgcagagagatccgtggttagtctgatggacttccctttgtgggtaacccgacatttttctctggctgcccttaacattttttctttcatttcaaccttggtgaatctgatgattatgtgtcttggggttgctcttctcgaggagtctctttgtgttgttctctgcatttcctgaatttgaatgtttggcctgtcttgctaggttggggaagttctcctggatagtatcctgacgagtattttccaacttagttccattctccccatcactttcaggtacaccaatcaaacgtaggtttggtcttttcacatagtcccatatttcttggaggctttgtttgttgcttttctttctttttttctctaatcttgtcttcacactttatttcattaagttaatcttcaatctctgatgtcctttcttccacttgatcgatttcactattgatacttgtgtatgcttcatgaagtactcgtgttgtgttttttagctccatcaggtcatttatgttcttctctaaactggtcgttttagttagcaattcctctaaccttttttcaaggttcttagcttccttgtatggggttggaacatgatgctttatctcagaggagtttgttattacccaccttctgaagcctacttctgtcaattcatcaaactcattatctgtccagttttattcccttgctggtaaggagctgtgatcctttggaggagaagagacatattggttttgggaatattcagtctttttgcacttttttcctcatcttcgtggatttatctacctttggtctttgatgttggtgaccttcggatggggtttctgtgtggatgtcctttttgttgatgttgatgctcttcctttgtatttgttagttttccttctaacagtcaggcccctctgctgcaggtctgcttgagtttgctagaagtccactccagaccctgtttgcctgggtatcaccagaggaggctgcagacagcaaagattgctgcctgttccttcatctggaagcttcctcccagaggggcacctaccagatgccagccagagctcagctgtatgaggtgtgtcctctcttaccactcctattcaacatagtattggaagttctggccacagcaatcaggaaagagaaagaaataaaaggtattcaaataggaagagaggaagtcaaattgtctctgtttgcagatgacataattgtatatttggaaaaccccacagtctcagcaaaaaaatctcccgaagctgataagcagcttcaacaaagtctcaggatacaaaaccaatgtgtaaaaatcacaagcattcctatacaccaataatagagaaacagagagccaaatcatgagtgaactaccattcacaattgctacaaagtgaataaaatacataggaatacaactcacaagggatgtgtaggacctcttcaactagaactacaaacaactgctcaaggaaataagagaggacacaaacaaatggagaaacattccaagctcatggataggaagaacgaatatcgtgaaaatggccatactgcccaaggtaatttatagattcaatgctattcccatcaaactaccattgactttcttcacagaattagaaaaaactactttaaatttcatatggaaccaataaagagcccgcatagccaagacaatactaaacaaaaagaacaaagctggacacatcatgctacctgactgcaaacgatgctacaaggctacagtaaccaaaacatcatggtactggtaccaaaaaaaatacatagaccaatggaacagaacagaagcctcagaatatgccacacatctaccactatctgatctttgacaaacctgacaaaaacaagcaatggggaaaggaaatccatacttcatcaatggtgctgggaaaactggctagccatatgcagaaaactgaaactggaccacttccttacaactcatacaaaaattaactcaaggtggtttaaagacttgaatgtaagacctaaaaccataaaaaccctagaagaataactaggtaataccattcaggacataggcatgggcaaagacttcatgactgaaacaccaaaagcaagggcaacaaaagccaaaattgataaatgggagctaattaaactaaagagcttctgcacagcaaaagaaactatcatcagagtgaaaaggaaacctacagaatgggagaaaatttttgcaatctatccatctgacaaagggctaatatccagaatctacaaagaacttaaacaaattaacaagaaagaaacaaccccatcaaaaagtgggcaaaggacatgaacagacacttctcaaaagaagacatttatgcggccaacaaacatgaaaaaaaaagctcatcatcactgttcattaaagaaatgcacattaaaaccacaatgagataccatctcatgccagttagaatggcaattattaaaaagtcaggaaacaacagatgctggagaggatgtggagaaataggaacgcttttacactgttgttgggattgtaagttagttcaaccattgtggaagacagtgtggcaattcctcaaggatctagaaccagaaatatcatttgatccagcaatcccattactgggtatatacccaaaggattataattcattctactataaagacacatgcacacatatgtttactgcagcactgttcacaatagcaaaggcttggaacccacccatatgtccatcagtgatagacggataaagaaaatgtggcacatatacaccatggaatactatgcagccataaaaacggatgagttcatgtcctttgcagggacatggatgaagctggaaaccatcattctcagctaaccaacacaggaacagaaaaccaaacactgcatgttctcactcataacggggagctgaacaatgagaacacatggacacagggaggggaacatcacacactggatcctgtcagccagtgggggataggggagggatagcattacgagaaatacctaatagctgtagctgatgggttgatgggtgtagcaaaccaccatggcacatgtgtacttatgtaacaaacctgcaggttctgcacatgtatcccagaacttatatatatatatatactgtgctgggatcacaaagaataaactgtgttccagtgctaaaattctgcttacagtttaagaagacacaatttcaggatatactatgatacatattatttgtgataaaaattgaattgtgttttataaatgtgagatagaataattctgccacaacagctgtgcatattaaaaagttatgtagaaccctacattaagcaattcatcattgctggcagaactgcaaaatggcacagtcactttgaaaaatagcgtagaatttatttgaaatgttagagttaccatataacctagcaattccacttctagttatacatacaaggtaaatgaaaacacatgtctataaaaaagcttttatatgcgtgttcatagtagcattattcataatagccaataaatgaaaacaacccaaatatctattaactaatgaatggataaataaaatttgtacagccatgcagtggaatattaattggcaatatgaagaaataaagtatttataagctataacaaagattaatcttgaaagcaaaagaccccatattgtaaaatttcagttacagtatatgaaatgtccagaacagcaaatccatagaggaagaaagtagcctggtagttgccagggccttggaggtggggcaagtggggaataattgctaatagatacagagaagagggtgatgcacatgatctaaagttagatggtggtgaaggttgctcaactctgtgaataagctaaaaaaaacactgaactatacactttaaaaggtgaattttatgctatttttttttcttaatacagttgttatgaaaaactgtaaggaaaaaactatctaaggtatttaaaaatcaaaatggaaaataactttcatagaaggttctatttctgaagtttaatattttcaattctataagatatatatttcaattttaatgaaatttctgctgtacacttgggaacttataacattataaatgtaatcatttcaaagtattttatagaatcacccttctcccccctcccttttttttgggtttggtgaccgataaaagtaaattatttcttgcccttgtgcagaagtttgaagtatccctcggggtaggaatcacttttaaaatgtcctactgtttcactgatggtgctgtattcttaaaggacactgacaaaaaaataatgtggcattacctgggcgaaggtcatttccttattaataattctacaatatcctggtactttcagagtttcatttttctgccctatgaaagaccaaataaaaagcctaaaatgctgacagaatagaagtcaaaaactcttgaggtggctgtaatggacaaataaaaaaaaatagtccacactattttgagtctggcactatgctagacactttggaagaaggggtggttttaaccacagtgatgctgattacctagtggggaaaacaaagcacgtaaatagttatatacaatgagacagaggctagtgatgaagatgtgtgcaaagtgttctaggaacactctggaggaggtgggattaatggtgactgtgggaggcagaaataccctcaaagatattaatattttcatgttgtacaataatattcaaaatttttccaggcttcatttgccataatgaatttatacaattaaaattcacattctgtaatttaagtatactcccatgaattcacataatagcactattcattagagtactacggaaatgaattaccattaatattgagaatatacatgctaggccagacccttattctagcaagagaagcatttgaccaaacttgatctcagcttttaaatctctactttggcataatttaaaacttcatatgttaaatatctttcattaaaataaaaatagcattgctaattttaaattcccatatttctattaaggctataagttgtgatgattttcatataactaattttggagatgaaatttaactacatgtatcaaaatgttttaaaatgttttctttctttgaatcagtaattcaaagaaagtgattcagtaagtgatatgataaaattaacaatataatatatagctacaatataattatttcaaggatatttagagacataagaaaatgcttattttatatagtaggtgaaaattataggctaaaaactactttaaaattaatgattcaaattatttttaaggccaaaaggaaatcactagcttgagctatatttcaaaaagccagcctagtaaatgagtatagggattatgaagtttttgcttgtcttcaaatttctaattcaaagtgatacttccataaatgtgaacccaatgcattatctagtcaatatatgcacttttaagaagacatctcattttattttagttgttctcttatttatatcgtttttgtacaggttatgtttttcttttcatcatcatttagtctttttttaactccttaatacactttatataattattcttacatattacatactcaataaatatatattttttaaaaatccttaacctataagttagttgcacctgtgtcacttccaatatatttttcctctagtgctaagaaataaaagagtactttccccaaataactcactcagatatacaactctcacctcaaatctgtcaccccttttgtgaatgaaaaatatttattttaaaactctgtgctctattaacttcagcctagatctaaatgttgtgtgctagaacacaaatgaatcacaagttcacatgaaaatttgttttaataaaggtatttcaaattttgtgcaagaaatgtataacacaagtcacaaaatagtaaacaaatcacttaaaatataagtttctatgagacgataaaatgtaaatttttgccattattgattgcaaaatatgaaagtctgaaactgcaaataatttgacaccctttatttaaggaacattgaatgttaaatgtataataatataagcgacataatttttggaactaaatgacttggcaagttccattaaaacagactaagtaccccatctgcaattaaatttattaaattataacacagataattccagcatatatgaggtcattctgaaagaacattcctattttgactttacttttcatttagctcattgtacacaatctctgatatattatcatacatttttagcgttataaattaatttttaaatgaaatgtaacacataggattaatagtaaatataatttcactatatttcaagcactgttctaggcacttaatatgtatcagcttattgactataaacaataaccatatggtgttgctaccatgatgatcccattttacatgtagggaaatagtggcacaaagagtttaagtgattttctcagtgccttacatgccttactgtcttatgtggcagaattagtactcgaacccagctagctggtaacaaaagttcagtttaatcactaagactgtacttctactttcattttattattataacatgaacattgcaacataaactaatatgccatgcagaaaactttcaggatattaacacatataaaacatttaaaaacatagtatttctagaaattatattattgatagaattttcaggtacaaattgccttaggaaaaaattctatttatgataaacatatgccaatttttttaactgcagatttttagtgatagatctattcaataaatttgcacaaagattttcaaatttagatgctggatatttaaatcagcttgtcattacatcctaaaactaataagtatgccatgctttatccatgtaactcatatcatcaacagtaggacatcagccacacaacttcagtttagaaaagtagtactcatatccactcttggctgacagtaatcattaaaataataatagatgataacattttttagtccacctcaagaaataatttttatataactgtcaactccaattttttgatgaggaaataaaaatgaaactaaaagaaaaatataagatcttaattgaacctgaaaacatatgccaatcaactccatccccttcttatagtcaaataataaaccatataaagccttggtaccagatttcttttaaaaatacattaatccctttgtttactcaatgcatatttacattttgcaaaacacggtgtgatttctgtccttagaaagtttcccttaggaaagaaaaacacgtgatcatgcatagcacagtgtgttaagctttggagcatctggaacctcaatttgccttgactggactggcctagaatatccactggagtgagttggttatctgtctatttacatgagggagaaaggtgacccctggaaagacgaagtagcaaggaggttaaagtctccagctctcgaagcaactgcttgttatttgaattccagctccatcttttttagctgtgtgttcttgggaaatttagtttaccttttttgtgttttatcttattaatctgtaaaacacggataacagaaacaagcaaagtcttactgggttgttgtgagacttaactaagttattcaggttaaatgcttagacaagtatgagcacttggtaagtgttaacaatgaattactattattattattattattaattactggaacaaactcaaagcttgtatttttaagggtgggagggccttgtcactggcgattctaggagtaagctgtatgtctccaagtcctgccaatctataggtaccgatattgccacatagcagtggcaataatcagcttccatggctgatatctcacacccatgctttcagaattctatcaggcccactcttaggattctttcacagtcaattccagttatttctttaaggcaagaaacaaacagtgtaggcataatatcatgaaaatgacagatgtttaatggccattgtgatatctgaaaaagctgacaaaactatatggaaagaataattaatataaatgaccatagaaggcaaaagaaatatatcatatttaaaggtaatctgaaatgtgtgtgaggacaatgaggcccataatctgattttatgtttaacatctgcatttccatttaattttgtattcattatcacttttaaagtattgatttaaaaagccatgtaatatagttagttagtggatacattagttgtggccgataattcctttatttaaaccagagaaagtagttttcctatgtaacattactatacataacagttagggaggtttgatggtctatatttcattgtctgttcctgttattttattattccagtttcttgttatatttgcctttggagaatagaatcagacaaacatgaaacctttgtcatatacagaataggaccataataaagccagaatgaactccgatttttattgacaagtgagtaaagtgtactacgttctcatctgtttcctctctctaccaccacaattcttttcacctgacattttgccatttttgggaggttttcaaggatcatatcctatgcctccctgctctgtcataacaggggatttcactgaagttacccccaacacacacacaaacacacccacagagagacaaaggacaatacaaagctatctccctctctttctgtcaccatatccattatcatggcacctgatactatctgagtgaattctgtcactcactcaaaagcccacgggccttacagcctactcttaagacactgattttactaattttgcattgtttcttctgtttaaggtgctcttccttgccctgtctatttggaaaactcttcttcattctttagggctttgatgtcacatcccctattctaggaagcctatgatcttcagacaaaatttggaaacctctcctcaggtttcccattgatgagaatatatatttatggggctataattttttgtacagttgtctagttcccacacgagaacacatgactctgaagggatggatggtcctttcattttaaccttctcacaacaatgtttctgaaaagggcagggtcttaatgtgttagaatgaataagctacctaatggaatatatgtatacaattaggcacagcgcaatgattctatgactgcaggttagccacataaacaagtatctgtcctatttcgacaaattaggccagatcaccaatgcccaacttttcttggaccagatataccatttaccatattctcaatatgtgctgacttggtaacattgagagatacaaaaataataaactacagtaattggaattattaatgactcaggtatttcattaattttaggcaaagtatccttaaagcattggaaagagtttaaaatttagttccctagttgctcagtattctaatatctatttctgtatctatatatacatctaataatatatatgggtgtatatatattattaataggtaaaatattcataatagatcattattttttaagtatttcacaaaatgctttggaaggaaccgtaaaactcaagatgcattccctatgatcaaggacattacttttagctttctttatttgaatgtttgcatttgcacatgtttcaatgcacctgttgaaagcaaccaaaataacacagagaaaaatcattagacagttttgattatgaactgggagaaaaagaatgtagtttaaaaaattaaccttttccctacttttctcttagttaccatactccactgccacacagtacagaaaagaaaaaataaatctatctttgagaaatgtttcattttcacttgaaatgatgcaattagtcactgctccatatatttgtgtttgaaacgtttctatcaagtataatcttagccagagcaccctatagtgtacaagctatacatgaatagtgaaagtattgtatttgttatttgaaatgtgtcgatgcagcacacttaattcaaaacatttatgagtggaggttgacaagtctgtccttctaactcttatggcataacttactatttatatgctacctgtatttcaagatccattctgtgttctaacactatagagaaggccaattgaatattccctcagatagaaatgaaagttctctctctgtccatctatctatttttctatctctttttcttattattacaatctttcttttgtatgtatccacttaacccattgtaacattttccccattataagacctagcattcctcctcttattaagaataaacaccttagcagtattggctacatggctgatgttgaattaagcgaattaagttgttggaaacacacaattcaaatttactatgtttgtgaatccaaagataggtttactcgtggagttttaggagttataaggtcagcctttggaaaattctgaattcgttttttaattatttcctgcgaatattgctttgtaggatatttctagaaacgcaacccactgaaaatagccaatctaaacattacaatctcagcataaacatttgcctcagtggaagtccttaattaccaaatggagagaaatgcatgcaggctgtcagcatcatgtttctccttggtagtgtctctcaccattttgccaccacgaatgtttctaaatggccaacatactacttcttctcatttgaatgtttatgtttgagaaaatgcaaaaataagagcactaagtgcaaacagaggtttgctgaagtttgtgtatttagctcctatggcgttctggatgccagattcacattcattagacataaattgatgttaagcagccttgactgcaggaggaaaagcaacaacaaaaatctcttcatacctctaagactttcagtcagattcttttcttacagaaccccattctgccattccagcacactgttttctgttcagtcttatcagtcttttcctgctttattcttgttttttgactgctgtttatgccacttaggcatttgcttatactggtccccatagattttcctcctgtttaacatcacaatggactcaactttctttgaagcatacctcgtctatggaagcaaatgacatcctaatttgttaactctaaggcattacagaactttattccttcaaggcctctaactttacttttggccttatcttctgccatgtcccatctgaacacaatgctgctttcacctgttcctttatactctccaggaggactgtgcaattgttttccttctgcctgaaatactctgttctatgtcatcttctgagataaggcttcccttttcacccactctacagtaggtttctgcaactcatttttaccaattatgatctctctctcctctcatgttttaagacagttaccttttaatgtttctggaattactttttttgtttttttgctttgtctccactgtattgaaataattgccaatccaggtttcttactttcaaaccttcttatatttaattcattttacaggtaggttattacttatcacaaatccttgtttggacattttatttcctcatctccatttatttcctcattctccccaaaaaaagtcaccccaccatttgataaatccctcatgtttagaggataaaatgaattgtctttatttattgctagagagtgaatgtgaaccctcaaaattcatttgttgaagccctaagcccgatttgatgggaatttgaggtggggcctttgggaggtaattactgttagataaatccatgagggtggagccctcatgatgaaaagaggagacatgagatattgcgctctctctctgtgccacgtgaggatacaataggaagcagactctcaccagacactggatccaccagtgccttgatcttgaacttctcaacctccagaattgtgagaaataaatagctgtttaagccactcggtccatggtatttttgtcctagtatcctaaattgtcgaagacagcactttatcaaggtcatcatgtactagtctttacctatagccctaaaccaaaatgtctaatacttctctaaaaggaacactctgcttcagggaagaaagaatgtttacaacatttctgctgttcaatttagcctcacatcatttctcttgcctggaacattatcttattcacccttcaatgtttctaaatcctatatacttaatttaaggcctagttcaagttgtagtacttcattgaatacttctccaattgataatctttcaatttttattcataattacaagatcgaggcagaaagagttttgtgtgcctgactttgtagacttagtaaaaatagcttcaccatttttttttaggaaataaaagcataatgtaagtactacacggcttatgtttgatataataacatctgcacaaaaaaacccacaaaaagtctcaattactctttttttttcaaaagtttatcacattccttcatgcatttactaattcaaacacatttataggtttccttgaagaggtccaggcattctgccagaaaatgggattatagtagcagactaaatttagtcaaaacagatcaaactccttgcccctagggagcttacatccttgcagggatgatagtggggttggagaggaagacattaaagaagacagacaaatacagagtgtgttacatggtggtaggtgctatagagtaaaataaaacggggaggggtggagctgcaatctagatagagatggcagaaaacacttaggaggagtgtggcatttgagcaaaggcctaaagacagcaagggagtaagacatgtgagtagataaggggtagttggaatatttcagagatgacagagtacttgaagcagaaggagccatgaagaggagaccacatctcagaggtaacttaggactcaagtatgcaggactctatgggctattatgagaacttggcttttgggaagcaaatggaagatttagagcaaaaattgacatggtcagatttctgtataaatgtaatcctttcagctgctatttgaggaacagacttaggtgaggcaaaagaggaagtaggaaaatcaatgagaggactattgaaagaatctggaaaaagataaaggtgacttgaacctaagtgttagctatggaagtgattgaagtagatagattatgcatatgttttcaagataatgtcagcaggttgaacaattatatgtgggtgagagataaagaggaaagtcagagatgatggaagatgactcagagtttttgccaaagcagctggaacataagaagagagattggaaaaattatgagaaaaggtttggaatgggaaagggaattaggaatcagtttttgatgcgttaaattgagatgtcaattagacaactaagttaagatacacatttttggtgtctggagtttgggagaagggtccaagttggagacgctaatatagaagtcatcatttataaaaaggtacttaaatctctaattcagcccaaattgctaaaggtatgagatagacttaatacacagagaagaggttcaaggactgagtcttggtacacttctcagtgttcagatgctgggaagacaagaagagagctaatgaaagatactgagagagtggctattacagggatgggaaacaccagagaagtgtgttactgggagcctggaacatgttacaaggaggaagttactaactctgagaaatagccctgaggacttaaaatctgtcaccagatttggcaacacagaaatcactgatgttgttaatattgtcaggttcactgaagagatagggggcaacagcctgggaagatacagaagagaaaaattggagataatgggcattcaaaactttttgaatcactttgctgtaaaggaactgatagaaatcaggatggaaggtaactagtagcacagatggaattgagtgtgtgtttgtgtgtgtgtgtgtgtgtgtgtctatatatatatatatatatatatatatatatatacacattggaaaaaataacagcattttgaacatagaaacatagatgaaggcaggtggggagatatgatgttcagagatgctgttttctcagagaaagaagcagagtcaataagaaaataaacatgaaaaagttattattagaaatttcagaaaaagcaaagttgaaaaagtgtcatttaggttagacctaaaaccataaaaaccctagaagaaaacctaggcattaccattcaggacaggcatgggcaaggacttcatgtctaaaacaccaaaagcaatggcaacaaaagacaaaattgacaaatgggatctaattaaactaaagagtttctgcacagcaaaagaaactaccatcagagtgaacaggcaacctacaaaatgggaaaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagtcaaaaaacacatgaaaaaatgctcaccatcactggccatcagagaaatgcaaatcaaaaccacaatgagatatcatctcacaccagttagaatggcaatcattaaaaagtcaggaaacaacaggtgctggtgaggaagtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatttatgtttattgcagcattattcacaatagcaaagacttggaaccaacccaaatgtccaacaacaatatactggattaagaaaatgtggcacatatacaccatggaatactatgcagccataaaaaaggatgagtccatgtcctttgtagggacatggatgaaattggaaatcatcattctcagtaaactatcacaaggacaaaaaaccaaacaccgcatgttctcactcataggtgggaattgaacaatgagaacacatagacacaggaaggggaacatcacaccctggggactgttgtggggtggggggaggggggagggatagcattaggagatatacctaatgctaaatgatgagttatgggtgcagcacaccagcatggcacatgtatacatatgtaactaacctgcacattgtgcacatgtaccctaaaacttaaagtataataataataaaattttaaaaaaaagaaaaagtgtcgtttaggacatcagtcttcaaacatgtttgctcaatcatcccctaacagaaatttagcaactgtgcctcctcacacatctataaattaacatctaaaatttgttattctatgtttacctgaatgccaagtatggaatttctgatataatgtaaattttggcatatatcaaattgaatcataacatttttgctattctaccctcaccattttacatgaataaaaaaaacataaattcttctttaaaatagaaaatttatatttttttattttgcctaaattgtagttcctttttttataacacagaaaatatttttaaacttaaagccacttactgatcacctaacataattctctgcaataaatacacttaaatactttgattttaaaatgtgtagggctaggtatggtggctcatgcctgtaatgccagcactttgggagactcaggcagaaggattgcttgagcccaggaattcaagatcagcctgggcaacatagtgaaaccccatctctacacaaaatacaaatacaaataaaaattaactaggcatgatggtgagcatctgtagtcccagctactcaggaacctgaggcaggagaatcacttgggccccagggtttgagcctacagtgggctataattgtgccactgcactttagcctgggcaacacagtaagatcctgtttccaaaacaaaacaaaacaaaagtataatattataaggctccaattttaaaatgttcttttgtgtttgaattctcataaattattattaattgaaaatgttaaaaacacatattataaagtttaatgtttaaatatgaaagacaggaagtaaattttattggcaatatatagtataatgacaaagataagaagtgatattatgacttaattgagaactacttcacagatgacaatgcagtgttttgttgtattgtttggagacccaggagtttttataacttagagcaatgcacaataaaagaatttgggatgaatgaaagtgatgcatctcctccctcctccgcttctctcttttatttgaaggagataagcattttaaaatggatatgagaaaggtgaatcaactggattcttcaataggcaaatcatttttaggaaaggagctcttagaagttttaaattatccacaagcaatgtgtgatccgtgatttaattttggagtgaattaacaaaaaactataaagaagaagaatatttttggagacaattgcagaaaattgccaatatattagataatgctattatatcatgtgaaatttcttgggtgtaataatggtattggggttataataggagaaagtcctcatgagactttctgaagtcactgaagagagacactgaagactttaggagtgatagatcatattttctgctttgtagtatcaaatatgtcagcaaaatgtgttgaggaaagaaatagatgaggtaaatgtggcaaaacaatcataaatccacgtgaatgaaaggaatcaataacaatactttctgcatactctgtcagctttaatatacaagatcagagagtccaatgtttctaggctctaaccctctgggatagaatgggaaaattcaacatgtagaaataaaactgaaggaatatgctgagtaaatgtatagcatgggaggtcaatgttgttacatttatatgagtaaaaccagaagaatggtttaatatgctaaaaatgggagccaactttgaggcataaaaataaatctgagaagttggatatcctatgccacagaccacagtctactcttcttgagtatgacatgccccagagcaaataaagcagacacgagaggctctaaaatggctttagccctactgaagctccatctacctggaggaagggtttacaatttttttaagtcaacaatcagtaataaaaagttgtcataattaaaattcccaaataataaaggtcaacatatatgtcctaactcatgcttggttcttcatgcatatgagctgcttgccagcagtgccacctccctagagacaaccaaatgtttaactcaccaatgacaagtgtgacttcagaaataatcctcttactgatttttatttgtgataaattaaaatgataatagaagcaattgcaccaagcccacattttcagatcattttatgattatttgtggctcacgagatgcttctaaatttctaactgagaccagtgtcttccttttttatctttccaagattatttgtaaattactcctttctattaattgtctcttcattagggcaaagttttcttatacacttttggtatatgagttaacataggaacacataatagagacagaagtagaaaaagggtctcctgccttccccatgttagtctttaagtgacatccctatttcattgatgtcttttttttttttttttttttttttttggggcagagttttgctcttattgcccaggctggagtgcaatggtgcgatctcggctcactgccactgcagcctcccaggttcaagcgattctcctgtctcagcctcctgagtagctggcattacaggcacacgccaccacgtccagctaattttgtatttttagtagagacagggtttctccatgttgatcaggctggtctcgaactcctgacctcaggtgatctgcctgcctctgcctcccaaaatgctgggattacaggcatgagccaccacacctgaccctcatagttgtcttttttgatgttctgaaatataacctaagttctagttctaaagagtttccttcaccttccatgagcactgctcagtttccttttccataatttttcctttcccaggcctttcaattaaattggtttggaaaagacacagacaaggaggagggcacagtatcccaaatgctgataacaaaccaaaaaccttaagggctgctgttctgcaaatttacagagttggcatggtgcaagaaagcaagctgtagtctgtcacagatttttttctcaaatttagtttgaaataattttagatgtataaaagagttacaaagatactacaaagagttctcatatactctttactcagcttcacctactgtttgcatcacacataatcatggtacatctatcaaataaattaaaattaatgaaaaactacagactgtcttcagatttttcaatttctactaatattactctgttccaggatccaattcaggatacagatgaaatgttgtatttcatcaggtctccttagtctcatctaatttgtgacaatttctcagtctttccttgtctttcatgatcttcacaggtttgaagagtactggtcacataatctgtaaaatgtccctcagtttggatttttctggtattttttcatgattactcatgattacactgtgaatttttggaagagcagcacagagaggatgtgtccttcttattgtatcctttcagggaatacagccatggggattttatttaacttattaatttatttattcattatttatttatttatttattgagacggagtctcactctgtcacccaggcttgagtgcagtggcgtgatctcggctcactgcaacctccacctcccaggttcaagtgattctcttgcctcagcctcccaagtagctgggattacaggcacacaccaccatgcttggataatttttgtatattttgtagagacggggtttcactatgttggccaggctagtctcgaactactgaccttgtgatccccctgccttggcctcccaaattgctgggattagagacgtgagccaccgtgcccggcatcatggggattgtaaaatgcatgtttcccattgagaaagtgaggtaaagaaaagaactgtgcatcaagcaatagaaaaaaaatcaatattctgtttttactggcacttttggcctgctggccataagccaatactataaactagcaggtagggtgctgcaagaatgtcaatacttctgccacattaatctttgcaggcttgccgcccctgcagttaactcatggagcatcctttgccaggacatacatctgcctctgtaccatgcccctgtaatgtgtcttcaaagggtgcaccattccacatctgttctctatcttttatgaccaaccactacaaaaactagagagaatccccaactgtttgttttctttcgttccagttaagaaaattgatgataatctcaaaaaaggggctattaactcttattatctctttcattttatcttcttcctctcttttaccctacatctgagcagggggccatggttagaagcaatgccttcaggaagtacgcactctttcccaaattaattctcatcatggaggtataggatcagctaataataattatatttttgaggaacagagaaagaggacaaaggggagaggagtcaccacttataatccctaccaggatagctttgtactgtgctaaacactttttgtcagatcccatttaaatctgagatgcctataaggtaagtatcattttctctatttgactgatgagaagagtggacttcagtagaatttaaaaaattcttcaaggttagctggttagtaaatgagtagagaccacaggtcatagtattttctctctccctcacctggaagaataaatcattcataccacctcagtatgggttaaagccagacatcttgtcagtgcttcctaaaaaaaaaagaaagaaagaaaagaaagaaattgtttttcatatgagattctgtgtctgggtccctgatgatttcctatgcctaagtatctacttgataatctctccaaaacgccactcttccaacactctgtgttgctattttcagtcctctccaggaactcttaaactaaaggacatgacccccatgcactgacaactacttcagccacctcaactctgaccagtccctcaaagcaggaagccatctgttgttattttcaccactaacaaatattcacggcctcatgttttcccggcacatagtgaacacgcacttatcttccccctttgaaactaggtgtggccatattcaaatcaaaatcctgccctttggtagttataagacacacaaaaaaactgaggcaggtattagagttagaattctagtctctctggcccaaactctgacctcataaccactgcaagataccctccctatcctatagagcctagtactacactaccccctcccaactttagcctccacatatagtaaagtgcttggaacacaaaaaacacttcataaattgtgctgaatgaaatcatttccatgagtgtttatggattttgagttcatttgtaccttttacctaaaattctagccactttaatttggagagtttccagagcaaagggcacagatcccaggcataacaacgctttgcgtatacagcaaccaatatcttgtcaacccaagaaagttcctccattgatacctagtagaaatagcccagtttttaaagtcctcaaaactgtaacaaattacttgtttttaaaatttaacttaaattaatacaatcagatttttgtgttatttgggtattagagtatgttaaagcacatatatcccagagacatagagtttccgtttcaaaaagtcatgcattcatgtgtgctaatgacaatcctatcctgacccgctatgtgacttgtatctctaaaccataggctttcctgaattttatctgttaatttaaccctgatttctcagcagcagcttctctttgtaaatagacttgcctcttctgtgtctgacctctgctcctcataatcagattaactcagataaagctgcttcagggaagaggtcaaaaccgttgccaaaaatagtagttgccctacttcagtctattttcaacagagtagccaggagatcctgttcacaccaaagtccaatcagccctactgttagcactctgctcacaagcctccagtggcttccgacctcactcacagtaaaagccaagtcatcctttagcctatgatgtcctacatgatttgaattcccttccattgatttttgtcactgatttttaaaaatccaaattcattctcatacagctgaattgtcctctttgctttaagtatgccaggattatttctacctcagggcctttgcacttgatattcccttcaccttttccaagatagttattccctcacctcagtcaagcctttatttagatgcccccttctcatcaaggcattctctgatctccttatttaaatgtatgacaccccttctttgctttacatttaatcagaacatgtatcactatctagcatataatacatttgcttgacctcttttgtttactgtctatgcctcctgaatactgtgtaagctccatgatacaggcacttttctctatttcgagcactgttgtattacagagccttaaaagtacctggcacttactagattaccaaaacacatttatcacacgactgaaaaagtaaatgaatagacacatcattattgatttttgcaaatgtttgaggcatgtattattattacccaataatgctagccagctaatacagctaattttatgtggtcatatttactaaaactttacacttttgttagaggtttatcattagtatttttattttcaaatgaagttttaaaaagaatatgctaaaggcagtattcttttcaaggtgaaagttggctcttaggcatatgtaatgctcctaacactgctattgtcaatttgttgctaagaaagatcaaaggagaaattgaaagccaaggatgcatagagctaggagatattaatgtggctttgaagaggaatatatccgagccctggcggtgggagagtttcataaaatagggcattttctctcagaaaaagggacgtgcagttttcggaacacttctctgttttccagtggaacaccatattttcacagaaaccatgccctgacctgatttataattttgagaaaatagttcaaatgcccttttctcattatgagaagatcatactgctgccaccacaagcatttcaccactgataattttaatactgactctcagagaaccaagtaagtagttgaacttaattccccagaaattattttgcaagaaaatttaccagcagttgctgcctacataaaaacgatatggaactgcaaacttgccatttaagaatcagccttttccctaaaacaaaggaaaattggttatagattaagaaacatttgtgcaatgtagaatcagttttcagttctggctgcatgtttacctgggaacttttgaaaatattagtatgtggtatttcatgtctatacttctcccacttccaaagatattctaatttagtgagtcttggtaggtcctagtaatcactatttttgacaagttcatccaaacgatttaatgtgcaactaactttaagggaaacatgtagtgggagaaaatgtatacaggcatatctgcctaatactcttcattgatgattcattcgttcatcctaaattacatcaagtacccactatgtgctaggaactgtgctaggggaaaaaggtgatggggtttagactgtagtctagaaaaaataacattgagcagaagagcagaaagtactactcaaatgttaataccactgctacattaatctcaacaacacactattgataatttctttccttttatcctcactcaagttaatctaatttatttgtaatcatttatctaaataatatctaagatctagtataactagtcatctataatctaatgcaacttgtaccactccactgcttccctgtttggaatgcctcctctaggacaaaacacaccctccatcaaaagccgtatgtctatggaaattttaagagagacagaggaagagaaagagaattcaacttcacttcaaaaccagacaaaaactctccacttcaaaaccttgcatatggattcttttctctagactaaacattcccacttcccataaataacacttctttctctctgatgagtcctttctgcctctccctcccactgccactgccctggtctggagttcctccgatgaggactgtggtaacaaccttctaactgatttttttaaatttttttatttttatttttatttttccttttagaagcttcaccctccaaatagtccttcactattccaagaatatctctgatatccagatctgctcatccacgctgtccaaaaaaacaaaacaaaaaacaaacaaacaaaaactctgtcaaatttccaccatccacatgataaagaccaaatggttttcccactgaccacatcataagaccaagtggtttagcatgacacacacagtcttctagaacttgactctggtcaaattctccagtgcagctctagctagccaagtctagatatacaggattactcatccttttgttattttgctaaaaaaaaaaaaaaagtttcattccatgaggaaataaaagaaaaaaaaaactttttagtcatttatgtaaatttttataaacttatagataaactgtgaattaaaatctagttttgtacagtaattaattatctctggtccctaataagttgagcacattgcttatttttctctagttataaattttatatttaaaaattgacctaaaagcctaaatagccatgtaaatgcatatgtataaacaaggcaaagctattttaagcagaatctacaatgtatgaaaaactggggcaaactaagtaatgcttagtcttaagactcattaaaaacaaaattctttttgttactgtagcatttaaaaaaatacaatttttaattgtatttgagcaaatacaattaagtacaattaaataaatttaatttgagcaaaacaatatatttaaaataagatgattaaagttagacagtgatatattggagacattattatttgttttgagatacttttatgtgcagctaatgagaaataattaaattataaagtaattataaataaattaggtatttcccatatatttaaaagtcttaatcaatgcaaaattctcttcctcataaattcttgaagctcagagataatggaactatggaaagaacaggcaatctatagaatgggataaaatttttgcaatctatccatctgacaaacggctaatatctagaatctacaaggaacttaaacaaatttacgagaaaaatcaaacaaccccatcaaaaagtgggcgaaagatatgaacagacacttctcaaaagaagatatttatatggccaacaagcatatgaaaaaaaagcttatcactggtcattagagaaatgcaaatcaaaaccacaatgagacaccatctcacaccagttagaatggcgatcattaaaaagtcaggaaacaacagatgctggagaggacatggagaaataggaatgcttttacactgttggtgggagtgtaaactagttcaaccattgtggaagacagtgtggtcattcctcaaggatctagaaataaaaataccatttgacccagcaatctcattactgggtatatactcaaagaattataaatcattctactataaggacacatgtacagctatgtttattgcaacactattctcaatagcaaagaattggaaccaacccaaatgcccatcagtgatagactggataaagaaaatgtggcacatatataccatggaatactatgcagccataaaaaaggatgagttcatatcctttgcagggacatggatgaagccggaaaccatcattctcagcaaactaacacaggaacagaaaaccaaacaccacatgttctcactcataagtgggagttgaacaatgagaacacatggacacaaggaggggaacatcacacaccgggccctgtcagggggtggggtgctaggggagggatagcattaggagaaatacctaatgtagataacgggttgatgcatgtagcagtggtacattcccacttccaaatatattctgatttagtgagtctttgtacgtcccagtaatcagtatttttgacaagttcctccgaatgatttaatgtgcaactaggtttaagagaaacatgcagcaaaccaccatggcacatgtatacctatgtaacaaacctgcacattctgcacatgtatcccagaacttaaagtataattaaaaaaaaaaaaaagaaagaaaagggaagaaagggccaaactactcaaaagaatgctgaaaataagaggttcagttgaatatgttgaaagtaatggtagaggggctgttaatgcttcatcttggcaaagacatagaaaatcttggtgattaatcaaaaggtcagaatccgttactctatttcctttccaagtgttttccccaggatggtttttgtttggtgttttattgagctcttgcttcctctgcaagtgagcctaatctatatgcagctctggagcaatgtctagcaattgattgttattttctggactctggctgcaggcttgtccatgaaagttggaaggtctaccacaaaattgcaagtggaggctcagtgctgaccccttctttttcctccacctctgttccacacaatgagttccctcttgtacatgtgtatgccctgagccacatgtaccagcttctcaactacaagcagtctccttttggctctatggtcctaaggatacatatgtcagagatgaggtttgcagacaaaggaggaggcccattcagtccttagaaataggctcagagcattggattagggattttcagggttcctggtacatgcagatggtgtagaagaggtaatgggatactgaattggatctagattcttggcctcaggaacatctgttctagtggtaaggaatgagaccaaaagaagaccagagcagggctgaagcacagagcatccgacagggttgcctcgattttctcacgtccctgatgtacagtaagcatttagtaccaataagtcatttagcagctgctgtatcatgaaaatgtttccatgctggtggaaggaaccagaatgaggatgtcagaagttatctgcaaagttacattaggcttatacaatattttttgtactcatatttctacaaagacctcagttataacttttattatttgcttatgcctatcattccattagaatacttcttttctttcttgtctgcctgaaaattttgcaagttttctttaaaagcccaggtcaaacttatactctgtatgaaactttccccaatcttccatcagcagaattaacttatgtttagatagcactttatacataactctaacttaacactgccacacagcattacatttaggtatatgtattttctctattagaatataaattcactgaacacatgatatttgctcattctttctttaccccaaaccaaatacagtatttggtatatacaaaggatacaactaacttttgatgaattgaattaaacacatatgttaagtttcctattcctacactgttttgtttatctttttcttgaaactaacttttgtcaagatcttttgtggaaaatgtgacagaatattctaggtattatgtaaccaggatggtctaaagtaggcaaattatctttattgattcagccaatcatttggaaacctttatttctgcaaagggccagatagtaaataatttaggcttttctgactatacagtctctttcctgccactcaactctgatgttatagcacaaaagcaacacagataatatgtatacagcaggcatggctgtgttccagtaaaactttatttacaaaaacaggtagcaggccagatgtggccctgatctataccagcacttcttaaacatggttacacaagagaataagtcctaatgctttaaagcatccaattacacactaacttccctcatacacatacagaatggtgatagttatgtactatcttaagagaattgagaaaatagttattcaaatagtatttttttttctatggttcagatgagcaatgctggctgacagaaatgcttatctagacactagacttccattcatagataagcctaagactatatgatatttttaacacaagctatcattggttcatattgattttctttccagacaaatccgcttaggtcttttatacttcagttgttttattatatctaaatggaaactgcatatttatcattattaattcttttcttgttggttttataaagaaaatctcccatttcttccataataaagcagtatttttttcaatctatatcttatgagcttgaaattgtatatatacaactaaaatccagaacataattattattaaaatgtctgagaaattgtttttaattgagttttatatgtacctcctaagtgactttttgtatccaatactccatccaagctctgtagatgttatcaaggcccaaaacttgaactctcaattagctcctctcttttattttttattcagtttgttagaaaagtttgttggatttatttttccaaacacatccagcatataaccactagcaaccatgctggtctgagtcatctttatctttcctctcaattactgtagtaacctaactgatctttgcttctgtccctgtctcctttagtctacgctaggcatactgctagaggagtccttttaaaacataaaacatatttgtctctcctttgttcaaaacccaaagagtaatcagttttagatggagaaaaatttatgagaaacgggagagacctgtccaatgtcacatagactggtaggtctgggcactagagcacaaacatctatcattgaatctgaaaccctatcacataaccaaaagtttctaaatgtaaattcatgtgctatttgttttcttagtattagacatttaaaaaaaataataccaaagagtatctactcctacttctgacataaataagtgctaagttccttagatctcaattctagtagtcacattgtattaaacttcagggtggggcattaactttattataggtacgcaatatataaatatatgtatgcttcttcatctctgaaataaagtttatagtataaatactatattcctcgtgtattatctgcaaggatcaaatgagataacatttatggtaagagctttgtggggccgggcacggtgggtcacgcctgtaatcccagcactttgggaggccgaggtgggtggatcacctgaggtcgggaggtcgagaccagcctgaccaacatagagaaaccccgtttctaccaaaaatacaaaattagcctggtatggtggcacatgcttgtaatcccagctattcgggaggctgaggcaggagaatcacttgaacccaggaggcggaagttgtggtgagccaagatcatgccattgcactccagcctggacaacaagagcaaaattccacctcaaaaaaaaaaaaaaaaaaaaaaaagctttgtaaaacttaaagaattataaatagcaagagtttactttctttttttttctctctttttaaaatttatttattattattatactttaagttttagggtacatgtgcacaatgtgcaggttagttacatatgtatacatgtgccttgctggtgcgctgcatccactaactcatcatctagcattaggtatatctcccgatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttacacatgcacacgtatgtttattgtggcattattcacaatagcaaagacttggaaccaacccaaatgtccaacaacgatagactggattaagaaaatgtggcacatatacaccatggactactatgcagccataaaaaatgatgagttcatgtcctttgtagggacatggatgaaactggaaatcatcattctcagtaaactatcgcaagagtttactttcacaggtatttaaagaatagaaataacgttacttcattgggatccaaaccaaagcagaaccttttgtccaattattatcagtgagatgtttgtttagatgtgtagatggtgaaactctagattatgccccttctcagtggctcacagacttccaaatattacacagaaattagaaaatggtaagagaaagaaggttttccattttagccatcatcttgatgacaaaagaccttcaaattttattattgaaagattcctatttcatcctcctctaacttttggactaaaagttgagaccagggtgaaataccaggtatagagcccaagtgaacaagcttttatttgcaggcatttatatagggtcttttctctgtcccaaggagattaggggccttggtgcccttgaaatctctgtcttcttcacccatattttcttgcttcaggaaaatacttcgaggtcttgcttctgaacctgctcactccacctaaccttttttttttttttgctcttgattcctgacttcctctgtggactcaaactatataaagtctgtccccatctcaaagttgtggatcacctctactcacttctacaaccatatatgctttctgtggacctagaacaggttggaattctgggaatctagcttgaacaagaaaggaacttggacgtcatctttaaagaaaatgttctcctttttccctgaatacaaaggactcagcatcattttggtgagaactcaaccttgcctttcttcatcagaagtaaaaagtgaatgtttttgaaagttcagaaccattctatgctatctgttagatgttaaaggcaactggaatttagaagaggagaaaagaacacacaccaaagataaaagcaacctcaccactccaactgcttaatttcctatgcttcacgttttggtttcttcagttggcaggttccaaaagttatctttacacatattcaaaatgtcaattgtatttcagaatccaaaaaattaatattttccaaacagctattatatatatttattatatatcaatattttccaagcagctattatatatatttccttaataacatatatacaaataaacagatgaggcaggcagatgcatacaaatgtgtgtgtttctgtatgtgtgtgtgagctccaatcacacttcccacaggaaccatacatttctcatgagctcctgtaatttgaactttaccaaacttgtcttcatactaacttttccaattaatcacatagaaactcaaactcgttttacatttgaatctggtaattgtgtaatctttatcagcagagcaaaaagctgaaataaattttaaaacaggtatatacaatatcatatctagaatgtattaattacttaggtatgagacactattcaaagctctttacagattttatttctttaattctaaagacaacatcatgagataggttctatgattgtaccaattttagcaacaacaaaggagatatggaaagtcacaaatgtgtgtggcaggcatagcaggaatttaaacagatgataaccctgagttaagaataacccgtggaatttctgatttgtgggtggaagaagaattctcactcttaactgttttttaaaaaattaatatagtgatgtactagttttgtatagtcatcataaaagaaaaaaatcttcaaagaaattgctattacaaacaaaatattcatgactaacaagcataaaaataaggccatgtctgaaatcatgttcacccacatgaaacattaaactcagaatcagccagggaggctgatgtgcaactaattagaaaacattctaattagttttctttatagttttccttgtttttcatctttatcctttccttaatcttcaaatggcagctgggtagatgtggtgaagttacatacacaacaataatttaccaggaaaaggaaagccatgttcaataagattttcattgcaagatacataacaaaaaaatctgttaattttcaagcaaagcaatgaaagctgaacactccctagcatacagagatgattctgaaaaatattgggtcaattttgtgaccatttttgacccatatctgggcattttccaatagtgtcaagagacatcatttacatttgaaaatgcgtatacaaaggaaaaaagaaacctctcaccactgccaacagacactttgtgatgggtgtgtcaattagcacaaacttttggaaaattattaagaaaataatacatcttcaaggaaaacattataagaaaataattagaaatgaacatcaagatttataaacaataatatccataggtaaaattgattaaaatgtaatttataatcatgcaaatttggataacataggaaaatatttcaaataatagtacatttttaaaaaggactgtacaggattatatctaccagtagatttcaaatacacaaaaatatattcaaagttgcatcaagctatttcctctatactgtaggttctgtgaggggaaaaacgaaaaacaaccctgatgtttactttcatacctttggcatctacatcagtatatggaacataatcaatgctcggtacaaaaaagaaagttaaatgatgaatgaatacatgtatttcccttcatatatattcaatatatgcctggtaagcagtcctttaagaacccaacatttccaagtcctgagctgattgtctaactgaatagaccaaacatttctacaggaagcagacagtgtctattcaaagaaagagtcctttcttctactcttagttttgctaaattgggcagtagaatgtttctgtttgttaatttgaaaaaaaaaaagataatagtctaacaactttttaggtttcttgtgcagtttatgtgacacaaggcatgaaaaacatttagcatataaacacatagcactaaataaatcagaggtgcagttactccagtaaacggaatctctcaaggcctatagagatgtattgtgtgattttctttttctgcctgcttttaagtttttttctgtagtgtccgtcaatgtcagcatgttagctaacaatgtgtttaatacttagcagatgctgtcttatcatcccttacttaaagtcccttaacggctccctaatgccttcattacaaaatctaaacacctcatgctgacacaaaacatacctgatgtcctggtcggcctctggctctcccttcccatctcccactgctatctcttatgtacctgcagccaaaacaaattacttacattctctgagcattctaccttctaaactttgtgatgctggacccagcctaaaatggaatttttctttaatctaaattctaatcttcctttaaagttaactcattagtttttattgcacttaaaaataattttagcttttctcaaaaatgtttaatttctaaactttttattgcttatttttatttcaaaatatttggggttcaggtggtttttggttacatggatgagttctctggtggtgatttctgagattttggtgcacctgtcattcgagcaatatactgtatactcaatatgtagtcttttttccctcactcccctcccattcttccccacaagtcccaaaagttcattacctcattcttatgcttttacagcctcatagcttagcttccacttataaataaatgagaacaaaatattgtatttggttttccattcctgatttacttcacttagaataatcaccttcagcttcatccaaattgtagcaaaagacattattttgttcctttttatgcctgagtagtattccatggtgttaagtaaaaagcttctgaacagaaaaataaataatcagcagagtaaacagacaacccactgggtaggagaaaatatttacaaactacgcatctgacaaaggaataatatccagaattgacacagaactcaaccaaatcagcaaggaaaataataataatcccatcaaaaagtgggcaaaggacatgaatagacaattttcaatagaagatatacaaatggccaacaaacatggaaaaatgctcaacatcactaattatcagggaaacgcaaagttaaaccacaatgagataccaacttattcttgcagggatgtacataatttaaaaagtcaaaaaacaatatatgttggcatggatgtggtgaaaagggaacacttttacactgctggtgggaatgtaaactagtacaaccactatggaaaacagtatggaaattccacagaaaactaaaagtagaactaccatttgatccagcaaccccactactgggtatctacccaaaggaaaataagtcattatacgaaaaagaaacatgcacctgcaagtttacagcagcaaaattcacaattgcaaagatatggaaccaacctaagttcccatcaacccagtggttaactttttattttgaaaggattttagatttatagaagagctataaagatagtacacagagttcacatgtacctttcatcctctttcctctaatgttgacatcttatggtatgttcaccatactaagaaattaatatttgtgtaacagtttacttttatttttaaaaatgattttatgtagttttaaaaatctatgccacttgaaattggtcaacaatatataataaagatagaacaatcaggcatacataggtgggtaacctttctctgaagatcattgtcataagaatgttttctctatattttccattagcaaattatgaagtgaatccagatttgtcatctatgacatttaaatggcaataaattagcagcctgatttataaatgattttcctctcagtgccagaattaaactgcattgctctacaaaaatgaacaagcaaagaaaccacaaagtcatattcaagtatttgttttttatctttttgtttacccatatgattatttcttgaattaatactacatgagcagattgatttggaattgttacaacagacaaaaaatcttttatctctgcctcactagaacttccagaatttaattaaaatttattcattgattctgccctcttctatcccagtcaagttccccccctgaacaaatacagtatatagggtcagtgcaatgagcagaattgctcagaaaatgtcctctctcctattaaccttacccacatgtgaacatctactgatgttagcatttaaaacaccttatctttcttttattctaaaagaaaattaatttaagtaataagtaaaattcagaattaaggtcttcactgttacattctatcatagtgcaattcacatattaagttgctaaataatgacaacacctgtaacttttcttctgtaatcatctgagcaaatgaattaactgtaagttaagttactttattttgacacttctaagagtgctttttttaaaattaggattttcatacatgtaactttaggacatttttggaggtatgcactgtcttatactgtatccacatgcaagtaaactcacttactaaggctgaaattagaaataaaacagtttaaggaaatttggtatgcttaaatcatgcaattctgatacaactaaatgatactttttttgacacatatgaccattcaaaataattacttttatacaatgataaagttgatgtctgttttaaaaattaaatatactaaattatcctgcatgggctacctttattccttgtttaaatccactgtgctttccttgatacaagattggtagaaataaattaactcatttattattctatgacattttatcatttaagctgtcacttatgcttttattatagagaagaatctctggtggattcttagagactttcttcttatccacttttttgcattccttaagtgttgttttctgctattatattcaatctttaagatcatatacagctaaaataaatttaatgagagagaaagtatgtgtttctattactggcattgccgtgaattttatatcactggtttgctttggtatttttacactgaaaaatgaagatacataaaatcatcataataaaaaacaaactgccaattaaaattatactttatttataatgaacagtatttgagaggtgctgaagtaactaatgctaattcaagtaatggggggtacaaggttacccctttctttcctaccagctacatgtaccaaagagtaaatcaaaagaaacctttcctgtaggatagaaagcgtgctgtgtttctgaaatcttgaagattacccaacatagatgtaaacacactctggtaaatgcaaataacatacaaatctaaaagcatattatttatattgataaatatgctgtgtttacacaaattaataaaaatgtaaatagcaaaaattctaaagattttgctacaattattttagctttatcatcaatttctctttctgacttgggtttggatttagctgctcttcaactactctgatggccagtctaggctactgaagactatcacttgctttattcatcagcttagatgcttatactacaccttctcagtgagtgtcatctggatgttttaaagtcaactcaaattcaatgtcttcaaaacttacctcccccacattttctctttttgaatattgtttgataaacactggattatttaacaattctatttttcaaatcagaaatctgggagtcattctacattcatttttctcatgagtacatccagtatatcaccaaagcctaaaacttctaccccaaatagatttctagagtctcactcttttctctcttttctcacatttgatcatctcttaccaaaactctttcttgaatttccactataccagcacatcatatacttggaaagaccttaaactcccagcatgccaaatttttttttttgtatctcatggtttaaatggttttaaagatattatattttttccacatggattgtgggaattaaggaaaagatgttctccaaatttataattcttatatagcttttctatttggggaagagtagaagagtggaaaagcatattggatttgtttcagatagattagttttatcatttctaagttcaaataatgtctttatgcttgtttaaagttggccaagttattgtaactaccaggagatagattctacttatttgtaagaggaggataattcttcctgaaagagttcttgttgagattaaatcagatgtaatatataatgttcctgtcttcatttatcaactcttctatccacttagctttcagttaccagacatttccaattataatttgatatataaaataaaatttcactttgttgttatgggttgagttgtgtcctctgccaaatatgtcgaagtcctaaccctagtactttaaagtttgaacctatttggaaatagggtctttgcagacgttaaaaataagtgatttggttgggtcctaacccaatatgactgtgtccttataagcaggagaaatttggacagagacaaacacatacacaggaagacaatatgaagacacagggagaggtcatctacaacacaaggaatctgaggcaatcaaaagttcaaagaatggaccagattcttgcaaagagccttcagaaggaactaaccctgcaaacaccttgattttagacttttagcatccagactgtgagataacaaatttctgttgtgtaagccacagtggtacattcttatggcagcctcagccaactaataaaattgttttattatgttttatataaatgtgcccattcttatgttaacttttttggaaggttaactaaggaaagatctgaaccagaaacacagataacttgtcatatcacttagtgaagtaccccaggaaactaggcaattcatgaaagatgttgataatcttagacatgaaaccaagaggaaaatatgtttaatgaattgctctcgcattctgcagaaccaaagagaaggcttcatgattaaaagacaagtaaaataaaatatgcagcatttttccttaaccccacattgtagcttttttttttttttttttggctgttttgcattgttcagagctctagtagaagacaacagaatccactcaaactagtgggaaatttgtcacacatgttaaatgtcttaccgaatcactggtagggatgattaaatagactttaagccaaacatttagtaactaatcctaaagctacccggcagaacaaggatccaggagaattactgtctcttccaaagttaggaagtcaccagcttcagttctccaccactactgcaacgatgaggaaggatatgtagctgtagcagctccagaaacccagcatgtcttctacagcctgcaccagtgaaaatcattccacacacttctcaagatcctcaaagttgctgacgaggtgccgagacctcggctaatgctgccaagaaacactccacatgcctttgactgtgcttgttggcagatagaacaggagcgactgaaatacggctatctgagaaaggttaagattgactgaacctccatcacattgagaacactagttgcaagagaatcttgaagatgtagattgtagctttccatattctgcaattcttcaaggaccattaaaaggagattggtatggtgttgagcaccaagccactatactcaccaaataacacagaaacgttggttagttatgaaactctcttagttacctgatgcagcctcgactttaggaattcttactattcattaccacatacaagctattagcctttctctttcctgaaaacatacagttttgaggctgctactctcaggtgacactgcctgctacctttccttgtaataatttacaaatgccccagattggcctgtcgtggggtggggggagggataccattaggagatacacctaatgtaaatgatgagttaatgggtgcagcacaccaacatggcacatgtatacatatgcaacaaacttgcacgttgtgcacatgtaccctagaacttaaagtataataaaacaaacaaacaaaaaacaaaacatacacacaaaaaatgccccagatttacttccttaaagattttaacacctggatcatggccaatttcactattccagtcaaaattcttgatgatccaataccaacatggaaggatattgaccatctcttttacaatgacttgatcctgaatcatatctcagccatctactttcaaggtcatatctatgtcctgctaataacaacaagtacaccccaattccataatctcaaccttaaacatctcattctctatctactagttttctctatttccaatgcttttactccctcaaatagccaagattcagtaattcttcaaagctaggagtaccaaatccactgcagatcactcctccacgctttctcatgttctcacctccctagctattcatcttagatagtacaacccatcatggtaagcactttcttactgacaccttcacctttctaagcatttagctattcatcttagatagtacaacccatcatggtaagcactttcttactgacaccttcacctttctaagcatttctttctcttccacagaactccctacaaactttccctgccttatcattttttataatatctatctatctattaatagttgcctcttttcctacttggccataatttccacaagggcaaagactcttctgtttattgctattgtctcagatggtgaaactgtggctagtatgtaataagagctcaataaatatttactgagtaaattaatgacataatattttaggttaactagaatattgtccgtcaggttaaagctgctcaaatattttactgaataaatgagtcatatagaataaaccctaagataaaacaaacctttaaagcctatttgatctactcattgaaggtagaatgaaaaatcaattgtgtaaagccaatgatatacaaaataaacaaatgtattctattctttttgtcatataacatactttgaaacttttcttccctttttaaaaacttttcctcctaaatctcctaccttttaaatggaaattacctcaattaaagcaacaatatgattttcaaagattaaaaatatatgagataactaattgaataaactcttacattggtccattaaaataactataggttatattaatattgtgctggaactgattatcttcaaattgattctattctcctcaatctgtctttaaggaaggatattaaaagacttgaaaatacttaaagactaattttaatgctgtctttcagcagtcacaatgtagttcccaaattattaattacatcaggtaaatcaaccatgacaagctattaataggaaatggagaagaaaattacattagtaaaaactatttaaactgattatctaattatagagagacccacattacataagcatgcaataggacagcctataggggtacagttagtcgcaggtctgtatctttgactgtttacagtgatgtcgcttccgctactataatgaaccattaagtgacctacaatatatcaaatggcatggaatcgtgtacttaaagaaatgtctcaagaccttgtttaactaacatgctcctaaaaccttcacagcatttagctatagaagcaaacaacacaaattgctattcagaacttataataacgaagaaagattaattttaaaatggacttttcagtttatatacagtcccccgttatccatggaggaatacattccaagatccccagtaaatgtctgaaaacaggtagtaccaaattttatatatgtctttccctgtatatatgtacatgtaataaagtttaatttgtaaattagacacagtaggagattaacaaaaataaaataggacaattataacaacatactctaataaaagttatgtggatgtggtctctctctcaaaaattatcttactgcactgttttcacacttctccttgtgatgatgtgagatgatataatgtctatgtgataagatggaatgaggtaaaagatgtaggcatttaacactgggttacttggcccttctgacaatatgtcagaagaaggatcatctgctttaggtgattctggatcactgatctatcatgatgttgatggctggatgtcaggagtagatgatgttgatgcctaacgcgcaggtagtgcagacagcatggatatgctggatatggggaggattcatgtctcaggcagaacgaagcaggttggcatgagatttcatcacactactctgaatggtgggtagcaacttaaaacttataaactgtttatttctggaattttccatttaatatttttgagccgtacaactgaccttaggtaaccgaaaccacaatactgaactgaaagtgaaactatgaatatgtggggactactgtacttgtaactcacaaagtatgcaataaacacttgttctttccttccttcactttgattctttcttcttttcttcttcgtttcttcttttgacatatattacttgtcacctactacatgtcaggtgctttgacatgtctggcagaatagtacataacaagacagacaaggtgactgagatctgaaggataggaagtagtcagttaagacaacagctgagaggaagagggtcaggaggtggtgaccacccttcctgagagcatccccacacacttctgttggtaagaaatgcatggtatattctaggagccagggtgctgaacacagaatcagtgacagtgcatgtgtcaagaggagagagagagtaagtaggcaggatttataccatgcagtgcctggtagcccaggaagagggtttgttcctattagaactgcaatgggaaatcattatagcagatttttttagggggggtgaggaagggaggtgtcatatgatataaacattgtaaaacataatagcagaaatgtctatttatatgttgctctattttgtatatagtgctagggaatcatataattccaaaaattatgccatgtttttacaaaagtgaggtcctaaatattcacaaaagaatgactagactataactcaatgattagagtcaatggaatacaatgcattcttgactgtttctagaaatttcaggaatcacgagaaaaaaaaaaaaagtgcggtgtaaagatcgctaccaaaagatcaaggtgagttttgagccttctgcatgccctctttaacagcccctcacaaatgcagtttaaaatagtaactgtcgtgagtgataacttgacgtatttatcatctaattgagctggtgatggtttattctgatatttactaaacacttattctttggaaacgattcatctgcaatgtatcatccacagtggtaagtacagtgtacatatgcagtaagtgcaatatactaacattttcttatttgagaacaattttgaaaagtaatgtcatccaaaggaacagtgtttgaagtattcatagccttttgttaaaatcgttgcccagcactttgggacgccgaggcgggcagatcacgaggtcaggagatcgagaccatcctggctaacaaggatctctaataaaatacaaaaaaaaaaaaaaaaaaaatagccaggcatggtggcgggcgcctgtagtcccagctactccggaggctgaggcaggagaatggcgtgaacacgggaggcggagcttgcagtgagctgagatcgcgccgctgcactccagcctgggcgacagagcaactccatctcacaaaaaaaaaaaaaaaaattattgcacattttttgtaaaaatctatgatcttgtattatgaaactaaattgcatccaggactgctcaattttgtttataaagtttacattgtagattgttacataaaggattaatttttgcaattgttctttttccaaccaaacatgatcataaaatgcatttacctattggaataaagatgaatcaaataaaatatttgaaataagtcattgtacatatacttgttccataatagctttttgaaagtattaaatctatagatgtgaaagaagcaaaaatataaaaaatctgaaactggacaacaaacattcattatgcaagatatttaaagctagctattgaattgcttcaaaataatttgttgtaggctactgttttcttcttgattccactgcctacaccttaacagggaataaataaatactctcctatgtgtacaaacaccttctttttagaaatattaaccatctactgtggattttatagatacactacaatataaggaaagttggatgcaactacatatgtcttgcatgatcagaaaaatatgatatattaaaagaatattctttctgaagattcactctctgaaaaaaaaagttctaaaagggcttatacagagcgatttaaatacaaaaatttgaatcaatcagcactacatctctgtaagtatacaataggaaaatttctgaatgagaaattacacatgctttctgtcatcaggctcctgctagctcagtgctataattcatcctacactgctgcaaatatatctttataaaaattacagcactactactaatattttgtgcttcatttcaccaaattttaacctaatcacttccctgccgtccaaatttttcctcagaagcccttttccatgacaaataactcttatctaccttgattcttcacagaacggtttttctccagcttgctttgactgcaaaaactttatttagagtgcatcactgtcctatgatcctcactcacagagacaatattgtgtattggttaaggtagtggtagcttctgtaacaaataaatcctgaaatctcaatagaggtttttctaattagtggactgggggaattttctccccacattcactcaaggacccaggctgatggaggttctgccatctttaacatgctgcttctagtttgctcaaaggatcaacactcatctatcagaggattacatgagattgtttttttggccaggccagaaacctatgtatgctaatcttgccactatttcattggcgataaatctgtcatgtggctgctcctgacagaaagggaggatgggatatacattatagccaagtgcccagcaagaaagaagaagagttttgctaaatagctaaatagtctctcacagtcccacagacttcacatatactaggcacaggagtttgttagcatttttctagttagtaaatagttccttattcctaggacacttgtacaaactacatcttccttagaattgaccaccccctatattcttatccctgtgagatgttttaatcttcacatggttgacccattccaaaacgtatcttcctaattaaaaacacaaaagtatttcaacataaatgttctttactgtctacctcttctgctagtcatattcaaggacatgcatgcacctcacttagcacatttttgtcattagaacacttgaattattattaattattgaatactccatcctttttttcatctacatgcctctgggaaatattatttcattaaataatagaaccctctaataaaatcttcactaaactacccttctcattcctgggggtggtatctgtacactgtgctgccaaaaaaacctagagcttacctctacaatgtgaggaacgcttagaacacgaaaattttctactaacttaacaagacctaagactaaacttttccacccatacttcttgctaaactcaaattaacccaccaatagctgctaaaccttggtcacagtcttgctttttttacatctactaccatggttaatgaaacatcagtttgcccataccttccaaaaatataaacaatgaaaaattcttagaacaaaactgaacctttagaactttggaccatctaattacctagatgcctttccctcctttatctgtcttacaaaagttctcttattttccactaccatacttacatgttacacattgtatgatgcctctgctgcccccagcaaagctgtgggagtgactacctccatcttgttttcaaaggaagtcatgaagaacatcagtgcccaggaagagaactgccatgagggtggggtcacttcagacagtccccactgagtcaatgcccagtggagccatagggttggttctaccctcaagaccttagactggtagagcaaccagagttctattccagcacagaagagctctggtgtgggccgcacccagcaaaaccaagcagggatgcctggagccctggagcccatttgcccagtaaagctgagaagatggagcctctaccccactgtgtccacaaggagacctctgccccagtgggcctcaagggcagacaactgagtcaaagaagattcttccacaacatttatgttttggacttgttcaggacctatcatttatttcttctttcctatttctttattttccagtgggaatgtctttccttgcctgtcccaccattatattttggaagcacataatttgttttatttcactggttcacaactggacaaaaatttgcctcagaatgaattgtatcttgagtctcatccatatctgatttagataatatttagatgagatgtgaactttagacttctaagttgatattagaacaagttaatacttttggggtaattgaaatgaatgcattttacatttgagaaggacatgcctttttgggggatggggcagaatgaaatggtctaaatatatccccttaaaattcatatgttcaaaccctaacctccaaggtgatggcattaagaaatgaagcctttgtgaggtgatgagctgatgagggcaaatccttcatgaatgagattagtgtccttattaaagagtctgaaactcctcaccaattaaagctgccatatgaagttacagtgaaaagacaactatctatgaaacagaaactgagtccttactagacactgaatttgagggtgccttgatcttggattttcaagcatccaaactgtgagaaataaatttctgctgtctataagttacccagttcatggtattttgttataacaactcaaaaggattaagacacattccttaataattctctacccctttagatagagtcaatttggctcctgtgatggatagatcctatggacaaggtcaagacactggtattttttcctctggtgttcactttctatacattccctcttatgttacagaacttgtgatttgcccctcaccaaggtgaagaggtgaaaagatttttgcacatgtaatgaaggtcccaaatcacttgcctttgggttaatcaaaaggaatattattctagatgaggttgactaaaccaggtaaaagctcttttgaaaaaagatatgaagcaccctgcaggtaagggaaatattcctgctgaacttgaaggaaagtgtaggtaacccctaagagctgagggtctcagtactacaatcacagggcctaaattctagcagccaccctgtgagcttggaagagggctctgagctccagttgaggactcaaatctggcctctgaaactttgagcagaagactcacctagattgtgtctagatccctgaaccaaggaaactgtgataatgtgtgctgtcttaagttgctaaatgtgtggtgatttatttccaagcactggaaattaatgcagaacccttatatatgttctccttatattgtttactaactccattacaacactggacatgaaaaactgttgctcatcagtgactttcttcccagtgagattccaaattccacaaaggcaagaaccatatctcatttataaaattcagtaatcagaacatattttatttttggctagaataatatagatacacaacaaaattcttagaaattttcccactattctagtctaagtaatctagtcattggttaaaaaaaaatataaaattagaaaatcaaaaactccttattaaaaatccaggtctcaggtctcaatagcagacattgatgaatccttttttcctttccaagtacttagatattagactaggtatttagccttttacatgcacccctgtagtttaaggaaagccaattaatctcctaccttcagataactcttttagcttgagacagcattttttattcccctaatctcaaatgtcagcatagggatgtgatttcagtgaacctcttacttggaatgccagaaacagagtggtctttttcctgatagttgagaataagggtgcatgtggccctgattgctaatgcaggccaatttgtggctgtgagcttttgcctgtttggggatggaaataatatcatgaactgaagagcagggaaacacaatcaattgtgtttaatgacatgattgaagacctgtaccaccattgctgaatcctgccttatttctggatttgagtcaccagtaaatctctttactgtttaaagccagtattagctgggattctgttgctttaacatatagtcctaaatgaggccatttctaaaactatattatcaaagaatcactaggattggtataaagcaaacatttggtcattcaactaattatttacaggatgtcaaatagctgaatggacaactttgttaatacatcctcatattttatgattgtggaaatagaacactatgactttttagattaatgttgatttgtaaagatagaagcaacaaatttttaaaatatttaacatttttgcttagtatttatctctagctcctcaatacccagtggttctgagtaggtttagtttgcatatcattgatatctattttaattggtagatacagtcactcatatattagaattctcataacagatttgtacctatgcttctagctgaaggtatgacctaaaagttaaaatacagaattattctctgggagaatttaaattagcctttgatcagaacaaatagggtcacataataccaataccaagatggtgggaacttcacataattgtaaagtggtgatggcaaggaggattaattttgcaaaatccatgccaatgatacaataaaaatattcgtgtcttaatttagtcattttctttgccttcaagaattcagctaatcaatattttattttaataggtgtcagcactgtaaaagtaagacacagaaacagaccaagaaaccagcattgggcatctgatgcatcattacttttctttctttcctgaaccattcccaccatgccacaatttcaatcatcctaagaaaacatattattaatactctcatcttccattttctaacactaggtatttactcctactatatacaccccggggagctccattttatgcttctgtttagagtaaaattctttgaagaagttgtctcttcattgtattgacttccacttttcttagtctctttcaaagccttctgactaatcttagcaaggtccacatgaacacatcctcccctccccctactcaaatatatgcatagttccttctttacttccttttttgagttttatgtccaaatggaaccttctcaggcaagcctttcctcataccttcggtgttccctgctttatttttttctttagtgcttaatgcttatttaattacaatttattatatatttctgatggactgaattcttatgttccacccaaattcgtatgttggaactctatcacctaatgtgatggtattaggaggtggagtctttggaaggtaattagaattagatgatgtcatgagggtttagtgaccttacaggagtcctaagagagcctgcttcctgcttccatcatataaggacacaaggcaccacctatgaatgaaaatctgctgggctttcaccagacaccaaatctgctgacactttgatcttggacttcctagcttccagaattgtgagaaataaacttctgttgtttataagctactcggtttatggtattttgttgtagcagcctgaacgaactaagacaacatttataatcaccaccaatcactcctactagaatgtaagttccatgaaagagggttttttatttattctattaacctcattatttcagttcctagaatagtacctaccccttagcagatattcagtatttttttgaatgaatgagagagtgccattgatcaagtgagcaaaaattagggcagtcaccaacaatagacagaggatctgagggtacatcttgaagcagacagatcaattaagagaaatcaagaactcagatagtgatatgggtaacaagaattcagaagcgcaacaaaatgattaggtaaaatgcacagaattccatgttccagaatagaattaggtaaagtgtcagctttctactgaagaaaatatccgtacgcactttatatagtctagagactgaatttatttcaaacctggctgatttataagtggaatcaggcaaatataactaacttctaggtatgaggggaaataaaacaagttcctgacaacagaattggctttctattcaaattattgagtacatgtgttcatccctaagcagcaatgctttataattgtctatgaccacaaaatataatttaagttcacgaatttataaatatatttactaataaatacacagaaaaataacaccaatattagaaacaatctacaaatgtgttgtgaaaagcatttccatagcaacatcagaataattatcgctataatcagcagtagagaaaatgtgctaaagccaagctttatttttctcagaatcatgggactgcagtgctcacccacacaaccgaatcagcagcatgaaaaacaacagaaaattatattttatgtataaaagagtaattgagcactctacaattatatagaaatcaatgagtacaaaaaatagattaacagctatgaaaagagacaattatgacatttttagtgtcagtaaaatgtatcatattctaatatgagattatttttctaaaattaatgcactgtagctggagacccaattttagaagaagaaatgaaaactcatatcaaacatcttaatttgtaactcattaatgcaactagcatgacttcatctggaatcaagaaaggcacagtctctcagagtcaatgtgtcagagaaaagataaaactgacaaccctcaagagaattattcttattttaatggactacattaaacaaagaaaatactacaaaatatgtacttttctgtgttacataaagatataagccatgaagtataaaaacaaagtcatcatagatttctatagtcaatcaaaaagacacctgagtctatttgctaatattttatttactttttcagcatcaagtgataaagtaatgtcttaattttcttgaatttatatttttctgctattttcaatcttctatgagagaagaaaaacccaatccaatagtccaccaggaagaaataacctcccaaggagaatataagctgtatatttattccaagtaaatagagagagagagacacacacacacacacaaagagtggcgggggggcagtggaaagagagagagagagagagagagagattcatataccaggattgctccaggcactaaaaatacaaaggcaagcaaggccattttttgttcaatgtcagctgaatgcctttaaaaattgtaatttttcaatgggggttggctaactccagctcctccggttaaatacagctgactacttgttgcatggtccaggtgctaaatatgttttttacacttttaaattgtccagttggaggagaacaacacacacaggggctactggagggtagagggtgagaggtgagagaggataaagaaaaataactaatgggtactaggcttaataccttggtggtggaacaatctgtacaaaaaaaaccatggcacaagtttacctgtgtaacaaacctgcacatgtacccctgaacttaaaataaaagttttttaaaaaaatgatgtagaccaacacatacaatgctataaactaaaataagaagaaaaagaactttcaaagattatatgacatgaaaattatatcaaattcaactttcagcatccataaagatgttttattggaacacagccatgaccacccattccttcatgcattgtctgtcactgcctttgagccacaagagcagaggtgggtagctgacacagactctatgacctcccaaagctcaaaatatcaactgtctggctctttacagaaaattttgctaactactattgggttaagcaaagctttgacagatattcagaatacaaatgaacacaattttagtatcctgaaaatttggagcttcaagataggaagaaatttaaaaagaaggcagaattctgtcagaaggtgaatagaacttaaatactctctcctaagagccaaagaaatgcaagatccaatctaatgatgtaatagcctaggtcaggaatgtaagctttgtgaacagacctggagtttgtgaactgcaagatgcagtagagcaacttttaaaaaaattgttcaagtttattattttaaaagagggcgaagtgtggcaactggaatgaacagaaaaaccactcggaatgtccacagctattcaactcctgctcagccacaatctctagttgaaaagtcagcacatcagctgaagagggtacagtctccttagtagtacacagtaaatagtaagcctggataagcccagagaaaattgaggaggataaaaaagagaaaaaaaaaaacacattatataatatatgtgtttaaaaagaaatctctacatatttggaatattatgtatttgcaatgttttagacattctgtccttattagagatagaagtcaggctcgtgattgaaatttaaaatgatttagaattgtgactttaggcagaaatcttactatgtttgtatgcagtatttacataattaagaaaactcagatttcaatatattaagttatctgatttcccttttaattatctaagttgtttgacagacaacatcataataaattttttaatgtactcttaaacttttataaattcaagatgcaggaagtttcaattctttggtctgagttacaaaaataatttcaatgcaataacttgaattactttgcaaccagtttacttattcccagcgaatagaagccatgccagtaaatcaaattggcataaatagtacaaaatttattcatccaaaaataccaattaagtagttagttgtaatttgtctagaattcaatgtggcactacatattcgagatgaatgataatatccctgcccttcagaaaactaaagaatggtggaagagacagataattaaatcactagggtagaagtatgataatagtataaatggagtgtaccatgaaatcacacatgcagaaaaaaggaaacaaaacccaacatcaagagatcacagaggactttctgggtgaattaaagcttacgtggaatgctgaataaaaatgaagaatcccctaggctataaatagatcacatttagtcaacttacaaaggacaaaacaaaacaatcatgaggaagagaatgatgataattaataacgaataagtgataaggatgattgagatattggcatatgaggatatagcaagatacgagatagaacggaagacagggtctactgtaccaggaacattgtagaatatttaaaggatagattttcttctaaaggtaatgaggaggttttaaagattattttatttctttaaacaagagagcaacacaggtaaggtacccttgactggagaaggactggaggcaaagagatgaactcaaaggctttaataataatggtactggtaagaaataatgaggacagtagaatctgaaaatgagaaattcaaagagcaaggtttattaaatcacttgtggaaataattttgaattaatttgatattaattagaaaataagtataatggacacatttcttgataaatgagctgctcaattcctaaaaggtcagcatgatctcaatgcaatccatggctgcaaccccaaaccacaacctctggccacagttacttgaatcaaaaattgtctttggaaataaaagcagccgtgacatttgttatacagaaaacttttcactttggtggcctggctttaacagatgagcaaatccagtcaaattagagatttaaagattcccactagcaagctgtagactttgcagctggaagattatatacccttgggttgtggggtggacattttcagatttgtgcaagctgatgactaagtctatttgtagaaataggaggatagggcagagcagagagaaaaaaagaaagtgagatgaaaatcatatagtccctgagagactatcagagcagctcagctcccaaaatcttgccagttgccatgaggtcaagtagtcctttcactaccatccttggattttgtgaggcccttcaaagctttacaatttactgtctgttcttgatctagtttacatgggttccattgctcgcaaacaaaaggctctgggtagaaaatgcaaagaaccactaatgatatagataaaatactatacagttagaaatcttttactctacctacaaaagaaattttttagcttctccttgaatattttcagtgaccacatgcataactgtttctgattacaatctatcccatttgcagaatttagatatttgcagccaattctttttattatgattaaatttatcctgattcccattttatttttaaagcaagagctatgactcttatttgtttctttgttttcctcatgccataacctccttctcttaagcagagtgcctaaaaatgtttttaaaattattatttgcatttcccctctcaacatattaactgaagcagtttttcactgatagaataaaatcccctttatctcaaccaagaaggcatcttcatttaacaaatatcatttaatttttttttgttagtaatgtgtttcttatgtatttggtttttggccaaaatgcagctgacagtgcaactttgtatcataatgttggtgaggggcacttaactttctgagtaaagttttagagctcagtttcatatccagtgttaccaatatcttggtagaagaaagggatttaataaaatgaaatgtttaaccatgatggaaagggcattggataaaatgttcaaaatgcatttaggtattgaagtatataatggttacaaatgacatcacaacgttttaatataaaaggatgacatcacaatattttagtataaaaggatattctataaaggtactcacattctccaaagcttacttacgattgtataatttatcaaatttatgcatatatttttaaatagtttgtatattcaatgcctttcttatcctattctttaggcctaggttatttaaaaaagtacaacctagaagatctcaaatttatgccaaattaagtgctggtagattacactgagttacagactttctgcagtgattttccacaacttgaaattttccacctttgaaaattcgtgaattttggggggcagaaactgaatttggatgcaaaaattgctctgaataagaaatagttttatagttatgaatatgtgaacaatgaattagaacttatcaatgttataccaaaactcctctttgattgtaacggtttctaaattcacaaatctatctatctatctatctatctatctatctatctatctatctatatatctatctatctacatatatatatacacatttgtgtatatacaaatgtgtgtatatatatgataatttgtgaattatcaggatatatatatatttcctgaagtcactgtatcatcctagtaaatttgcacaataatatcatatttgtctttaaattatcactcccttgctagtttttttaccaaaataaaaaaacgaatgggtaaagaatatgtgacatatatacacaatagaatacaatttggccataaaaacatgaaatcctgtcatttacagcaacatggatggatatgtaggtcattaggttaagtgaaataagcaaggcacagaaagacaaatattgcatgttctcactcatatgtgtgagctaaaattttcctttcatggaggttgagagtagaatggtagttaccagaggctgggaagggtgtgtgtgtaaaaagagggagataaagagaggttgattaatgggtacaaacatagaggtagatagaaggaataagttctaaaagtccatagcagagtggggtgactattactatagtaaacaaaaatttatcatatatttcaaaatgttaacaactagaagagaggacttaaaacgttcccaccacataaaattgagaaattttcagggtgatggatatcctaaatgccctgattttattattacatgttctatgcatgtaacaaaatatcacaggtactccataaagatgtacaaatattatgtatcaggaaaaaatattttgaaactctattaatgcattttccctcttggaaattatactggtttctttttacttttcattcttttaaaaaagactataagggaccctaagcactaataatttactgttaaactttgagtttcaaatttaactcaaaaattcatagcaaggcactctttcaagagggagaaaaagaacttttctagaaacaacccaagcacacttgatatacatcaagaaccaaagctgagaagacagttcatgaagtcagaagtgagagcagataaagtaattgccacacaagaactctttcagaagtagaggagggaagcaagaagatgagaaaaaagagagtagtgctgatatgcaaatggcttgctccccagtcagtgttgaaattctagggagggagaagatggagtagtttgaaagattcaggttgattggagaaatggataattagggggaggtttcctgcttcccccagtacagtcccggcaagttctaacgtcttcagagaagttcccattttagcaggtgttatggccaccatgcaacaagaagatttcaaatatgtgaacaataaatttgaacttattgttatagcaaagatcttcttggattataatggtatatacatatatatgtctccatataggcaaaattgcctatattgggtgaaatgttgcctagttgagtagacatgagagcagcctcagatggtctggtacactacagcttggagtatgaaatgtgtagttgaaattttaagggcaatggacagcagagcatgcacaagaagttctgagaatgctggtggatttcaagaggactggattcaggaaaagagggttccggagtttgggaactcttgattattggcaaaggccagatctatagtcaccagcactggatttcagaacaacacttgaaagacaagatggtacccaccatatctcagtggacactaggtcatgatgctcaatatcctgaaaggcagaatctcactgtagcaggtgccatgagatcaggttgagacacctaaaatgaagaacatctaactcaataacacaaaaatacatacatttctctgtccttctagatactaccttggcaagggaggaaggaaaaaagttcctaaaacagaaccaccccacagcaaacacacacatacacacacacacacaaaactagtgagagtgtttcaaactaaaagagactgagatctcttttatgacacgtgttactttatatgaggaaatgaaagttcaggagcaagaagatattcatcatagaaaacaggaaaatttacaggaatgtattttcttttatttttagaaattgcatgaaaatttcacttgttataactataacttggcaaactccttcattcatgctgcctttgtggtaactgtatatatctaccttttctaaataaaaccagaatataacacaaggtaacatctaggaagaaagcattagcaaaccgtgctattagccacttcattaaatcaggcaggtcataaaaaacaagcaaagccacattttcaaatttgttcctcagattcattttcacacatcatcaaatctaagtcttcagtgaatatatgagtgttataaatatagtcagcatctcagcctgcaaagaatacactatgagaattaattaccaaagcacttaaaattcatcaaaatcacaacaaagctgacaactattatttacttccatatcagatcagttgaagattaatgtgaaacaagataaatgtatcatctgttctgaactacctacacagtaatcatctctggctcagtataatttccaaatttcactctaacatactcataaatacttaatattacatatagcctgtattttatctgaaacttttatggtgctttaccataaaaataatcgctttcaattatattttccaagccattcaaatgccacactaagaaatatcaacaaccttattttagataccaacgaaagacaagtattgtttccccaaatatctttattacagaaaattaaaaaaagaaaacttttccttaaagttccaaaattttaaattttatattgaaaaaaatcaatttattcaatttcccaaagggaaaccaaaaaaagtgaacagcaaattgactattgaagattaaccaattagtaataaatatatttattgagtttattgcagattattcaattaatatatacatgctatatatatatagcatgtaatatacatatatacacaaatatatatacataaacatatatatatatatatatatatagttttgaagaaaaatataaaataacttctccattagaaaattatctctgagatgtggtaaggagaagaggaaatgaagaattttttttttttaggttaacatgacatagctagaaaaacacgctatatttcaaatatagcagttaagactgatgggaaagtaaacattttttaaaattcatgataagttccccaccggttattgacaggtttatggttttacgttagtaaatattgatttattaagtatatactctttatagaatacaatacagccctaaagtctgagtggaaagcagaaggagaattacaaaagaaatgaaaaataagcatcttccaatgaagcacttaattatgtatgtatgttgtaggcaaaatgaaaaatttaatatggaacacttgtagagaaaccaggcaacagaagataattctttgatgtgtttaaagtttaaaaaaattctgctgggacaattatgtagtatatgaatttcagtatttagacatttgacttttcccattatctcacaaatcctccccactggcaatggagacaccatctccttatttcaacacttataagtaaaaaagagacataaataaaagaggagaaagagttaagggaggaagtgaacaaaaagaaagtatggccctaattataatcaaaggcatccaaaaaatacagaactgaaaaatcaattattccttactgtgtgcctttgccatgcaatgccaaataaaagaactgagtgtacttggattccctcttgcccttcacaccaatgttttgtggaccacttactcatctaacctaatacctgagatgcctcccttataactcttggtaaacttagatgttctctacagaccacgtattctaatgtcaacatgcctcaattagagtgcatatcaagacgtattttaagaatcccttcttcctattagactgttaatgagttcttcgttttaccaatttttccagggcctgacaccatgcctggcctgccccatgtctgacctctgcaaatgttcaatctgaacaaaagatgagctctaagggagaagagaactggctggctaaaaggaatctcaagatgtaacattttcttactgaatattccctagatcagtgccttccccgcaatcttttggggttaaatatttgattttgttcaggacactaacagtggatcaatctctcaaacgtagactcacattatccatgtttgcaatctgataataagcaaaagtcccaagaaatgaatagcaaacctcacagtatagtaggtgagagcacaattcttggattgaattgaatcaaatgttacccccactaggctgtaatgttagaaagttattatatcccaatgaacttgtttcctcccttgcaaaataagcataaaaatagtcacctcaatagttggttgtgaagattaaaaatgataaggtatggtgaatacatagcataattactgcatattgataataaagaacaaatgttgatattatcatgacaatattaaagaaaagaagttgtagatcttgatgatcaatccattcctccattacatgcatgttcatgggtgtcagacagtattcttaatacatggatatattattatataaaacataatggagtttaggttctagtgcagatagaaataaacaataaaaatacacaataaatatgttttatgtaacagagagaagatatatgctttggaaaatataatagaggatgttcgggaagattggaaatgctgaggatgagggaaggggtattgccattttaagttgggaagtcccagtaggtatcatagagaagatgctatttcaacaaagacttgaaagaagtgaacatgtggatatcaggagtaaaagtattttattatagaaaacagcaaatacaagggccctcaggtgtaatgtactgtctgttttgtggaacaggatgggggctggtgcagacaacatggagtgaactagggaaaacatagtatgaggtgaagtcagagcatgagtcgtgtccatgggtcattctaagaatgttggcttccatctggagtaagacaggtagtctggagggttctgagggcaataataacaaaaactgagttttagcatcactttggctgctgtgttgagaacagaccatagagcgaccagggtagaagtatggtttaggatatgtagttagaggactattgtaataatccagatgaaagatgatgctcagaccagggtggcagcaatagaggtggcgaaatgtggtcagatttctgtatgggttgtattgtgtgaaagagagaactcaaggatgatttcaagattttatactaatccactggaattgaattgttatcagttaagatggggaagactctgcggggagcagttgagagatgaagtccaagagttctgctttaagatacgtcaactgagatgcctattagaaatagaaatggagaggttgggtagacatttgcatatatgtgtctgaaggtcaggggagaaatctgggcaggaaatatacatttgagagccttggcctacaaaatgatatttaaagtcacgaggttgggtgacatttgatgagatcaccaaataaccaaggtctgcatttgcagtattccagtcttaggatgtctggagaggaaaagaagctagcaatgaaatttgagaagaaacaagcgatgtaggagtaaaacttgatgtggttttcccacaattagcatcaatagcatcataacagaccttgctagaaatgcaaacctcttaccccacccatgccataacgaatcagtggggcccagcaatttgtgttttagtaacttccaggtgattcttatgcatgctaaagtttaagaaccactgctgtagaggggcagtagaatttggggtaaaaattatgaattttaattaatctccttaaatgttaatacagtgtcactgaacctctttgaggaataactcaactagatacagaacgaagcagtccctcattgagctcaaactcaagcactccacctttagatgctaccacacttagattaatgttttcacacactctatatttcttattttctcattttccattgctgttaggtgtgattgcttagaataagttttattccctcaatttgatttcactaagttcaatttctttccattaaatctgattaaagaaactcaaatttaactaaggttttaaacatccaggcattattagcattccagaagaggggtttgtttatctgcaagaattcccacaatgtggaaaaacagagagagagaggagacagagagagagagaaagagaaagagagagaccaatagatatttgtgtttatagccaatttcaggcagattctgtacttctcaccaactcctgttctcttgccctatcaaagcaaacaaaccaaaataaaatgacagttaacaaggtaataaaaacaccaaaccagggaataaagaagtaaaccttttaaagtcttctttaatatttaaatagaaatatttatcataagacttagcaattaagaatggaaagagctatgttttatatcaattcaacaactgatttggggaaagtgatttaacctctcagagtttctgcatgtttaacgatacaaatgtgtacagaaagtaaatattccctgtaaacttaccacaaaggctgggcttggtctcttatatgggaaaatgctttgtcagctgaagaactaagcagagattaaattgatgttaaaataaatttttaaaatgtatctttcattaagggaagaaactttaggacagggagaatttatcaattttaaattttaaataaatgtagctctttaggagtttaaaaaatatttcaagggaagattgcatatatatagtcttgatatacattgttggcattgttttattgatacaaatggagtattcaaaacaaaaattcatatacttaaataattaagtatctatactcaaatattattgcagtttagaattctaagctattttggcctatttaaatgaaaataacatagagaagagtagaaaataaaatgacataccctatatctatcattaagatttaagaagtattttcctactgctatattatatttagatctctctttaggaagacaaatatgtcacaaaaacaattaaagttggtgcctccgcattccatttctctttatctctttccccaggggtgcctgctatcctgaaactggaatctattattcccatgcaaattcttgcacattatatacataggtagatactcataaacaacatatattatcattatgtatttaaacatttgcataaacaacttactttttaaacataacattaagttttaaaatttatcagtgttgatacatgttgttaaatagtcttctattataagaataaaactatttaggctgctacacagaatcagttaggctgtttccacatttttccccatattataaacagttcattggcaggcattttctttttttaatgagtgctattcaaatgaattcagctgtgggaaattgtttgtggctcattcacatctgacaattctgttcatgggctcctcctcaacagctgtccctactaatgcaagataattttatgtaaaattaatgtttccataagaaggcctcatgagaggagttgtcttctgtggtaggaagtcaagaaccaaaggaaaactataaactcaaagaagaaatatgcaacaaagtaaatcagttttggtgatttcccaggtgattttacaggttctatgccaatttggaaaatgcgttctcttcttttgttgaaaaataaaaaaatacttgtgaaaaaattgttactgctcaacaaatagttctctttcattatattaattagacaaattatgtctttaaagcaataaaaaaaaccctgctaatagttccttgaatatttggcatttttgtgatcagactgctggactaaaaagacttttatttcttgagttgtcttcctcaggagttgacttgttccaggctacaagtgaacaattctgaaaccactatacatgtatgatggaattgggtaattaagtaaatggtgactgatgctgggagccaggcttctcatattggagttggaagttacagacaagcaagctttgaagactagaatgattggtatattactggattagggttagaaacatcaggatgaactcatgttcagtttaatatagatgtagatggataccgcagtgagctgattggtgacttccaaaaaaaaaaaaatgtatctgttctaatccctggaacttacgaacattaccttatatggcaaaatatgtgatttaactaagaattttgagaagagtttattctggtgtacttgggtgggccttacatgcactcacatgtatcctttaagacagggcaagagagagctttgggacagatgagcaggcaatgagaccatgcaagctgagactggggtgagtgcagataccatggaatgcctaaagccacaggaggctgaaagaggcaaggactatattctcctctaggagccttgggaaaggagcatggctctgccagcacctcactttaggacttctggcttccagtctgtgacagaataaatttatatcgttttaagccactgattttgtggtaatttgttaccacagggcagacacaggaaacaaataaaatagatacgtagaagtttttataaatatgtgcatatacaagggttagaatgcacatatgtttactttgctccatctgctgagtgatcctagaagtaatgggaccccagtaacaaagataatgctgactaatataaccttaaagtttccctcagctggactaaattttaacagactttttcctgactctaggctcctgacctcttttctaaagcttttaccttagaaaatttgtgaatataaatatttctatgttcctttgagatataaatcttttaaacagcctctagccagctttatagccaggaatgtctttttcaggaatctggaagccattcttttgcaatgtaatcataaaatagtttcctcatctcccaggctctgggagaatgagcccccaacttcctagggcatgatggttcaagctataaaactaccttcagtcatgaagatcagagaaagtttacttttccattggataaggaaaattagaaaacaaaagtggcctaggattcccctatcccagctcttaaaatttcttccgccatttgttttaaggagaattaagctcagattaacttgtggcctctctccatgtctgcagttgccttgaatgaatcttccttttactgcttttactgtttaaatttgccaggcacagttttggctttgacaatacctagagcctagctgttggtttctaacaccattctccaataaaagaagttaaagatccacggagaaatagctgattctaggactgggttgggaaatatacaagacaagcctggaacattttgtagtgccagaagtgctaaaaacaacagcaacatagcaataaataaaccacacaccaacacacacataaacacacacaaaaaatgatggggtctgtcaaaaggacagcagtgaatagagctcctaatgaccaaagtgtgcaaattttgagcaacaaaaaaggcagaaataaagtagtattgtattacaacttaaaggataaaacaaatatccatgaatccataatcacataaataaatgatgatataagtaaataaatgtgaagaatatagaaatcttacaaaggtttgcagaattcaaaataatttatatggatactcttccttaagtaggtggagcataactccctactctttaaaggtggactgtcaatagtgactttctttcaaagacaaatggaagtggaatgagttcacagagtatggacgtgggcaggaaaaaaataactttatagtgaagaaacccgacaaacaattcctcagccaggtgatcaagattaaaatcaacagtgatatgtaatattgacagtatgtactcttcatatgatgtgatgttaatggcactttacctctgtggtcttcttccccaaacccataactctaatctgatcataagaaaaatatcagacaaatacaagttcagggatattcttcccaacacgtgactagtatacttcaaaactgtcaaggtcatcaaaaacaagcaaagtctgagaaacagccaagataaatattatgtggtatcctggaagagatctttgaacacaaaaaggaccttaggaaagagccaaagagatacgaataaagcttagactttagttaataaaaatatatcaacattgcttcattagttctgaccaatgtaccataccaatgtaagatgttaataacaggggagacttggtgagggtatatgctttctgtgctatcttcacaatttttctgtaaccctaaaagtattcttataaaagcttattaaaaaatagatctttatttttgagttgattttctcagcagataaagaaataaggtccaggtttcctacaagaatgttcattatcttccccagaactgatggttataatccccaagatgagaatgtgctcaggcagcatggtcttaatggagtgatagtgtacctcatgcccagtctccagagcagtttttatgcaaatgactattgccattaggatgaagaggagctgttctagctaatggggcagcccaacatacttccggcatagcttttgaatgtctctttgaacattcactttgtttataattatctgactgtacctaatttgattctacatgaaaatttatataattatgtaattattccattttaatgtaagactgaaacagactgttaccactattcttgagattccacagagaactgcatgcttttgctattaaaagaccactgttgaagtatttgaatattatctcttaggaactgatgaaatatagaggtttcaagcatttccatcagcacacaattattcacaacaaccttctagatgcttattttctatcttttcctatacaagctgcttccaaatcaccgtcattactactgaagaattcaaagtcctgagctcaaaagcaatcagaacccataaggtagcataattaatagtacaaaatttcagttaaatgcttaaatcatagcaaactacaaataatataacaccaaatagaatattattgtctcaatgaggtaatgactcatcaactaaaaccacctaagatagaactttttggtatctgctttctattggtacaacactttcattcttaatgtttcttatggcttcacaggttttagaaataaaacaatacattttcagccttccacagtaatcaacactttcaaaaactgagatacacatatgcatgctacactaacttacaatatacaagtatttggttatatattaactctcaaagaacacaactgtttactattccctttccacaattgttaacaggatgcactttctttaaatataaagtgaagaaaaatcagaaattttgcaaccaatattttccttcagttttctactttatcatcttctgataccaccataccctgaggcagttgttgttctcgggtcagagtttgacctgggcctcctctaagcagtaggatgattattccatgtgctagagtacaatggaggataagatggggggcgggtgccacatgtctaaaaagagtgctgctgatatactgctgccaaacaaatacccaatattcctccagttcccacaccagtccagaatcctggtccagaattttcatatgcttgtcctgcaaaaggacagtcaaaaatagaagttgcaccatggctagaattctgcagtcctgtgaatgcagaataaagactggcatcaggggtcctgctcagttggtgaatttctgacaacggtgggaaatgcacaatactcagaatatggtggcatagaatattgaccattgcttaggaacagtctataaactacaaggtagaagcaccacagtggtaatcaatccactgatgccacaggaatctgcagagtaccactaataaaaattatctgagaggccaggcgccatggctcatgcctgtaatcccagaactttgggaggccgaggcaggcggatcaccttaggtcagaagttcgagaccagcatggccaacatggtgaaacctgtctctaccaaaaatacaaaaattagccagaggtggtggcatgtgcctgtaatcccagctactcgggaggtcgaggcaggagaatcacttgaacctgggaggcagaggttgcagtgattcaagatcacgccactgcactccagcctgggcaacagagtgagactgtgtctcaaaaaaaaaaaaaaaaaaaaaaaattcatccgagaaagaggtaaagctgtggtgttttccagattctgaatttcttcaggccaagttccaagaccatacaacctaagttatattccaagccacaggaacctctttgtacacacaggtgttcaggggattcatagcatttacagcttaccactgtttttttctaaatttgtgtgcaatatctaaatcactctcacattcccatggggtctttccagcccagtgtagagcttgcaattactagaggcaaatgcaggctgtggtagtgcatgcttctgtgcagttacgccaggagctccagtaaaaggaaagtcacttctacactgttttaacatacatgaatttccccgccgtagaattaccatgtacatctaggataaatttattttatttaaaaacatttcggaaagtcccactaccaatcgcccaatttgtcaatataatataccccatctatcacacccacagagatcttaggtataagtaaaagcatctaatgaattcactatgcttggtcatgcctgaacatttacatattaaaatatgtgctatttattatgcattgactttctcttacctctttttttttttaacatttcagagaaactgggctttttaaaaatatttcttctttagatagatcatgttttttatgtgtttagatttaggaagtaaaagagcattggcttagaaagcaatggatttatggtaagtcgcagcagttgggcccagaaagtgtgaggaccactggtccagagaacttctgattctctacctgtcttcttctctaatagggaaagagttagcaggacgtcacttctcagttcctaatcatgccctaagcctggcagtgagaagcgtggcagatgctaggggtgggcgtactggaagggaaaagaaaataatattttccagtgcctagattttggtgttggcaggaaaattatttgcccgtgacaaactgcatttatcttttatggaaactgtgctcaatttatgaactacactcactttaaattaactagaaaccaaagttatattgtgtaaatttcagttgaattccaattttactaaccaaaactcctgttggttaattatacattttacataatattgaattcagataacaaaagtcgagcctcaatctctcaatctaaaacaaaattcagcacacttcactgtagggtaacaactgttaacttattgactaacttttttttctttccttttttttttctttttgagacagagttttgctcttgttgcccaggctggagtgcaatggcatgatctccactcaccgcaacctctgcctccctggttcaagcgattctcctgcctcaggttcctgagtagctgggattacaggcatgcgccactacacctgcctaattttgtatttttcgtggagacggggtttctccatgttggccaggctggtctcgaacttactgactaagttttaaatgaatcagtgctacatttaatttgaagaagtaacaaagagttagagaaaaaacaaagataactggggaattgggtgcaagtccaccataatctgttgacactctataaaaattccatgtgagtaatattttaaccagaaaaataggaataatgactgttctctagagcaaccataaccagtacctagaaaatatgtaataaacaaggaaatggactagaacactaatgtggttttctggcaaagaactatccttacttaaaaataatgagaagaatattcaaatacttactttcctttaaataatgaaaactttaattcatgactcccatagctgttgttaggatttatgagtgaagtcactaaactaacattcattgagcacatgctaggtactatagcaagtgctttgtatattgcatttcaatcagctttccaaataatggtatgaggttattgctactatatatcgtaatttccaagccaaaacttagaaaagatcagtaatttttccaaagtctatataatcaagaaacaccagagtaggagatagatcccaagattcgttgactccaaaggctatttttctaaactctaagctctatttactgcctatatagtaagaggggattagcagcaacattggaatttacacagggaaatacacggggaatgttcgatcatctaaggccttccaataatttttcttttttccaaaagaaagcaagagcaagtttattttctgttttaattaatatttcaaaaaaagccatcaagaagtctgcttgtttgaatttctaagttttcacatcaagattctgatttttaggtttgtccaaagctggagaataataaagtttgatatattcaaaacaatgttttcctttatatgtttttctagagatgggagtctcaatatgttacctagactgcacttaaactcctgtgctcaagcaatcctctcacctaagtctctcaagtaggtggaactatagacatgcaccatcccacctggcttaaattgggatatattaatgttagtcaatggttcatccataaatgaattttcaaaagcctcatttataatatttaaagcttgtatgtaaaaatgcacgtagccttcagaatttgacatatttcccaaattcaatgtagtgccagatgataaaaaaatccaaaagaatgcaacacaataagtatgttgaataaatgttaagcaaattttattttgcatttaaaaacatattctttttgcccatttggaatagacatcatgattttaaacaaagaaactgcaggtacttactatggaactatacaactaaatatgcaaagacaatatttgtgttatttcaaagctttcattggtaagctttttattagcaaaaatataaggaagcttagtttcctgcaagagaaataaatagtaaaaattaatgtctctgagccatagcttgcctccacacaagtagtgaatcatttctcccatctgtcccaacctgaatatatcccttagagatatctgcctttctgggaagagcgttggcatgtatatttattattactttcatttatatacagttctagctttgctgctatcttcctagagccttcagttcttctgtgatgttgagtaagagttatatgttttactggaaagatatcagtcactattattcataattagaaataaaatctttgaattgattagaagataattaatgtatattctaagaaaaaaatctacttttaagatacataatgatacacattagagacaccacaagaatggatagaacttttggtttctctaaaaatatgacctagatgtcaactagagtcttcctcattttgatagttaaataatactaactgctgtccccatatcatggcctatgggaagtctaatgcattcctctttgatgcttttaagtatacaggagttttcattcttgcaacaacctggtcgctccaatgttcttatctcactaaatccttgaatatgtcccattccattagacactctcaaaacatcactcacataaggcttttgtgtgcttatgaggtaagaaacaataatcatagatcaaatagtaatatgcataaacaatagcaatcagaatataaggcattcttattttaagattttcttttttagccatgttttctactcactggcaggtcattttgctgtctggctggtcattttcctgctggggtctctattctctctccacatccatatatcccaattaacatattatatgaagctatttttttaatctctatttcccctcgcttgactaaaccatccccaaataatttttatcttagcaaaaacaaaaacaaaaaactaagatttttaaggtatattccaaggcaaagatagctttctttctgaaaggaccctttaaatatcctattacaaaaacagtttagtctaaatattgtctttaatctcaaataaattgacgaattacttagcaggaggcactagagacttagagtaaatgacaaaaatctctgccctttcgaaactctgtctacctgggaaaatgtacaaatgaagaaggttacagacaatgcactaagtgttataatagagttgtatgggtttaaggagcagggaaaatctggggattagaggtctaggggctcacagattcacatagaaggaaacatctgagctaagactttcagaatgaataagaatttgctaggcacttgggaaattaaggcattccagatccagggaaaacatttgtcaaggcataacgataatttatttgaaaaaatagtaattggatatctttgacagggtatgtatagaagcgatgtgatccaattagacagaaggtaggggatttaagtgatatattttgaaggtctaagtaagacaggctgtggaagtaaacagtagaggatctgaaacagatttcctgttgggagtttggtttcaaggaactcaggtttctggctgaggcatctctgcagaacagcattaaaatatccaatggtgatttttagtttgacatttgatttatgctgatattgatgtgcataggggatgttgaggttagttctttagtagaactaatcaaaataaactcaaggtgccattaaaacagcaaaggcaaatatgtcaataaagatacaaggggaaatcatttaagggggaagaccagtggactaacgactgaactctggggggaaaatctatatttaatggctaaaaagaggaagaatctgagatgggaagaggtctcagaaggaaattggaagaaccaggtgatagcgctttcttagaatcctaatgaaagaattcaagaaggagggagttatcaatggtgataaatggtgcattatgatgcattgagatcaaataagagagtaaaaaatagttattgaatttggcaagtagaagaacagaaaagatagagaaagcaactttattggcatgactaggataaacacattacagtgagtggaaaatgatcaggctagaaatgtacgctcagaatttggtgttgctgccaacacatcaaggtcagacagcaggacttacttagcatgtagcagatgttcaataaagtttatggtataaatgaatgaaaagatgaatggcaaatgaaattctggggtgagccatatccaaaatgaaacatggactatatgttttactatcaggtgctgcattattaaatttagttaatttcattattttaccatactatcattttgaaaggaagctattctgtcattagaaagtacagtccaccttccatgtccaaacagataaaaaatattcaggaaaaaacaattaaaaataacaataaaacaatttaaaatacaaataaaaacaaagtgactatttacaaagcactcacattgcatgatttacatagtattcgcattgtattagatattataagcaatctagagatgatctaaagtatagtgaaggataagcatccatggattttggtttctgaggggtgaaataaaccccccatggatagcaaaggacaacagtaatctattcttgaaatcttatgtttttatagttacttatttgtgtactatcatatttacttctgagtgtgtgaaactgttattttagaagtgatttttgtattgtatatataaagtcttttcaaataagcatatttatgtatccttttacgacctccttaattacaatctctgttttattcactcattctcaaaaagaacaaggaaacaaggtgatactgtggaatcttattttttattagataactacaactggattaattactttaatttctctcttattcaagatgcttttaaattaaatgcctatactgaggcctagatgaatattctgaacacaaaaattctaagaaattatttcagtataaccaatttaaagaacttaattatttaacttacacaattttaatagataaaattaataattaatttaaaaacaatgtttatataatttcaataatatttatcactattatagtaaccaaaataatactatataataaccaaaattattgaactttagaaataaatggcaaaactactttataaggttaatcagaacctcagaaattatggattgaagaatcaacactattaaatatgtaagcatagaactctatgcaggaggagaaagtaagaaaaccttctggttaagtaaattatttcatattacattgtgtccccttctaagtgtaaactgcactgtgtaatatacacattttttttttcttgaacagacttagtcataacagttaattacagagacaggtatttactttgtaaatatagatgcaactaaattgaaagtattattctggaaccaatgtataggtttctgacttgccaaacatgttacaattgaaatgtcaagaaacagtaccttctagtatctaagttatcaatcatgatgactatatcaataaaaacttattatatgtttgaacaatataatgaaaaatatgaatcttttgttatttaatgtttggtggtttaaatatcaaaaattcatgtgtgtagctttccaaaatgataataattcaaataaacaactcagttcaattaatactctaaattcaatttttgactaaattttacataagtgaaaaagtagtttcctatttagaagatatgatcccattcacgctaaacagtaaagtagctttagtcatttttgatgatgtaggttacccagagaaactatattacagatctatgccacctacactcagtccatcgacaacgaaacaagtagttgtaatgtagcctattaaaaatcaaatgagtaattcacattttttccatataataaatagtaactgagtcctctgccattcactttgctcatcactgaggacacagaaatcaaagaccgatttttttttccccctaatgaaagagccacagttcatgtacagagtgtggtatgacaggaacacatggatacatgaaattccagagaagaagcattaatctcacgggctgagaggccagagaaggtatcttaggcgagctgtaatctgagctaaggtttgaagaatgaataggatttagccagataaataagggaaataaattgaagcattctaagcaaaggaaataaaaataggaaaaaaaaccaagaagcattagaatgtaactaactcaggaatacattaataattaaaactgtgcctgtaatattaatggtggtaaattgtatttttcaaagatggataccagaaaatatcctatctttgcatactcttttgaacgttagcttgtcctactcccatcaagatgaagactggacttcatttctttgaatcttagcaggccctgtgagcactttaacccatagcatgtggcagaagttggtagcataaaagacacaagcatagcacttcaattacctaacaacttctaccttctgcttcttgtagccctaatcctggacctcatgtaagaagttcaggaaccacaagactctgcggaagagaggagccatagaggagcactgagctgctagacatgtgagtgaagaaaccatccttgcttgacaccagcccatcaaagactttgcatgatgctagtcccatctgctttccaattggaactgcattgagagactttgggtgagaattatccaatcaactccctggtcagaaaaaatagtgataaggtggtgttttaagcctccatgttttggagtttttgtcaataacagtaaataactgagatataaagtgtctgttttgatggtgatgatggagtaggtggtaagagctggataagtgacttggaaccagattaagaatggttttcatggcatttaagattttggttttagttttaagggcaatgctatggcaaaaagaaattaattgatttaatacaacttttttttgctagaaatggggatttgatccaatttatactaaatatcacaatataaattaaaagaggtgagcactagaatgaggagactcagttgaagggtgcttcagtaattgaagtaaaaatgataagtctgaactaaaatggcaacagtaggaagaaggggatacaagtgatgtcaagatttacctaggagataaaatttgtaggacttgatcagttgtataggagagatataattttaggtacttaattagtaaaaagtgatggcaactcaaattttcctaagccaaagtgggatatgttttcaggataatggtgcttctcttggaactcaaagactgggatgtgtctgggtctcagggacaactggaactgggaaccgaaatgtcactttccactttttaactctgctcctacctaaatctttattttctttctctgtaccatggcttcttccaattttcttattataatggaggaacacatggcctccaaattgaccaagatttacatctaatagttttaagatccaacaaaatctactatctctttctcagatccaggaacaaaatgttcaagaaatcttctgatcagatatttgaaaagaattgattttaatttgctcatgtcctcaaagcaacaaggggagtttgaggtgtagtgaatagtttcttagaagaacaacgattgtattccaattaagggaacataattcttgatcttagatcaggtggacatttatagttctgggatttgaaatataaatgttttctgaactaaaaacgtatacagttatttcagcacaagaactgaaggctgttcagaaatgtataccaaagtttttcttgttcagtaccatgtgagatcatttcaaactctcagtaacagagatgagtcaaccttctaataagtattggtcttctctttctctaaagatagacatttttgggggaataggatctcagagtacagtttgtgatcaaatctcaaaaaagtttattgcatttacaacagcatttttcaaagagaacacctctaaatacgacacacagttttgtggtcacacgaatcctcaaagtgctatattttatgtctgccttcaaggtattcactatatagatgagaagattaaaagctctaagaaatctgtaaacacacacatgcttctaaaactagtattttctaatgtatttgacaacctttttaatagtctttctaatatcccatattatatgttgtaggaaattcatataaagtaatattgatttagatatctaagtccatgatttcaaaatggaaagtttttgtcccaatttaagacatatggtatgtaatatagcataagatataataatgtgtataaaacgtcttcactgatactcttagtcaaatgacattttattgatataactttaattaatgaatgatgttggcacattaatccttttctgtttcccagtagatattatgctttattattctgcaattcttgaaattgataatttataaatcttaacaggcacaattttcaaacagtgacagactttcatgaggagaaaagaaatatttagtcataggtttgtttaaattaatattttcaccatttgggatgacaaagcacaaaaaattacaatttctttttatagaggataagaataaaattagagcacaaatctgtaagtcagtaaattaatagagttgagatttttaaaacatctagtattttaatgcaatgaagagaagaaaacatacagaatcccacaactcatgtctgcagatcaataaaaaggtacagacttgatacatattactgctatgcttcttctgggtacttaaatatggctctaacaaaatataataggccactgtcaaattcagtgttttctgaaccttgtcgcccatcaggataattcagagtttttaaaaatagagacccttggggtttcatcctctaaattaagtgttagttgggatggaactaagaaatgtttatgtttaaaagcatctctggtgattctgacatcactggtctgtaactagccatgatatgtgggaaacactggactgggtgttcctggatcatttggctactatttccaaatactgtaaatactgtgtgttatattatatattccaacttttcaattatctttacttattcatcaaaatgaaatgttattaattagaccaatactttgaagtgatggtagcctaataatattccttgataaatgcacggtggtcattttaccaaaattaatcagatgaatacataaaagtttatggctgtcaattgaataatacttcttatcatgaataatgcaaatgggtttattggggtcctaacattttaaactacatacatgtcaaacttaattaactctgctttcataaccacctacagaatgtcttacccttttttcatgcacattagaagatgcaaaactctgaactgttttccacaaactaacataacatatattgataggacttaataggctatcttacaagtgaaggctaattgctaaaggtgagattaggtaagttgaaaagtggtgctggacatcaaacaagtgggaaaatttgtgcaagtttttaatcaatattttgataggttattatagttcaatatatctaccccctacattaacttccgtggttgtggagtattaaaaaaaaaatcaagcaaaactttatcagtgataatcaaccaatttaagagagaaattccacatatggcctaaaacctgggggctacccattgttgggatccttattactgaaattcaccatcaatctaatagaagctaaaatataagatgtacatgaggactgcacatctttcactttttgcacttatttgcatttttaatcagcaagaatgttgaaaattaatttttatttcaataaaaattcaatattagtttcaataaaagtcaagctgttaatttcttaactgctgaaaatattttttaaaatatttgtagaagtgatctaagttatcttgatgactggcatttttttttccctcaatgagaccatcagcagtaaaaggaggaattaaacaggaagtatttatcaggtctcattcttatatgcttttactgaagtgtatttctctccctgatcaatagctatgcattagagaggacagatatagatcttatatctacacacacacacacacacacacgtatacatatacataaaaatacagatattatacgtatgtataggtataataatataaagagtaatttctaaataaatatttgtctagaaatttgactgaactctgtgggtggagggacaagatcttttattcatcatgatattcccaaatcccagtttctgatagagtaaagactccccaaatccccatatcttaaatggatatttatatcctttctatagaggcatccaatttcaaacttactttggttaaaatccctgcatattttctttcccattgaccaaagtggagaagtatctttaaaactggtcaaccctagcaagctatttaatagctacagtgaatgctttcttactcaaagatctcatcattaaagctatcaattgttccaggaatcagcattatttcagcagttttcaccagctatctttaaaactagtctttgtataggtgaataggtatagaaatttcctttctctataatttaagctaattcataaaaatacactaagctaggtcattactcagagttaaatactttcagattataactgagccttctcaaattaaatggcatttagctcactaaatgtgtaatttacttaaaagtattaatagtcttgagagaattagtgcttatgctaaaatataattacaaactctctggccataaattatttttctaataccatctgagactcagaaaatgtgtgtaaaggcatgccatggcctaatctgggtagcacaattataggggattatctctggaattggtggtcctgtctcaaatctaccattataatagggaaagtaatgtttaaacagtttttgcattattcttgttattcttaagatactccatttatactcaaatcaccctaaaaagataagaatctatcaagtttatgaaataaaactttctgaattcccaggttgtggctcatttctcaaaggggatgtagatgactcattctgcctagtgtataaataatatcattgcataatgcccaattcttctagcaactaagttgaaatatatagagaatcatattcatgcttttccacattttctttgtacttctcaagttgtggagcttggacgtaagccagtacttagaatgaatggaagattgatcagtagttactgtgatctacatttctttatcctagggcaactatattttcatacacattacaatttgatacaagcttgctgacaataattagaaaattcaggcaatcaaaatacaaataaatcaataatagttacactacctggagagaacattcccgtgctttcacatggaatataggatggccctcgcacattggtggtagtggagacagcccatcccagtgtgatcacagagctgtagaacaatgcacatcaaagaagccaggacagcagaaggagttaacagtctctcaaaggatttgtttaggaggacttccaagatatctacagggacttgaaaaatacttgaagaggtggctatgtatttctgatcctgtaatggcaggtgtgggcagagctggtgaaaaagggattactactttctaatttccactctggctggagtggcctggggaagcacacactataatatatgttacgaatatgtgtgtttttccattctatatcacacaatggcattagtgtcatttctagaagagtgtattgtgtattcaaaaggccaaaatatagtcccttctaaactagaacaagtataatacttattctgataagttcttgaattacaatatatggctacttggctagcttaatctattttcttaaattcatttcagagttaatagccctgaaaattaagaaatctttgaaccatttgaaaaagacatactttgtgcaatagctgaaacaattttaaaacacacagagaaaatactacccttcatttatttaaaggagttaagaattgcttcaaggtactctaactgatagaaaatgtgggtaatatcagctaatcatatttcaacaataagagggttaaaggaccttgatgctcattattaaaaaggaatgtgggtgtggtagaaacagcgtgtgcatttgcacgtgtggatgcatgtgcatgcacgtgcatgtgtgtgtgtgcacatataatagttagcaaggatattataggacaataaaacatgacacaatattgtcattccagagttgttgtgtgttatgggtccttcaaaggactcaaattttattttgttgtattctattgggagaaaaataatttttattccaaagctaagttaatgttttcatgttgcataatcaaaatgatgactttgatctaatgagattttataagcacattaaaaattatacccttataattataaacgtaccattagaagactctttttcttagaaactccgttataaacttaagaatgggttcaattgctattgtgtcaaggatttctcaaaaacatcaaaaggaaaacttttttatatttaggtgagatcttgtaaacctctttgaaattataaatgcaagatacttattaagtgattttacatttcatttatttttcttacccaatgctttttacatgatgcttagttgtttttttttttgttgttgtttttttgcaatcttctgtctcatttcccccaacccaaataatttgacacacatcgtttcaaataaattaacatcctatctcagtggactcctttggccaaaatagaaagttcaaatcctaatttgtgggctgacacatgtggcctcctctatccaagatataacacgttattacactttgcactaacagacactgaagagctatgagccttctttcttattcttgtcttttaaactgaggtttgaattgacgtatacctgtgatcctgaataatacaggtactgtagactggaatgtaaaagagacaaaagtaaggtccaaatggtacagatactagaggtagtgtggtaaaggtgtttaaaatattatcaaaagtacgggcatgtctttaaaaaaacagaattgtggtggggggtatgtgtgtgtgtgtctgtgtgtatgtgtgtgtgtgagagagagagagagctagagagagagacagagagaacaggcaaaggagagaaagaacaaatcctaatttagctttagatgtagaactatatgtgaaaggtggaaggtaatcatatgtcattagttttacattcttacatgacctcaccatctgattgtttttatagaaatactagcagagtcatatgtgttttaaaaaagaactaggagaattcattaggatgacttacttctttcataaataaaaactggattgacttatttaataaatgtcctgtaagagcctatgtgtcaggcagaaaaccagactctctctcagagaatacttcttcagatcttaaaattttggtctaaatattttaactgagcttaaatgtgttcaaaaatttgcctttactgcctttcaacatcatgtaaccctagatttataaacacagaaaagcatggaatagaagaaaaaggtcgtatttggaatcgcagagatgtaagtctatttctcagctctagtacaggtgcctctgattctattaagatgggaataagttattaatgaacatacaagcttaaatttataaaatttagagaaataaatctatctgaaaacagctgataatttttaatctattgaaacttctgatcagggaagaatagatatcaacaaatcaccttttatgcaaaagactttctgcccacgttttaaatcaatgagctttgttcctaaatgaaaaactaattgtgtatgtatgtgtgtgtgtatttatatataatcttagctattttatgcaatgatttacataactcactaagtttaaaagtgtaatggcattccaaattttttcctatgattcatttaagataacagcatctatttctattgtagtttacatgagaagaaagaaagacccaggctgtgtatatgatatgagatggcaaagagcaaacttcatgaacagaatatgctgtctcctatgttccacctttcccttatgatattgcagcaaatttaatctcactagtttcagacataacatttcaattagcatagctaataatttagaaaaacaattttggaggctttttaatatgataggcaactatgatagtataagtaagaattagacacagttcatgcttcaaaaacttacaatctctcatgtgaagcaaatagaaatacagtaatgaattaatgaggtaagtgtagagattgtgatgtgccagggtaatacaggagggagtccccccccaaaaaaaacgttaagcaaatctgttggtatgttagaaaaactcctgtccaaagggctcatatagctatcttcctattacttcccctctctctgataaataaattttatattctctggagtgctgtctggggtaattttacaaatcactttttttaaattatagcatagggttcagatggaattagtaacagacgcaagctgccaacttcggtttcttatgtgaaagccacttgttctcaaagggtctccactttctaggcttgcttggtttttgttttctgagtctggttcaaactttaccatatgttcttaaaaaaattaactgcttaagagttgatttatcttgtctgcattgaatagcttattatctttaaccatgcatctacctggagtattcttttgatgaagttttaccaaacaaaattctaactagactttcttttaaccttaacaaatacttcatgttcacatttatgttttgctaatgtcagaaaacaggtatcatcaaagataaaaatcatttaataagttaatattgacagtacttcttttattctaaagttttgttgtctcttaaaaagataggcctttatgtttttcagatctagttttataggtctgtaacagattgtctgttgctaagcattccagaaaaagaaatgtaacttagagggtacaaaaagaaaattataaaatccagtgaaagaaacataaaaattgaatacatctaaaagtagtaagttataagaagaataaattatgctactttaagccaagggttaattgtcttgatgttctttgaatataaaattataattatagccaaaaataattaggccagtacataaaatgaaaataattctgaaaatggtaccctattatatttactgccaagtgtttatttttattctacagatagtcacagagaaaacactattaggggaaaacattgaaaacttatatagttagaactgaagatgataggtaaataagtttcactgaggaatatttcaagaacatgtaggcattttgtaagagagtatgttgaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaaaaaaaaaaaaaaagagagagtatgttgaatgtacaataactacttacagtgaatatttccaataggataatataacattcattctttcaggatattaggcaaggaaagatattcttgcaagtcattgccaatgtcaatagacaacgaacattgtctaaacagagatgtcatggccctcattttttgtctttctttttgaggagtgaatgtctccatcttgtcctcttttctatatatatgttcttcttgtttttaaattatctttcctaagaaacttcactacatattcctgcccaagtatatcagtttgtctatgtcattgcttctgtcttttatctcctctggtttgtgactccactacttagtctgggtccccctttcttctggcatctccactagatcctgagcctgaacttcaaacattatacactattgacagcacttaaggatttactaacacgtgcttttcatacatgtacaacctctgttctactgtcttagatttctcttttccacaattacccttcttaaagaggtagtccaacttcactgtttccacttgcttttcaagtggaaaagcttgtggaacttgcttgtggaaaaacgtgtttactccatactcattgcaatctggtttcctttttagtgaattaaatccaaaatcctcttcttagttcacatctaatcttttaaatatatgacataatatgtgacataatatgactcaagaacaacccctctactcagcatggaggtctgttgagaaaacagactacagctcaccagaagaaatcaacacacgctgttaaaatcagctaattgaactgctttactctaaatataaatgacttaaatcttagcatctatgatgatacactagtcagtcgttattcattaatttgtgtatttaaaagatataaagccattatcatgcagcaggcatcattacagatgctaagttataaagctgagaatcatatggtcccagcatttgtgaggggaaaaagtacacaaataattgtaataaaatgtgttatgctataatagagatatttgccattgcagtatggtatcatagaagatgagtcacttacaaaaaacctttaatacatatcattgtgtccaagtatataaaaacaataaaaaagtattcaacataaatctttttatttaaaagggaataaaaaattggcttctaaagatttttgtgtgaatgacatcaaacatcacacactcattttgcaaaatagacataagtatgaaaaacaattattttgaatgtattattaattctgataaacattgtacatagaaatcattcatcttcattgaacattcatgacattgatcattcaaatagcacttcaaaagcagagcatttgaaatgagaaaatttacagaactatagatttttcaagctgaaggaaagaaacttagagactatttggtccacactcatcattttacaaagaaggaattgatgctctgggagacacttgcacacaaattctctgaagcataactgaaatagaagcgagcctgctctactgctagtgacctttctaccaaaatgcaaactgaccaaaataggttgtctgtacagtgaactgctattaaggatggagttcttttgttggttttgaggtttccggagttggctgcttaatatgattaggcccaaaaatgctaaggactctacttccaatagtatgtagaacactgatagtccttggtgtgaactgtttagagagttatgcaaaataaatgcatttaacattcctgattcactgcttgtgagaggcaagcagtttactgaccctatacctaatacctttgaccatatgcggagaaccaaggaacataatgaagctggttggttgtttctaagttcagtggacaaagtgatgaaagaaaatgatgtactcagggatgctaactcccggcttcaaaagcagatactgagcctcaaatctgctaagactgccctgagtgagagtcttatcctctctgtagagaaagagttgaaattgtggaaaaacagacacaagctcttatcatacaagtggctgacctgcaaggaaaggtgcatgcacaacctcaccagctgtctactgttaaagtgagggcattgattggaaaagaataggaccctgcaactcggaatggggatgtgtgggaggaccctgataaagctggagatactgagtttataaactctgatgaaccttttttgccagaagaaacagcttacccatccccagtagtggtaacatcccctccccgatccatgctgccatcagcctctccacctttgtctgaggagataaaccctgtgctgcctgaggcaacagtgatgacctcccctgaggcagttgccaggcaagataatgttgattctcctcaggagccacccccaacactcctgtttgcttctagacctataactagactggcctagcctcccagcctacatctttctcccgtgctggatgcttcctgccctcgaatatcagactccaagttcttcagttttgggactcggactggctctccttgttcctcagcctgcagatggcctattgtgggaccttgtgatcatgtgagttaataataaactcctgtctatctatctacctatctatctgtctatcatctacctaattcgttctgtccctctacagaacactaactaatacaactgcatacactcctttctgaaagtatttacaatagcctgagaaaaatattttaatgaggactgtgtgtgttttgccaccacttcattttctccaattataaaattatagaccaactcctaaacacagtgttaaactcccaggaatcctcaaatagatattacttaacataactgagattgtgttgccctaagaaattaataaggaaatcaaatgcctagaaacagctttcatatcttataaaaattacaagctctgccccccaaaaatgtcatgggtaatgccacaaatattttctttatctgtcatctgatcacttcattttaggacaaatctataactatttactttcctttgtaataattacttgccagaggcagaccagaatttgatgtattcaaacctgtcacatatgtatatttacagggaaagcacatcttctctgtgggagagaattaggttttaaagttagttcataaggcaaaagtcaatgtattcaaaaccaccctggatggtccctcagggaagcaccagtctgaagatcaaatactgagtcccactatgctcactccaggcatttttcttcagagttagaatatatcactcctcctaggcaagaggacccagtaaatgacctgccctgccataagggctttgtcttatgaaaagtacatgtacgttttggccgggcacggtggctcatgcctgtaatcccagcactttgggaggctgaggcaggtagagcatgaggtcaagagatcgagaccatcctggccaacatggtaaaaccccatctgtactaagaaaatacaaaaatcagctaggcttggtggtgggtgcctgtagtcccagatactcgggaggttgaggcagaagaatcacttgaagccgggaggcggaggttgcagtgggccaagattgtgccactacactccagcctagcagcctggtgacacagtgagactccaactcaaaaaaaaaaaaaaaaaaaaaagaaaagaaaagaaaaaaagaaaagtacatgtactttttaatgtatgaaaagtgtctttatcaactaggattacattcagcattagagagtgctcacttcaagagaaggacacatttttcaagtttccgtattcacattctcttagggggatatacactcattgcaatggattcctgtaagatttcagtggttatttgtgtcccatatttttgttgttgtagaacatgtgtgactgtatttatacaagatacatgtgcaactgatgccattccacttactacatacactttctcatatatctatgtttatacactgacatagatgtatatcagtactcaactgtacatacgtgtgtactgtaagaaatgttttatggtataagtttgtttcaggaaacaactgcatgttgtaagaataaaattataatagtaatgcagtttataaaatatgtaattgttgtataataatttgtctgatctttttccctccctgggagaaactttctttttcttgagactgagtggcgctctgtcgcccaggctagagtgcagtggcgcaatctcggctcactgcaagctctgcctcccgggattcacgccattttcctgcctcggcctcccgagtagctgggaccacaggcacccaccaccatgcctggctaatttcttttgtatttttagtagagatggggtttcaccgtgttagccaggatggtctcgatctcctgacctcgtgatccacctgcctcggcttcccaaagtgctgggattacaggcgtgatccactgcgcccggccaggagagactttctagacccttataattgataggagtgtttttattattaatacctgattttgtgctaataaaatgacttatgctgggcctttagatagttttagaataagagatggtcatgtcaaaaatatgaagcatgtgattagtggatttggggctttgatccatgtaatatttgactaaactcctgactccagtgagaggaggggtctacagattgagtccaatcacttggccaatgattcacctaatcatacctgcatgataaaactccagtgaaaactttggacacctgaagtgaacttcctggttgatgatatgcactgatgtgctgggagtgtgatacatcctgataacaaagaagcttcaaatttgggaccctcccattccagggcttatgtgtctcttcatttggctggtcctgatttgtgtcctttctactgaaactgtaattgaaaatatagcactttcctgaattctatgagttgttctagtgaattattgaacctcggtggaaaatgtaaaccttcacatttatagacacttgatcagaaatgtaggtggcctggcaacctcagagctttcaactggtgtttgaagtgagcatagtcttgtggatgcctgtgtccttaacctgtaaagtctgcactaattccaggtagtgatagaattgcattgcagtaatcatgttcctaatctgactaacactaggtttaaatgaacagattaagttgtttgtttaatatgcaattcatgtaaacttcctcaagaagctgtacccactagggggtggataaaacattaatttaatccaatctgataatttaaacagtttcttgagataaaggacttccatatctcctgctctggctactctctgagatgacagtgcagggtacaggtcatatataaactcatgaaaaaggacaagagtcagaggcctagaatgtgctatcttttgcctcttctgtcaccaaggcactgtcccttgtttgtctgatggtgggtctcctttcttgtattcaaacatttgtctggggttaatataacttgggatctctgttgaagcctggtcgccattgccagttagactttccttagctaagcccctagctctatagagcttcctgaatgggtggccggccctccacctttactgctgggttaagttgctttttcccatggctggcccaattgcaggccttcaggcactcaaatctgcagctttcagcgtgtcctctcagggagatttgatctgagaactcataagtctttccatcctacaggggatacaagggagtgtcttgtctcatatacagaacaagaatgcatgatgagaaaccatccctccaccttgatatgcctttctttttatcaaatacgtcttacatcagcttcatgcctggccttccttttcttccattccccatcttgatggagaggaatagactctctaccctattctctacagcgttactcagtgtcagaggtcaaaaactacatggtataatggggaaattaaaacaattcagattaatttcttcaaaatggtatcttttgttaaataaagataaatattcatatttatatatttaaagaattaaaacatgtatgtggccaaaatagaaaatcactgttttgataaaaatatattagatattgttctacttttcttcataatggtattcaaataggacagctaaagacaaaacagtatttaaactatttaatttagttatcaacatgcattcattttgaatcatgatttttaaataatattgctgaaaatttaaagtagtgtggttggtgagaatcatagcttctttctatgtgttcatatttcattgaataatagagttgctttttttatctttaacaaataaaaacatgatcaatacctagcattagatttcttacaatttgaagaaactttataccatattggttctgctgtacaaatgagagataaaattgctattttaagatgagaattgtacgtaacttttatcttccctaacaaaaagtaatgtgcatttactccacaacgatttgaaagtgtgaataaaaagtgaaataatctaaactccgactactccaacaaaaaagcctttagcttccaatacgtaaaatcactgaatcctatggttcagagaaacaaaactagttgctaatatctttccaggtatacttgcagatttttcaaaatgcattcattgaaaaacatttataacaataatattacactgtagaggaatattgtgtcctatattttaaatttaacaccaaataataaacaaaattagaatattaaacaagtttggaacattgtcattgtggaattaggaaagaactatataataataccaatagcttctacttactggcacttaatcaatacaaggatactgcaaagagctttatttatatatgctaaaattttatttaatacacaaaatataggaagtaagtgctattattgttccttttactgatttttttatagataggttagaaatgattatgtcaaccatccaaggttacaaagctggtaataggcagtgagggcatttgaactctaaactatccacaatttaaaccccaagtttgataactgagagaatgagccatacctataagctctttctccctgtttccaaatctagacacaggctagccagttatcctgaattatttcaaaacccagcaaagcaagtgttcactcttttcccttccccttattttccaacctatgctcattactacttcctatttctcaaatatatgatggctaaccatatggttaacatcatatatattatcttgggaatcaaagatgatgtattgaaagataagttttcactaaacccagtgataatagaacaagagatgctgttttttgacttgacaattacatttaatattgatttgtatgttttcctcaaatgttgataatatttttttcaaaattcattggccccatttattcctttgaaaaatccacactaaagtttttttctcctcccccttcacttattgccagactaaatttagagaaagacaagtgctgtgttgccaaatcgtgaaatgtgtttgggcgaggtgatgagagttggtttgtgagcagtaagggctgctgctatttttgccaagagaagtataatatacatgactctttaaaaattatctattgtgtgtcttttaagcaatcttggttttaaaatctattgtgggtcttttatgcaatcttggttttaaaaattgaagcattctttaacattcatcagttgtgaaaatttttcttaaaaagggggaatttatctcattcctttaaaaaataattttataattacataaaaatataatattttataatatataaaatatatcaattaatataatttataggtaaaaatttatgtattaatttcaaaatagtaactgtaatgtggattataaaaacagtttcaccatgtctaccaggagatatcatcccatcatagaaagccggttcgaaactaactgaagatatgatctcttactggtttatattcttctaaagttttgactggctagattcattgaaatctagattcacaaggtattttcatttatatggtcatatttaattgcatcccctagtaaaaaaaatcatctagaatatttattctattcattatggtgtaacaacttgcatttgatttttttcatactgagaatttttttccctactctactgtgctatgattacatgaaatagctatgataccagcatttatagaatctaattagagtatgcctatgtggagaatgattccaggattgaaaatttcttgcgtaaaatgctttaaaatattcttccaaatcaactctgattttgaatttaattgtggtggcccattactgcttttaacatttctggactacattcttggcattaaacttgtcttgggagtggaaggaagaaggaaaaaatatcccagtaactagtaaacaaaaacaggcagaatattagaaggaaaatattcatattcatcctaccacctctccctgctgccatttgacctagctaccagcaacgtaaccgagcagcttatttgaagagtctattatactggttcaaggactgggaagcagactccttgggttgaaatcccagctcttcacttacaagttgtgccatcttaagcaagttactcatctggaagtagtttaacaagcaaataacctagcatgctggattataataaaggtcaactggttaatatgcatgggtaaaccacttaggacagaacacacagggtacacaaaatatatgtgtttctaaagtaaaataatctcattccttgtgatttataaccttgaaataattatatccatttaataatctactcattcacatattcagaaaacatttacagagtactataactgtttttcactttttttctgggcctagaataattttgtccaatgtgacaagcaacaatttttgtcgacacattgtaggtattaagaattgaataaaagagaaatccagtgtattccatctacttctttcatatactgaagtggcattccaaatgaaatgttgtctaattccgtatctgagccaaagtggtaaacccaatgctggatcatgtagtcttaatatgcaagagcactgaagagagaacctgttttagggtatcccccaggacataacagatatgcagatctgtctgatcaccttgtcactctgctacagccatgctggtctccttgctttgttaggacatgtcaaacaatcttccacctcaggagattcatatttgctgctccttgtctagagcactccacttctcctaatctccctacttctatccctgctctgacacacaatctgcttgacccatgtcctcatctccttcaggtctcaactcaaaagtcaagttctcagtaagccttccttggaccaccctttaaaaaatagcaacttctcccatatactcagcatttttgtcctgctttgttttcctctttatcactatcatcttgtaatataataaatatgtgtttccttaagtattgttttcattttacatgtaaagacatatttattttctttatgtatcctttcccatacagtgtaagctcaattagaacagtcactctatttgtatactcaatgccaaaaacagtgcctaccacatatcacatgtccaaatgtttaataaactttagaataaatgtagttactttatctatttgcctgtgtcttgggctatttgctttcttttgtgcaaactaaatagaacctgcagcaacctggagttatgcccaatgagcactacaaattagtggtagttctctagtagcaatgggacatcctggtgctcagatctgttttttaaacaccttttcccattaaaaggaactgagatcctttgaagaactggctgatttcaggtctaaagaaggcgagcctgagatagttgtgtgtttgtgtgtgtgtgtgttcagaaaatacgcatacaaagactaatggaagtatgtcaaaggacatatggatcaacttgaaggagctttcactggcaaaatttgggatgacttgtgtactaaaaagaagtgagtgtaatttattttaatgcaacaaagaaagaaaaacacacaagtgtattaatattgagagagagagagagagagactgagactcatttgcaacactggaactaatacagcttcattggtttcagagaagacaataataagttaattaaatgacatgtccaaaatgtcaaatatgacttcagattttcagagcgtgttgcagattaattggcagaaacagcatgtgtgtactttctataagctctcaacatgaagggtggaggccacagacttaacagaagagggagcaccacacaaaacagtagcatatcttattctgtatttttttaaattaatgataccctacagagtgggtacatagctgtcattcacattctctgcagcggtgagaaaatagtcaatttcttgctaacaacaacacaaaagtggtttatacttagagcttagatcgccattctggaatgctaaccatctatgttgaaaaaaatgtttatagacatccattcttctgcttctcaaaccacatttggtattagcaggagtacattctcaaagaaggaactgcagaatcagtaactaggttccataggcagtctctatttctaggttatttccggtaaatgtgaatctccacactcagatttcagtgctttcatcttgtgattctgatatttggtttaaccaccacaatcatgaagcacgcctctatctccccaactatgaatgtatactcccccaaagagaacagcatgtctttaatcactgatgccaggggcttcaaaattgttaattaaaatgctcctgtagaacagcagttaatcctagtcctcaatgatattaaattatctttaaaatatttattgtggttaaagaagcttttatcgactccaaggtcctactgtggtcagtagttctttgtaacctaaaaacagcctaatatcataattgaaagaaaaaagaaacaatttgtaaactgctctatgctggaaacactcaaagttggatttgaatcattgactttcaccctgttattagagttttacttaatatgtccagatctgagatcataattttggcttacaactagacagatggtactcaattacacatttaatgctacattttctaatgtaacaatacaaaaatagttatcaggggctgcatatccattttctgtagacacccaggagaaataactttcacatttcctcttttatcatctacttctgtgcagccagaaggttgcatgccactccttaccatctgtcaatgtattgcttgctaatatatttttctttaatcagagaattgatgggacattctggataagattctatttaatagcaaaagatgatcattttttaaagaattagattatacttgagtactaaaattacatgaaacattattgacattctccttaatatttcagatggctcatcagttttgatattccttgtattttttttaaagaaagagcttacaaaaatcccataaaatagaaaatgatcagaatcagaagaggtgatccttatttctatgccactatgttcaccatccctggtgtaaaagattgcatccttctattaagaccaattgaatgcaataaaaaattgcaaaacctactaagtacctttttagtcatatctccagaataccccatgacttttcagttcccatgaataacacaggtgtaaataaaattttgcctgtagttaccatggtgtttttataaatgttttattattattgggaaaaaaaaaacaccactcttctgatagggcttgcatgcaattagtcacgtgtatttatagaaacaaagtcctaatttaactgatacttttatggttcaccttactcttacagatgcaaagtttaattgtttgctgctgtatgcctttgtgttaccaagggttagataacatgtaaccaaaaagactttgatttttctcctcttttcatggaattgtattaaaactaatttgaatgctaaataaattgatgtctctcttggttctgaaaactggcagaatattttctgtgaagcaaaagaacacacactcacacctctgcaatttatgtagaggatggttatataatcatttcacacagatgaactctaaaatttaaaatgaaatatttgtgagaccactgacttttaaatcacctaagaatgttacatttctatcttgttgttgatttgtaaatgcacgtttaatcattacttttcaatatccccttatccacaatggaaatagtttctgaaagtgaagatatatgtatttaagatatctggaaactatagatggtgaatgtaatcgttccaccaaatgattctcaccactcctctcatcagttaggttttatgacaaagcagatagttacaaattcattactactgctgaacagccaaccaatgcaagcatagtgctgtataataatttttattcaaagtgtttcatgagaaatttaaagtctcaattaagcttatgagtcttagattataaatattggcaatgtgatcacaccatatttaacaggtatttatgaaacatttattttgtcatcagcactatgatagacatcggtgatataaaggtgaacagaaagatatatgggctctgctctctggaaagttccattcaaaaagagaaaaaacaatatatataaatgtataattatatactgagataacctgtatgaaagaaaaaatatggggttataaacctataaaacagaggaacatgatcatatctatttggtcaggaaaggctgttatattagctatgatgagattcagttgcatatgtaagtatcacgaaataagagtgacagaaatgagaaagaagtttactactcttttataaaaaagactactgaatataggtgttccaaggtcatgcacagaagctgcaagttgacaaaggtccatactccttctcttttgtttctgccattttaagcatgtgcttccactttataaacaaagatggctggttgagccccagcaatcaggtttgcattccagttagcaagtagaaggaaagctttatgcaacctgttcccttacattagcaggtgaacacttagtcatacagccaaccatagccatcccatttcacgtgaccacaccagcttcccttcagttttaagttcccttacaattgaagggaagctggtgtggtcatgtgaaatgtgcctgattaagaatggggtgtccttcaataaagcagaagaaaagaatggatatttggaggcaggtagcagtacctatcatagatgtcttgagaaaatgactttggatctgagatttgaaggataaagagatgttagccagatggagtgaggaagggaagactgaaaagcagtccagacacatggctgcaccagcctcacttgcaactgaacttgaacttcctgtatccagcagtctttatgtgggaaacaaaacttctttcagtcaatgccattttgtgatttttaacatatgtgattgaacttaatcctaccaaataaaacaaccgttgctgaccctttagataaggcctacttattctatttttactgtttttctgggtctcatgcatgactaatggtttttgttttgttttgtttattaataatagcaggtttactcttaccatgagtttatgatagcatctaatatcacaaacccaaaagtaaataaatctctatcaaggctatataaatgtctttagaatgcatacaaattttataagtagcttcttgaagtatttcttattgctgaactataccaaagattttgaaaacttttagataatcacgtcatattttaggaaattggaaagcattttaaaacaagttattcaactagtatgatttcatctgaaaatattccctgtattttttttggagggagggattggtaatttattcaaaataatttcaaatgctgttaatccattcatttgtttttgacacatccagactcagcatgaatttttttataatacagctgaagatactagaatttcacatacatataatatttcaagtataaattaattgagctgtagagataagaaaataaatgtttatctaattttgttactcaggataataaagtgctttactaaacaggctattttcctttgtagatttacttaataggaattcaaattctttcaacagaaaatgtttccaaaacagacaaacattagaatatcttgtctttcataaaataattatcccaaataatgagcttagtaaaattaacattcctctgcttagaggaaaaccagacattatagtaaaatatttcacttttaagaagagcttttaaaaagtttattcttttattgttttcctccacattttctctttggattggttccctcctgtatgaaaggttcctatcctgtgcacagtattagcaagtagatataaccgtcaaacatatttttcctactaagaagaagccattggcaaatgccagagagcattcattaaaccaccataataggaaatataaccatatgagtgagttgttcaaaacaattcaaagaagaggaggttggacacctgttgacaaacaacatagaagtatataatgtaaactttttagaaaagattttcagcaagaaagtttcattaaattgattgaatgtgaaagatattgatgccttaaaattagagtatttatgacaataaagtatttaggtaaagtgaggtgcaaagataaattgggtggagaggaagagcaggttggtttagctagaaaggccgtgttagcagtaatgaaatatagatgaacataattggttactgtgaacttgtttagtgacaacaaagctgactttcaactttggcagttgtatcagttaactattgttttataagaaattatcccaaaatttagtggcttatggcagtgattatatttagcctgtttttctggttcaggatttggggatggcttagttgagtggtccaaccttgggatctctcatgaggtttcagccagtggtcagcttgagaagtgtcatctggaatctttctattacgagaagatccacttctttcattctgtgaatgaaaaaagtgtttcattcacaggaccagcaatttagtgctggctatgggctggaggccttagtgactttctatgtgggcatctctacagggctgtgtaagtgtctttaagcatggtagctggtttgtgagcaatcaagagaggtaggtagaagctgaaatgccttcatgatctcatttcagaaggcacacactgtcacttgcaccatataatattcacacaaggtgacctctaatttaatgaagaaggggtctacacaaaggcagacatatcaggaagtgagggtgtttgggggttgtccttgaggttatcaaccaaattaggtattattattatcatcatcatcaccatcaccataatgatgaacattagaatatcttgtctttcataaaaaattatcccaactaaccagcttactaaaattaacacccctctgcttagaaagaaactgtaagttatagtaaaatatctcacttttaaaaagaacttttaatgagtttattttatttttatttaaaaagtttcatgacgaggatgatgatcaacatttttattatagaaaggctaatacttagtagcttacatcatttctaatctttataaaatttctttatatcatttccaatctttataacaattctgtgagataggttttattattttcattttatagtgagagcgtagttaaataacttgcccaaagtcacatggttagtaaatggtagcatatctgtccatctgattcaaatctcacattcttttagccatatcatgatgcctctcaggaaatattgtctgctctgggctgattttgctagatatcataaatgcctgtatagtgattgatacacctcttaaatgaagcacaaagtacaggagaaggagacactaatcaacatcaataattcaggtactttaaagtattgtttcccataatagttaaaatacatttaaaaataatgctcattttacaatattagaataagattgccaattttcttctaagtgaagctaaattgaaaaaaatcatgagacaagttattagtgaatatttagctggtcataagcaagtgctttctttacgacttttctaatattacattttttgtatcaatttgtaatttcgaacttttataaaagcaaaagtgacactcataataggccttattattgagatgtagctaaaggtaaaaagataatgaccaaatccactaggagggattgtgtactcgaggaatagcaaccacataatacccctctagtaatgaacattaattgttttaatcaagctctaatttgaaatcagaattttaaaaaactaatcacatttattgtagtggataatttaaagcttttgtttcattttaaacagattctcagtgacagataaatcattatttaggaagagacgaatatcattcctgacatggcaatatattaagtctaagtctggaaattcctggacaaacatatgccctaaaggaggtataagctaaaggtcattattacagagggctgttccacaatttaattagcttattttcatgtgaaaaaagtagtttggtatcctcacaatgcatacatcaattggagttacaaattggcttacgaaggaaataattaaatgacttcatcacacaaatcaaagcacatctttctaaaatataattatttataactgaaggaaggctctgtgaatatttaaccttccattcaccattcttcacatagacggtaccgtttgtagtgctaaaaatactccatctcttatacactattttccaatttgtgatatttttgcataggcatcacctcagattcagattaaaaatgctaattcattttctcctacatattttctgcatcatctctggaggtagtcttggtagtctgcattttggataattatgcattctgaagttcgagaatcactgtaacaattccaaggatcttttactctgatccaagagagagaagagataaaataaaatgcagccaataaaatctgaaactcacaggcaatttctagagagaatttgaattgacagtaacaattaattatattattaaggaacaaagtatttcatttaaatatttgatactttgtaatgatattaataaaatagtactgtaagtacacctgttttgcattcgtgcatgtcaagcctcatgatgggttctttacatatgcagtatctcagttcaccttgatgacaatcccttgaggttggtattcctatctgccccattttacagatgtaaaaagtgaagttagaaagattaaatcccttgtccagaaggtggtaaagaatgattaacactcagctctgtatgacttcaaatgctataaggattccatactaataactttagggaaaacggtttgctattaaaagaaaattgaagctgatttgaatagcacggtatggttgaacatcaaacagattgaaatggaatatctatattttatatggtatttatataaagtacaggtagcctgatattaaatacacattaaatataaataaatatattttaaattttaaaatattttaaaacttttatgttaaaatgcttacaataataaattatttccctcacttataacttctctctaccaaataaacaaaaacatcaacaactacacacatgcataaatgataattatatcctgttagatacttcatattctatagaaacgatgtcaactttaatgaatatatcgccaacataaagcttggtacaacatgtgctttgtgccctttgagataattacatatatcctttatatatttagacatttattgaacacccacaatttgttcacctaaaaaagtgtatttttttccttaaggaactcacagaatcatgggaaaacagatatgcataattaaatcagatatgtggtaattattataattgaggtaagcgcaacattatatgcaatctcaacaagagtaatggtgaacctaaattgagggactgtgacacattcatatattgcaccggactctgaagaaacagtgagattttagcacacagaagtagaaaatggggaaaggatggcacagaaagaaagtgttagaagaagtgaggactgtacagatgtcatagacacttttttttttttttttggtcttaaaggaaatctaaaatctccttgagcacaatctgtggtgtaccttgttatagcaggtgggacagtgttgggacaggggttgagcaagccaggcacaagaccagcagatcacagcatatacatgattaaacgaggtccagattgggccagccacattttctctgccttgagtagagggctgtgagtacagttaaactatctagtgatggatgacattgtaaagagactgcccttcagtgcattctagtacagagatctccaaagctgctttgattcctccaggactttacgcgcaggtcctcttctctgtgaggcctctcctccccatatcatttaaactgcacactctaacactcccttcccacttcctatgttccctatttctccttagcttttatcactgcccagcatgctatacatcatcctatttattttgctattatctattttatcctattagaatataagctccatgtttcacttccttgccgtaatttatccagtaactagaatagaactttgtacataatagtcacgtgagtcaaacaaaacaaaacaaaacgaacaaacaaacaaacaaacaaaaacaaccctgatatttttggttttctttcagtgtttctgtatcattctgatacatttttattttgtttaatgtgcccataagtttctgctgctttcaactgcaagcctcaactgaatggtgttttaaaatgtataaaatgccttccaatatattttctcttcaaccttgagaaacatatttactatttttattactttaaaaataaactgaacctcggggaaattcaatatttgcatattaacgtttcaagtttagatataaggcccaaattcatatttcctgctccttgcattttgtagtccgcctcatctagaaaatccccaatatcgagatttgactaagattccatttttaatgattattttactccaatacttattgattcatatttatatccaattgaaacatcttgtttacattcacttttatgtattcccacaggtttctcaccagacatggtgaacaataataatgtattcaaatcaaagagtcttgcttttgaatagatggaattgagtttctcttccatgttcttttcctcagactacataatgcctgtgattttcttcatcctttcttcttaagatctatttttcacttagtaaattatattggcagcatttcatattaaatatttctctatattttttgaaaatgtaatatactaactggctatattaataaaattagattaacgcaatattaaaaataaggctaattttctaggcctgtgagtgtatttgacccttctctacaaaagcacaaattctcctacctttcgtttagcttataaaaaacactatgactgtccctctcatcattatctacaatggttgatgtgctcacacgtccttcaatgcatgtttcatactgctacttattctttcttattagatatatgtaaaagttaaatttggggattacttaatagtgcaaaatatattaactttatttcagttacaatattttacaaggtaaaaaaaaatcttcaaatttgtattaccaaataacatctattcacttcacatatatttttggagtgtcacatatgatgaaatgtcctgggaatcatcattgaataaaatacattttcttggaatttatgtctgtaacatggtactataataacattaagcaaagtacaattttccggggagtttttctatttttttgagaagtgaaatatattttcaataaaaatatcacttcctatgttcattacctaaagaataacccatattcagtcagttcaacattactcattgaaaccttgaattccttgcctccttaatatttcgtggcatctgccaatacgtatttccatttcaattctgtttagaaagataatcacagaaatctacttaaaagacagctacacatctatgcttccaattgcaccttgactctcattgctgctaacatctattatcccccaaaaagacattatttccaatatttcccactctcctgaagcatgcaacgtcattcctgtgccatttacttttggtacagtgattaggataaagccatttgatgtaaattgtttcaaaatgctttctatcaagttttattacgtctctttacccatcttctcttttccttttttttttctaagaaaatgaagcattagtcactacaaggtttatgtgctagctcttaacctcacccttttcaatttcttcagcattctctgccttctatcaataaatacagtaaagatcagagaaaatacatattttccttcttgtcatgcaaataacctagaagaatatttaaaaataaatataggatgtttaagatttattaaaacaaattggccattgctttttccagtaaaacatgctaaaacagaaactagcctgttctcagaacaaggctcttagctgatggagtattcttcataattaccatcaccaatgggttgtactgaatgagtgtgtctatgtgtgcataacacaacatggagacagggaatggcatccctaaagatctggaggcctagggtccacagtatgttttagaacttcaagaaggtaaagaaaacaaaaattctagggaatgtctgccatggagaagctctgcctagaatggtccctcagttcatggcccattggccagccataaaccatggctggtatgtatgtattaataaaatacttctttacttatgtttttgtaatataattatttcaaaattcctcaagactttttaaagaataaaattcttcctcaaattctttctcaattgacacatttagaattaactgattcttttagcacaatataactgcatcttacaatcgtctattaaaatatttgttttaacctcttatgctttacaaaaactgctccctgaaaatatacttcacatctaaagcaagttcttgataagtgtttcctgaatgaaagaacagtgtatgcaaatatttgaaatatattgttgttaaaacatgtgattccttatatattaaatatttaacattaaacaaaattgtgttaaaacaaataatgtagtcagacagtgataaattataatgctcgaaatacagttaatgtataatattttatttatgatgccatatatcatttaggatttcaaagatggcttcattttcagcatctgtgtaacatcaaccaactacacctatggcttcttatagtcctattataacctcagagctggatcatcttaaaaagagcagaataataatgtgccaaagaagacagaagtacaggataaagtatgctacagttatacatcatctaatgactggcttgtgttctgagaagtgcgtaattaggtgattttgtcatgtaaacatcatgacacaatacataaatctagatggcgagcctactacgcatctagcctatatggcatagcttactgctcctaggccacaaacctgtacagcatgctactgtagtgattactgtaggcattgtaatatggtagtaattgtatatctaaatatatataaggcctatctaaaacatatggtaaatatatagcataaaagaataaaaagcattatatataatatatatatttattatatacaataaatttattatatttacatattttataattataaatataatataattatattatataattatatattaattatatttatatataatatattatatattaattatatttatatataatatattatatattaattatatttatatataatatattatatattaattatatttatatataatatattaattatatttatatataatatattaattatatttatatataatatattatataattatataatatataaatataatatatataatatataaaagaataaaaagcataaatatatagcataaaataataaaaaagaataaatatagggcacttaccataaatggagcttgcaggactgcaaattgctctgggtgaattggtgagtgagtggttggtgaatgtgaaggcctaggacattactgtacactactgcaggcatagtaaacgatgtacacttgggctacactaaatttacaaaacatatttttcttccttcaatgataaattagccttagcttactgtaactgttttactttataaactttaggttatttttttcactttttgactcttctgtaataacacttagcttaaaacataaacacattgtatagctggacaaaaatattttctttctttatatccgtattctataagcttcttttctatttgatttttgtttttactttttaaacttttaaattaaaaataagacacagacatgcacattagcccaggcccacagaggctcatgatcatcaccaccattgtcgtccacctccacattttgtcttacaagaaggtcttcaggaacaataacacccacagagctgtcaccacctatgataatagtgccttcttctggaattcttcctgaagtacctgcctgagactatttcacagttaagttttttttaataagtagaagtacactccaaaatatcaattaaaatattgtatagtaaatgtataatccagtaacatagaagtttattatcattatcaagttattatgtactgtacataattgtatgtgctatacttttatatgacttgcagcatagtaggtttgtttacactagcatcaccaccagcatgatgcattgtgctatgacgttatgatgtgtatgatgttatgatgactatgatattatgatggctatgatgtcactttgtgatagaaatttttcagttgcattgtaatcttataggaccaccattatatatgcactttgtcattgaccacaatgtcattaagtggttgtatgactgtatatacaaacattacactgtagttcagaactgttgcttttgcattaattttattttgtagaaaacaaccaataaatacaatgttttctatgaatcatgtgtcttttcttcaccaaaataattacaatcaagaatatttacgatacaataattaggttatgtccattgcttcctagtgtcattgtccagttttctatttaaagttgctgaggtttgctttttgatataacttaaaatatcagtttgtgatattcttttaacatgccagtaatagcattgactctttttgactcccagtgatacaaatttctttaaatctttacatgttgtatgcagcacttagcatacaaagtcagctattctcttttaatttgtagatacagtaaattatattttaaaattagctaaattcagaaattggtaattttaatatacatatttatgactataaaactaagatggtaataaaagtcataacaaagattcaatatggtaaacttcaaaatgaattatataacacaatttaaaaatacacaagaaatgcatttataaagaaatacaagaacactttcaaaaggatacttagcattctgaaaatttatattatataagcacaaaataatgtatatattataaggatcttgacaagtcaatatattttactgagcttccctaattgatatataaaatacttaaagtagtgcctgtgctcacttaacattacatttctctaaatttaagataagccaataaaaagattatttgtaatcttgaaataaattatgctattatttaaaaagtaccttcatcattaaaacaacagttaatcttgagttccatctttactggaagtaaatacttttacaagattccatatatattccattgagcttttagaataaccttatgacctaaatattttttttattttccaatggtttaggaaagtaaaaatagagaaataatttcacttgcttatagtcacactctagcaaactgtagaacctgtttttgaataatgtatttaattccaatggtcattgatatggtttgcatctgcttccccatccaaatatcatcttgaattgtaatcctcacatgtagagggaaggacctgtaattcccatgtgtcgagggaggggagtgattggatcatggcggcagttcctcctatcctggtcttgtgatagtgagttctcatgagatctgatggttttataaatgcttgacagttcttccttcacactttctctctcttgcctgccacttgtaagacgtgccttcttccccttccaccatgattataagtttcctgaggcctctctacccatgtgaaactgtgagttaattaaacatcttttatttataaattacccagtcttgggtagtattctttataccagtgtgaaaatggactaatacattaatgttcttaactattatgaattttttagaataattcttgttatttgtaaagtattttgaaaatataaaaggaaaaagcaataaaaatggtagcaaagttaaatatgaactagaattaaaagtaaatttggaagtagaattatgtaattgaaattacccaatttataataatattgtctgtatgtacatttaaagtcaaagcacttctgtttatctgtctactctagagaacagaataatatgctattgtgactttttgatagttttccttggggtaactctaagatccttgagtgcagaggcctagtgtttttctcaacattgttgaagtctgacataatggtgcctcacaacaaggtgtgtcaaagttagcaaactaattttagtctaaaatttaaatatgaattcatttattcattcaaaaagcatagaaactttctatatgacaggcattatgctaggtgtcaataaaaatgtgaccagttaagtgaaataaattatatgctctctaggaattcccaatctagtggtgcagagagacaagcaaaaaactaagggtagtataataatgcaatacacatatctttattatggtaaggaagtataagaacaggagaatttatcttgaattaggtttcagggataatagtccaggatggggttgaatgggaatataagcttccagaaagtatttataaaataaagctaatacacacatttaggagtcaggagtatctaactttaagtaacttcaggggtaatattcaaggaggggtgataaggaaaacaacttccaaaatgtacttacaaagtaaaccaagcacacacactcaaaataatgataattctgtgtaagtgaatgtgtccagccccaccctactcccaatctcctcattctctgctaaagccatttcatctacttccatggcttcctctacccagtaaccagatgtctcccacattaacatctactactcaggcagacctctttcctgagagccaaacctgtgtttccagctgtctaatcaatctgttcaaaactgaacttaatatattgttttccaaacggctccttctccatattcatctctccttcactagaaatattaaagataaacctgacctttcctcttttgcctcttataatattcagcaactttataaattcttttgaattatatttattatacctattaaatatgttttactttctcttttattagctcacatccttgccaactctagtgtgatctatggaccataccataccactgaaaccactgtttcagtagctgctttattgggctctttctaaccacctggactgtactcagtgtattaaatactttatatcaagaacttgccaagtcatttacatacttccaatttctttcccctccagatgatacctgaaacatagagttattttagctaggtacaagtgaaatacacttgtatgcctaaacctgagaatcataaaagcatttatgtgattttaaggaggttgcactaaatcagaataccagcaatgactatatgacactaagtaaaacattcttcttcttaatttgtaataaaattcatcacctatttactaatcatggttttgtattaggcaatctgcttgatgtctgtgaattaacaatgagaataaggatgcagcacctgccctcatataatatacagcctagctaacttgtattaggtagagacttctgcaaatggaagagttataacttcctatctggagccccaaaggctactcattgatttctatggttgctatcactgatatacagaacattcttaaaaaaacaaaggtgtgtatttatgacagatgttttccttgagttgccctttatatctttcagtgcaatttcaggatataagtttattggaaatttgattataataaatatgtatttgcaactaggaaaatactatcagtaacgactacatgagggggtgtagttaaataaaagccttaaatttaaaaatccagtgaggcaatgttttcaagttatggagacaaatttctgtaaatgtctgccctaataggtaaacagtattggaaattacatagtttagaatacttttgttgctgcatgtaataattaacagtttaggcagcagaatataatggaaagagcatggatttttgtgttttatagctctggattcagaaaaactatattactccctctttgcgttattaaatgctgatttgggtacctttatggaccttcattttttcatctctaagtgggaaatcatgacaactcatctgcattttttttaaaagctactgaattgttccctctgttctcgtccaaatcccaaccaaggaaatatccagtattctaacagcaaatccaagctttttttcactcctcactgaaaattcttaaacccaaatccaaggtcttagggattacagttaaagctatctttgtattttggaggttgcatactttatttttagccatttcctgtctctaggttatgttccagttattttaaacatctcttgtattatctctgccattcataagcatgaatgcatataattgggtgacagagcaaaatactgattctctctcttggctgggaaactctgcctatattactgggtaatcttgcagctaagaggtattttgtatcatctgtatattgttactttgtcttcattaattttatttgaacacataacacatgccaagcattctgagaggtatttccagatggatttaaaatttatctaccataagaagttatatggtcctccaaataatagaaaaataatggcagactcttaggtagcaacaaaatgacagaatgtagaaaatcttgttctttgatgaaaagccagaattacctcaacctcatttgattacagagatatgatgctatccatatactaattaccattagtatcttttttctttttcttttttattttctttccaattttatttatctatttatttatttttgaaacagggtgatagggtttggctgtgtccccacccaaatctcaccttgaattttaactctctcaatttccatgtgttgtgggaggaacccggtgggaggtgattgaattatgggggtgggtctttcctgtgctgttctcatgatagtgaatgagtctcacgagatctgatggttttaaaaatgggagtttccctgcccaagctctctctctttgcctgccaccatctatttaagatgtcatttgctcttccttgcctccgccatgactgtaaggcctcctcagccatgtggagctgttaagtcctttaaacatctttttcttcccagtcttgggtatgtctttatcagcagtgtgaaaacggactaatacagtaaattggtaccaggagtggggtattgctgaaaagataattgaaaatgtggaggcaactttggaactggataactggcagaggttggaacagtttggagggctcagaagaagacaggaaaatgtgggacaatttggaacttcctagagacttattgaatgactttgaccaaaatgctgataatgatatggacaataaaatccaggctgaggtggtctcagatggagatgaggatctctttgggaactggagcaaaggtgacccttgttatgttttagcaaagagactggtggcattttgcccttgccctaaagatttgtggaactttgaacttgagagagatgatttaggatatctggcagaagaaatttcaaagcagcaaaacattcaagaggtgacttgggtgttgttaaaggcacttagttttaaaagggaaacagagcacaaaagttttgaaaatgtgcagcctgacaatgctatagaaaagaaaaacccattttctgaggagaaattcaagccggctgcaggaatttgcataagtaacaagaagctgaatgttaatccccaagacaatagtgaaaatgtctccagggcatgtcagagacctttgtggcagcccctctcatcgcaggcccagaggtagaggaggaaaaagtgttttcatgggccgggcccagggtccttctgctatgtacagtctagggacttggtgccctacgtcccagctacaccagctgtgattaaaaggggccaaagttcagctcaggttgttgcttcagagggtggaagcctgaagccttggcagcttccacatgctgttgagcctgtgggtgcacagaagtcaagaattgaggtttgggaccttctgcctagatttcacaggatgtatggaaatgcctggatgcccaggcagaagttttctgcaggggtggggtcctcatggagaacctctgctatggcagtgcagaaaaaaatgtggggtcaatctctactggggaaccaccattgcttgcctccagaccccagaatggtagatccactgacaccttgcactgtacacctggaaaagccacaggcactcaacactggcccatgaaagcagccaggaaggaggctgtacctgtaaagccataggggtggaattgcccatgaccatgggaacccacctcttgtatcagcatgaatggatgtgagacatgaagtcaaaggagatcattttggagctttaagatttgactgccctgctggatttcagacttgcatggggcctgtagtccttttgttttggccaatttctcctgtttggaatggctgtattaacccaatgcctgtgcccccatggtatttaggaagtatgcaacttgctgttgattttacaggctcataggcagaagaaacttgccttgtctcaggtaagactttggactgtggacttttgagttaatgctgaaatgagttaagattttgggggactgttgggaaggcatgattggttttaaaatgtgagaacaagacatttgggatgggtctgggatggaaaaatatggtttgattctgtccccatccaaatctcatctttaattgtaactcccacacttcctacatgttgtggaaggaacccagtggggtgtggttgaattatggtggtgggtctttcctttattattctcatgatagtgaatgagtctcatgagatctgacggttttaaaaagaagagcacaagctctctctttgcctactgccatccacttaagacatgacttgctcctctttgccttccaccgtgattgtgaggcctcctcagtcacagggaactgtaagtctactaaacctctttttcttcccagtcttgggtatatctttatcagcagcatgaaaacgaactaatacacagggtatcactctgtcacccaggttggaattcactggtgcgatcttggctcactgcaacctctgcatcccaggctcaagtgatcctccgacctcagtctcccaagtagctttgaccacaggtgtgtaccaccatgcccagctaatttttttgtatttttgatagagacggggtttctctgtgttgcctaagctggtcttgaactcctgagctcaggagttccacttgccttggccttgcaaagtgctgagaacacaggcatgagccaccatgcccagctaagtatctttttgaataaaatttcttcatgcaattgagattttcagtttacatatcagtctcctatttcaggtgctaatcctatctgccaagtatgagactatatacaataaaaatttaaagttctcttggtaaaataagaaaaaccccaattaataaaaatggtaaagaggtattaaaaatcctcaaaaaggctttggctagctaccatagaaatattaaaaaacaataaaattaaaaaatttccttggtcactcatgtatctgttacatatttttaataatcttactttgtgtggtacacaagcaaatttacatttatacatctttagatactatccctattaataaatagttacgtctcactaactgcctatatagttaaaagaaaaataattagttgcttactgtgttaaattttaataggtaaatcatttatttttgaaatatattttccaccttacacacataatattggtctccatgtatgaggaacacagcttaataaaatggtcttggggattataacgaagcataaaatttgttttggtagcagtatgaacaaataaagaggattttttacaaaaggcatttaatacagtgtgcaggaatgggtgaaggcttcacagaggaggtagcatgtgagataagtctttaagaaaaattttccagtgggcactttgagtgaagaggcaaagacaatcacacagaagagcatgcaaacaacttttttaggaaagaaagtagagtgtgtcccatatcaggaaggtcttttttatgccaagctgggaagataatttctgtcatttaaggcagtgatcccaactggtggtacctgtccatggcctgttaggaactaggctgcagaacagaaggtgagcagtgggcaagtgagcaaagcttcatctgtatttacagctgctccccattactcacattaccgcctgagctctgcctcctgtcagatcagtggtggcattagatgctcataggagtgtgaaccctatcgtgaactgtgcttgtgagggatctatgttgcacctgccttacagaaatctcatgcctgatgatctaagatggaacatcttagatcccttccctgaaaccatcccttcccgtccccctctcaagttcatggaaaaattgtcttccagaaaaccagtgtctggtgccagaatggttggagaagagaagtattttaagcacggaagcaggaggttactatgtttccaaacctatagtaaagtttctttctcttgttttcagtaggtatgaagagttagccacttctatacatagttctgacagataatgttattaatgctaggattcaatggctaaacaaataaataaatatatcttaaacagaaataattcttctatgggcccaggagataaaatgccttctatcagaaattattcctttggtttgaagaaatgggttgcgaacttcgttttgttttgtatgtgatagtaacacactgttgttatttatgaaagtttccacagagaactcataaataaaaaatgtaaatgtagaatagagaaacttggtgagcctcaaaagaatgtttcgtagcctggtggggtggctcactcctgtaatcccagcactttgggaggccagtgttggaggattgcttgagcccaggagttcaagaccctggaaaatatagtgagacttccatctatacagaacattaaaaaagtaactgggtgtggtggtgtgtgcctatagtcccagctacttgtggggctaaggtgggaggatcgcttgagcctgggaggctgaggctgcagtgagcttttattgggccactgcactccagcctgggcaacagagcgagatgctgtctaaaaataaaaataaaataaaataaaaatattttccctgctgttgctagcaactactgacaaactcccatgaaagtttaggactgtgcagatatggtttgaaaacagctgagtgaaggtatttaatttcgaggaaatgaggggagccatggtggtggccaggatatctgggaggaggaacacattaagtcatgattaaccactcagtagggttagtagagcaaatagatggtgttatttacaaagataaagctatgaaagaacaaatgtagaatcatgttgagacatcatttttatggacataaaggtaacaaaattcactgtgtttatatatatatatatatactttaaacaaacatatatatatatgtttgttttaaagtaggttttccatttgtatatatttgagtcctacaaattgacacttctaatgcataagaatactgcaaatattattttcctctagtagctcttaattttaacttttgtcaattaaagggcattttagaaactacattctagaacttgacttttgatgagaagtcattcattagacatacagtgcaaattgagtgctggcatcatccagggtccaggcacctctgagtagaaaactgcaggcacaagtatattcacagtaatataaaactgatgattcacacataagggaattagcttaaattgagtgttacatattctattaaaaaaggcatatgtgtttgcacagaagtatgaatgtgtttgtctaaattaaagatgcaatgaagagcaaggtcttgtactaagaatatccttcaacttcttatttgttgccttttcacctttgaactgcttaggtcaaatacattctaaatcttactcttaaaatgtgatagcataccatgtcagaaaaaaatgacaggatagtttggatgtttaacgagaatatggagctaaaacacagtattattcatgctaagctctcttaaatatatttgcatatgttaactcctgtgctagaattattttaaggaagtaagcattaaaatcccaactccttgatgcagaatcattttagaagtacatttgcaccatttcataatgacaaccatttttgaaaatttaatcattttctcaagatacagtttttgacaaatggtctgttactttacagcatctcatttgtttttatagcatttcaaccaaagaaaatatgctgcctcaatatgggttaatgtatataggtaagaaaatcatttaattctttataatcaatatataattctaataatcattcagtataattgtaataatcatttaattctttcttttggaaaaaaaaaagccaagagttgactattatataccttaatctttgtgctttaaaaatcttctttctctctttcttccaccaaaggcaaaaacaaatgacaatagcaacaaaaagataaacatcaaaacttaaacacatattgtctgttatagacctcaggatcaaatattttaggaaattaaaaatgtagaagaacagagtttatgtttggtaaaatttatatcttatcttaattcctacggtttttacaagaatatgttattatcgacaaaaagggggtagttaaaaatcgttgcagtgtgttttcaaagaaagtcacctgccaagaaaggtgtcagtaagatctttactgaaagaattgtaaaaagcctctgtcatgaccgagcatatggaatgaactgacccttaaactttaagagactgaagtagaatacctaatgtcaaatgctacccaaagagccagctgcaggatattgtaagaggtgttcatatctcagtgtacagaggagaaaaaaaagtaataattctgtacagcagccccagggcacttgcattttgaatcactgccacaataagcagatcaccagtaggaagagaatatattttgtaaaaccacagacttgcactatcagtagacatcagtgtaaaacagaagaggcaacagaattaaaaatagaagtatagaaaggggagagagaaagagtaattatatctactgcctacagtttgcaaaggcaagagacttataattcagatgtgcatttatttagagatcccttcaaaaaattctgaccacctttattatattaattctctaggccgttatacttattttttccaagtatggtataattatacagccagaataattaaatgtcaggctgtctatatttccataatgtataatatacagggaaaagaatatcaagttcctttttcatgtaacgatgatatgactgaattacaaagtaaaccttaggaatgaaaggcacaatttgaagataaaaagaagatagaatctgatctagtttagacttagccattttctagactgatggctgatttattcacaggcaattgaaatacatttagtaggtaacagctttctaactcatatttatattataaatcattttgacttttcgataacacagaaaatcttccatcttaatgagtttctactctatttcaaattggaaagcatactaaacttggttcttaaacctcctgtattgtttattgtctttatgttatacacataagaaaattaaataatgggaattatgttaaactgtgtatatgaaatgcaaaatatttttctaagccaagaggacttagtttgcaaagttcataaaatgtgttttaatcttactctttctgcgacgcacaaggaaagtaactctacaatgtttaccatattataaccataaataacaatatcaggagacacaacacatctcataaaccttcaaggatgacactgtagcagatttaaaaattcctgtggaaaattgtgttcactatttttttttttaattcacagagactcctaatgccatcctatacccacagtttaaagtagattaaactgacatgcacattattcattccatacattttcttcaatacttccaacctttttaagtctttcttcctttatatagcactttgttaaaagtttgacaatacattaacttactaagtagtgaagccatttaaagcacacttacttgaaaagtgtaaaaccgggtcccattaggaggatgcactttaggggagccagaaacggtgttcatatccgagaaaatcatttctgatcactgagacaatataatccacaaggagctacagatgcagagcagagagcttagcgtacagataaatccgtgcatgcattgagggagactagagggtaaaatgaaatctgccccatccttcttacatacacagtgatagcattttgaattgttcttctacatttgaaatcttagctgaaagatcatcagccaccgaccttttgtgaagctagttctctagaacatacaatgttttttaaaaaattaaaaacacagaaggaaaaaagcaagaaccaacgataaatggagcttgtgcagaatctggcagtgctgtggacctgcccatctgttctcagtgataatcacctccctccaccacagtctagcagagtgattatgctaaatatcctggttaaccaataacatacagtttcatttcagggaagcatgcacagtgtattcagaggacctcttctgactaacctgaagcatgtttcatatactgtttaaagctctacttagtaacaaattgctgttttatcactcttatttctgtatctttctaaatcttttagtcactcccagacttttcaacaagatgtgattttttttttacaaagcctttttttttttaaagggagttcttttataatttatagatcaaagtatattacagctgttacagctggcccggatattgagaggcaattgcatacaattcagtaagactgtatatactaggagtactatcaaataaaatgtaccaaatattttccacttttctgaactgctatagaatgtcatgaatacgaatgaaattattattatctcatttccccatcttagctaaaaaatcattatgtttgacaatcagtgcttcaaaaagtaccacatatttgttttaaataatcacaaccttatttcatatacatatatacacacaagaattaataaaaatatttaatacacatgaagattttcaactcaaaaatccaaaaatattgaatgcaaacatgtaggttttgttgcaaaatatgttctttttgtatatctttaacaaattcttcaatttgtacaaaagatcatattcagatgacttgacaacttttagaggtaaaaataaatgttccatttacacatcgttcaaatgtggagacttcagtaggataggaaacagaataagccaaaagtggtgtctttgtgaatgtatctaagatgacatagtcatacataataaaaaccacctactttaaacctgaaggctgtaaaggatgatgatttacacatacaacctaaattattattcattagtatttctgattctccaattatgcatgaagtttataacatcaatggaaaggatgcagaaaagtgatcctcaattctttagatgggactcctacattctgataaattaagtgtgtaggtaattatttaactagcaaactgctaaataaaccagaaaattattttaataaaatcttaatttgggaataatttctgatttatagaaaatctgcaaagaaagtacagagaattcctgtatgtccttcattcagtttttctaactgttatcttacattaactatgggacacttgtcaaaactaagaaactgatgttagtgtattattattaactaaactcaatactttacttggattttactagtattgacattaatgtgctctttgtattttaggttcaaattcaggataccatatttacttagttgtcatgtctctccagtttcttttggtgtgtgacagcttttctttgtttctcatgaccttgatggtctggagaggaactggccaaatgtaccatagaatatcccctaatcccatgaaatcatacatgtttgcctgttttcatcctgattacactgggctatgaatggataagcataccacaaaggtgaagtgtcctcaatcacatcatattagtggtacatgacatccagataacattattaatgatgtcaacctttgtcatttgacaaacaaagtttttgcctggtttctctactataaagttactattttccctttcccatactctattatttggaaagtagtacaccctcaacagggttggtaagaaatggcggaaattaagcttggccccttggaagacagagtacctacatatattaaatagatttcttctgtaatggctggcctcttttccttcaattatttactttttcagttatttacttacaacagtatagactcatgtatacttactttacactctggtttgaaatttaatattacataatttaatatgtttttcatattgtcccagctttaatcattggtagctcctttatttcaggttgtctcctgtgtcccttgacatgctcccatccttttgtttttagagcactcaatgattatttttttaaaatggttttctcttgcataaatcgcttatgatttgctgaaactatttatttccttaactataactctaattattattgtgagtaaacttgaaaatttatgttttattttccagtaatttttaagcagctatattattcaattttttcaaattaatatttttcccttctgatatcttagtccacatgggatttattcaaatgataatcaaattttttaaatgactaaatagatttactagctgtggaaataagttatatatgtgaaatattctagatacgtgttaggatcttacttcctcttatggttagcgaggccatgtaactcatgttccccacagagttgtgagtagaaataatccctcaaacagaaacctcaaggtttaagagcgaagttttaagaaaaaagaatgtttgtcaaatagatttttaccatgcaaatataaactccatgtacttttatgtttgcctgtaaactgggtctaacacaattgagatcagaaaattcaccagatcccttgttattgtagaggaactcataaatcaaatgtttttggtaaaatatcacatattcttaatataatctcatgtatttgctgcatttgcatcagccagaaaactattttattttagctgggaattatgaatctttccagccaataagaatacactttctttttcatatttctttggtgggggaggagatgaaaatagtatagattaatgttaaaagaggcaggagggagaaatagtactactaatatataattattttaagtacaatgctttattctaaatgttactgaaattgccaaagtatacaatttttccagaacattttttcctatgattattttgataataatgttatctcgtaattctgaatgtctatttggaaacaactcaattttctcttctgcctggtagcaataggaaaggtgttgtccaggtctaaaaattgccaagatttagaattattcattgtccattgtggttgaggccaaagcttatatatcaaggtacggtcccatcattctcattctgaaaagccatgagagttggagttgctggaggatggaaaagtttctgtctcactaaaaaacacatccctttaactcatgttaactgcctaaaggaaataataagtattaaatttagtcagggacatttgacactttttttttttctgtagggaagccccattcagtcaggcccaagaagtcctaatgggcaggaactgaacagtcttggagcaggctcagagttgtgctaagttccatgcccaacatttcatctagtactgtactttccaaacctggtttgtttgtacccttaggtacatacagtttgaaaaactatgaagcctctctttgtcaaaatttaaatattttaagagatttaaattacagtacctcataggtattgacagatgatactcatttaaatgaatcaaatggaataaagatgatctagcaatttaatgcccatcttctattaaaaacctcaagagctcttaaaaattgaaattttataccatcccttttattccttcaacttttttccttttctcctgcacataattttattttactatattgtactatctttctatattgtgtgccttaaagtattttatcagtaatattatattttgttgctgcaaaaatatataatatacacttaaaatatttttctttttaaattttaaatgactatatggttgtaagtgttaaaacttgtctcttgaaatgagcagcattcacaaatattattaccacacaatgtaccagaacagaataaatatattaaaatgctgataaacagagaaaatacaatattatgtctggataacacaaaaaatgtatgtttgtataatacaactgcagttttatcttttttaaactagcttatgtttcaattcaaacatcctattagaattagacagagtcctaattttcagttttgtagatttattgttgagaaactctgttcccagaagtaagtagatggaaaagaaaaaaggttgtgttgttgttatggtttttatcagcaatattactcaaattttctgatttcttctgcatatatactagaataaagatatattttataataatcattaaataccttgattaaatcaacctccgattttgttgaaagctaacaaccagaaaacatctggctttcaaaaaggatttcttatgtagctattaaagtcattcactttcctaacacctaaatctataatttgagtggtttcttattttggtccttgaagttttgagaccctggagtaatgcgacacagttaagattcatgagaaacatacactctgaaagagaagattgatttaaatgcagacagaactccttaattgcggcactgttctcagaataataaattttagaaaagggtacatatagaagaagaaaatgaatcccttgcaaatatccatgtccttgtatttcttggacagtcttcataccttaattttaaataactatcaaacatctatccctgcaatcaaatacgtttccggtggttgataaatgttgactcaatgaatgtgctgcttacacaatatggctaagtaattgctttaaacatcatttctaatcaatataatcaaaaattaaaaatcagcctggtcatagtcttattagaaattcaaaacttcagcatatgctcagaatgtagaggaaaaaattcagtgaccacgctgagttcattgttccttaataagcctcaatctcctcacttatgaaatggggagaatattgcctcactcaaagtcttctgtaacatttaaataaaattaagatagtaagaccctaatttgtctccattctctgcaatgtcttgcattaattgcaatgtctcattaattgcatatagtagataatttatagtgtaactggcacatatttgaggggaaaagaagaacgatcaatcattatttcagacaatagacacgaagactgttcttggtaaaccagaacttggtcttgtgtttaccatggcctttgtactcatggtaaacacaaaagtatgtttacatttgaggagcttttattatattggaggaaaaaaaaacagatacactttttgaaaaattactttaagagcattatatatatcaaatccattctaaagaatataaacaaatgtggacattaatttaggcttattaattagggtgacttcatgggctacattacctgaaaatctagaaaggaagaaagaactaacattcagtacttgtgtgtcagacatggacacatggcatttaatttgagccatacactgtcatttggcctgggtaatatattgattttacatatgagaacattgatatttaagaaagtagaatacctttttcaaggacagaatcactattctgactaaaaaaaaaaaaaaaaaaaaagccctgtccattacacctgtcccttactgttttcctttctcttccacatttattcgtttatttatttattcaactatgcattaatcaaagactaattaccaaatgccttaaatttgcctggtattgtttccaggctttggggacaggattatcagatacaatatcagtgctttaggaactttaaattttgtgggagagataccagctaaggagaggtagttaagtagcaaaacaactgcaatgtagtttgacaaatgctaaccattgacttgatgtaatgtatactgagttcatctggaaatcactgatttccagtgggtgatttccagtgggtgaccatggcaaaagcaggaggttaaaggatttccaaaaagagaatcaatgtttgaaacaaaatgaaatggcatggaaatggttgggaaaatatggctgaaagcatttcaggacataagaggtaactgtgctaggtgtgtatttgtatttacaaacagttttttcaagtaaaattagtaaagacacttaatctggtcatcatccttttcctataaaatcaaataaaattagaacattcctgtttggaaaaaaaaaagatatgaaatgttgagtcacattttcacacttttggttagtatattttaacatctttctttagtttgccaaatagctttccaagattatttttggttgtgaagaaacttcattcttagtttgattgctttcaatttatcataaaactatttcaatcgaaaattatatatatatattacaatatcacacctcaaataaaatttaatgtgcttatgttatcaatcattggttttcaggcaatggctaccactttacgtgaagggtaaataacatacccattttaatcgctacagacagaccactaccaaaaatttcttaagatgtatcttttccaagagaggtaaattatgaagttgagcttcaggaaatttaatattagctatcacaaccacctcaatttttacagaaaggaattgaaaatgaaacagtaaaagtatgactaaactatacttaacttaaaacggagtaaattaaaaatcctgaagccagacatttgctcttaatagaattaagagaagaccccaagaaattatctaatacacccttgtgcccttaggaacaattactcctatgccatctgaaatgcatgttatcagcttggtgttaatcaatgttccaaaaatacttagagcctatgcttttatatcaggaaattcaactcacatatttttataatcctggaaaataattttgttttaagaaatagttgtgagatatattctgttttaagaccagcaatttgacatagcctttctttcattcatttgtgggtaaagctcaaaattttgctaaaatgataagaatttggggatttaaatacactgaaaaggctgcttattttatgttaatttttgataaatggtcaggggaaaatggtcatactgaaagaacaatggggtgaagaaggaagagaagaacatagtggtgaaagagagagacagatgaaagtaggtaaatgggaaagatgaaggtgagagagaaaagggagaggagagaggaggcgaggggaggaaacagatattacactttgcatggtagcattacacgataacaaagcattttccaagcaaacattcagttaaaattcatgccatatggaatgaaatttgcagcccagatggacaatacatcctagtaaatttatatggataacatatgaacgctagttaagtatgtaatatcactagcctgtctgtctatccatccatccatccagctatctatctatctatctatctatctatctatctatctatctaatctgtctataatttctctatctctatttaatctatcttcatatttatccacttctaacagtatccatacccttagctttatatcatgagttctacaatatgtagcaaaaatgaccctttacagatagccaaaatcctgagtttactctatgatttattttctcaacttttattcagattcagggggtacatgtgcagatttgttacataagtgtattgcacccaggtagtgagcataatagccaataagtagtttttcaacccacgctacactccatcccttcccaccatagtagtctacagtgtcaattgctcctatgttgacgtccctctgtactcaatgcttagcttccacttgtaagtgagaaaatgcagtatttggttttctgtttgtgtgctaattcacttaagattatggcctccagctccatctatgtttctgcaaaggacaagattaattatttttatatggctgcatagtattctacagtgtatatggagcacattttcgctatccagtccaccattgatgggcacccaggttgattccatgtctttgccattgtgaatagaatgacactgaacatatgagtccatgtaactttttggtataatgattgattttcctttgagtatatacccagtaatgggatggctaggttgaattgtagctctgttttaagttatttgaaatatctccaaactgctttttacagtggctgaactcatttacattcccaccaatagtgtataagtgttctctttatccacagcatcaccagcatctattgtttcctggctttgtagtaatagcgattttgcctggtgtgagatagtatctcattgtggttttcatttgcaattctctgatgcttagtgatgttcagtattttttatgtttgctggccacttgaatgtcttcctttgaaaagtatctgttcatttcctttgcccatttttaatgaggttatttgttttttgcttgttgatttaagttccttaaagattctgtatattagacctctgtcagacacatagttcacaaatatttcctcccattctgtaggtcatctgtttactttgttgatagtttatttcactgtgcagaagctctttagtttaattaggtaccatttgtccatttttgcttttgttgtagttgcttttggggacttggcaaaaaaatatttgccaatgccgatgttgagaatggtatttcttcagttttattttaggatttctatagtttgatgtcttacatttaaacctttaatccatctctagttaatttttatataaggtgggaggtaggggcccagtttcaatcttctacatgtggctagcccgttatcccagcaccattaattgaatagggagtcacctcctcatggcttgctattgtcagcctcatcgaagatctgatggttgtaggtggtatctttatttctgagttttctattctgttctattggtttatgtgtccctgtaccaataccatgctgttttggttactggaggcttatagtttgaagtagagcagtgtgatgcctccaactttgttcttttgcttaggattgctttggctatttgggctcttttttggttccatatgaattttagaatagttttctctaattctgtgaagaatgacattgttagtttgatagaagtagttgaatctgtaaattgcttcaggtgtatggacattttaatgatattggtcctacaatccatgagaatggaatgttttttccatttatttgtgtcatctctgatttatttcagcagttttgcagttcctcttgtacagaactttcaactctgtggttagctgaattcctacatatttcattttctttgtggctactgtaaatggaattgtgttctgaattgacttttagcctaaacattattgatgtatagaattgctactgattttttaacattgattttgtatcctgaaactgtgttaaagtcacttatcatttctagtagccttttggcagagtctttagagttttctaagtacagaaccatatcatcagtgaagagagatattttgactttttttcatatttggatgccttttatttctttctcttatttgaatgctctggctaagacttctcgtattatgtcaaataggcgtggtgagaatggacatctttgtctggttccatttctcaagggggacggttctagtttttgctcattcagtatgatgttggttgtgtgtttgttaaagatggctcttcttattttgaggtatattcctttgatgcctagtctgttgggggtttttatcatgaagagatgttgaattttatcacaagttttttctgtgtctattgagatgatcacattgtttttgcttttaattctgcttatgtgatgaatcacatttactcatttacatattttgaaccaaccttgcatcccaggaatcaagcccacttgattgtggtgaattagttttttgatgtgctgttgaattctgttttatagtattctgttgaggatttttgcaactatgatcataagggatactggcctgtagttttatttctttgttgtgtctctgtcagattttggtattaggctgattctggcttcatagaatgagttagggaggagtccctccacttcaattttttggaatagtttcagtaggattggtaccagttcttctttatagatctggtaaaattcagctgtgaatccatctggtccagggcttttttgattggtaggtttcttattactgattgaacttcagaacttgttatgggtcttttcagggtttcaatctctgcctgattcaatcttgggaaattgtatgtttccaagcatttatctatttcttctagattttaaaatttgtgtgcatagagttgcttgtaatactctccgagaatcctttgtgtttctgtgggatcagttgtaatgtcatctttatcatttctgactgtacttatttggatcttctattttttttctttgctaatatagctagtagtatgtcaaccttgcttattttttcaaaaaacaagtcttggtttcatcaatttttaaaatatatttttgcatgtcaattttattgttctctaattttagttatttctttatgtctgctagttttggggttggtttcttctttttatttttcctaggtcctttcagtgcaaagttagagtgctaatttgaactctttctaactttttaatgaaggtatttagggctatagacttccctcttaacattgcttcagttgtatcctagagatttggataagttttatacctattttcattaatttcaaagaattttttttattttaatgttcacccagggattattcaggagtaaattgtttaattttcatgtatttgtatactatagattttttttgctatcaatttctatttttattgcactgtgatccaagaatgtagttggtatgattttaatttttttaatttattgagatttctgttatgagtaagcatgtcatcaatcttaaaatatgttctgtgtgcagatgagaataatgtatattctgtggttgttgggtggagtgttctatagatgtctactaggaccaattggtcaaatgttgagtttaagtccacagtttctttgttgttttgctgctttgacaatctaaggctgtcagtggggcgttgaagtctcccatcattactgtgtgattgtctaagtcttctcataggccaagaagaacttgttttattaaactgggtgctccaatgttgggtatgtatacatttagaatggttaagtctccttgttcaactgtactcattaatattatgcaatgcccttcattgtccttcttaatttttattggtgaaaagtctgtttcatctgatatagaaatagggacgctttctcttttttgttttccatttgcatggtagatctttccttattcttttactttgaacctgtgggtgttgttacatgtgaaatgggtccctggaagaaagcagaaggttgaatcttgtattttacacagtttgccactctgtgtcctttcagtggaacatttaccccatttacattcaaggttaatattgatatgtgtgatttttgatcctgtcattatgttgctagctggttgctatgtagatttgattttacagttgctttatagtacctgagggctatgcacttaaatgtgtttttgtggtagcaggttttgttcttttgattctaagtttagcactcctttatggatcccttgtaaaactagtctagttgaaaacaaatccctcaatatttgcttgtctgagaaggattttatttctccttcaattatgaagcttagtttggtgggatttaaaattcttggttgattttttaaggacactgataacagtctccctatctcttccggcaagtaggatttctgctaagaggtcttttgctagtctgataaagttacttttgtacctgacttgacctttatctctagctgcctttaagatttttttgttaaaaaaatctacatgccttggggacgatcaacttatctagctggggttatctgtatctcttagattttcatgtcaacctctctagtgagattaggagaattttcatggactacatttgcaaatatattttccaaattgtttattttctttctttctctgtcaggatgccaatgaatcatagatttattctctttacataatcccatatttcatagaggttttgttcatttttcccaattcctttttgacttagttgcttcaaaaactggtctttaagctctgagattctttcctcagcttggtctgttctgctgttaatacttcaaattatactatgaaattcttgtagtgagttttccagctttagaagttcagtttggttctttcttaaaatggctatttcatatttcaaatcttggatcattttactagattccctggattttttggatgggtttactttatcctgaatcttgatgagattcttgccgtccagattctgaattctatgtttgtcatttcagtcatttcagactggctaagaaccattgctgaggagctagtggacttgttagaaggggatactgtctttttgaattgtcaagagttccggaactgattctttctcatcagagagttttgatgttcctttaactgtagtataagttgagtatagtcagttgctttgtttctggatgctttcagagcaccagggctttgtgcaggatttttgttgtgggtgaattcttgggcttgttttcacaggtgtatatattaataggataattgttgatgctgtagtttggactgtgatcctgtagatggcacttaagagtaatggctggcagctaggctgatacctagtccctgactcttctacttcctagcattcgcggggaggaataaagatggctcgctcaccatgtctgctctcgggccttgtggggagccctctacagtcaccagcgctgtgcctcggtttcttttggtaggggttccaggccacgagcctctcttgggcaaaggttgtgacagggagatatgccgcaccgtttatgaaccagctcttcagagggaggcatactccactcctacctggggcccgggacccagcaactggcccctctcagtgttctgagctggggtttcctctcctgcaaggggggttcctcccctgcctgagtgctggccgcagcactgagctcttcactgcagccctggggaaccaggacatccgtggttcatggttgggttctagctgtgccagggtgtctgttgtgttcctgtgctgtctggaaagtactcatatacagcaacacattcagcagggccgtggaggctgtggggtgcacccactcctgcagggcagctaggcacaggccctgcgggggtcaggggacagcatgtggaagggtttgcagaacagatgtgccccggtcacatctgttgcaaagaaagttcagctctcttctggctcagaagtcagctggggccaatgcctctgggggagtggggaggcgggcccaagtgatgggcgtttatggctgcttttcactagagctgccagcacacaaaaactcctgggctccatgccgtctcaaggcctgtctctgcctattccctggagagatctcctgacatctcacatgtccataggggatgcagggtcccctgtcactaagttcccagaggtccatggggagactgaaccaaatctcatttccctcactcacccctctcccacgagccattagtggctgggaactggccctagtgatcaggtaccctaagtagggctgccagcttcctttctattcagcctcagtttcagagtcacatctccatccactatcagctttttctctcccaatatctgctcaaattatggtggctgacttaataatttggtctctcttggtgggagcagtgctttctggctgcatctagtcagccatcttgtcctcctgagtttactcatacatcctacttctgggccttctacttcctgggcttttacttccagacaatccacagctggctatgcataggatcgtagtgctcattctttcactcactcacttgtagtgctcattctttcactcactcacttgttcaacaaatcattattgaggagctatgatgtgccagataacagctacagttagagcagaaatgattctgcaggtgaactgggagacaaactctgcattttttggcacccaaatgagaaactccattcagcaagtgttgtcaattttagcagttagatattggattagaggatcccaagaaaaagaaaaaaaaacttcgaatacctcagtctttcttccaagatcaagaaatttattttagctaactcaccattcattgaggatgtcacacaaatgaagacattttttagactccactggggtaacaggatatacaggcaagtgaacaaaaaggcatgtcaaaattgaaatttaaaacttctgtttataataagacaaaattagtaaatctggttaaactcacattttgatgatgttttatttttacataatttcataaaatatgtatatgaatgtacatagatgtgtcatatatatgtgtgtatgtatatgtgtgaacattatctacataaatacacgtgcacaaacatacacacacacaaatttaaaatggtgttttctttccgtattttatttcttcttatttgttaactgtttttctctgtgcttaaaccaaatttttcacaaatttttacatgtattatcatggtgatagcccataatgacctttatgcttaaattataatgttaaatcatataaaatacaggattaagagttttgtttttgttggtcctttgacagacatgttagttgattagaagaactctaatattataacagaatcattttattatatgctgttaggtttatttcatgttttgaaatatatgtcatcaactagttttatagaaattacattaaagctctagagcggaatgttatttcttcacctatcactctggataccagatgcctacatagttccagagtttaaaataatacctggaggatttttaaaaccatgacttttataaacacaaaaagagttacctgagcaatttggggcccactctatgacatgagaaccacatacagattattagatgttgaacttcaacttgcacacgccctccatgctcatctatgtattatgtagtgcacttttgttgttaaatttcaaccactttttgttagcaactgttaaaattcttagacattcctgactcaataaaatatttcttctctggataaatttaaattatccactttatttactgttcagcgtccatgtaggttctatgatacactgtgcagtaatcattaaatcaagatacaaagaattctcagtctctcatacataatttggattttttaaatctacaagcataattcctagccacagtttaagagataataagtttccttagtgtgcaaaagttatggaatctatggaacttctagtgtatcactgctaaggactagaataatgcatagcatggagttggtattcaataactatttaggaaatgttaaagacatcttcctctggctgttttgcttctctgtgagtgtgagttgcattttaatattaattatctcattagacttgctgaatagtcttgagaattagaaaatacttattctaagattattacagttagtatgtggtacatctaacacttaaactttgggctgaatgcactacttggtacttaacaggctagattttggtgactgaatgaacaagcaaaaccatgaccaaatcaagatattctaaccaccaaactatattatttctatgaattcgtactgtctagtaggttagattgttttaaaaaaagatttttatggattgtttttaaatatagggacatgcccctttgcattcctacatacatccacttgcctaaatgcacacacagtatgctaatccccctgcacatattcacagagtattgggggaaatatgacattaatgaaaagaaatatgtggtctaaaaaacagaaagcagatgttttcgtgctcttcaatgtatgctttagcatacattttatttataacatctcagaagaaacagatgtaaatgataagatgagaagaaaagaagaatcaggataataaccaattacatgcaaggactttaggataatatttacatgggtagcatggaatcatagaacaaaattttaaaacccagtaatttatatgaatggacattacattcaaaatcccatgtttaagatgagaaagattattggttttacaggaacaagacaatattaggcaaaactgtggagtagactaacacaatgtttaggccaccttatttcttactcatcaagatctctactgccactcttaccttgctagcaaatacagtattttctcctaaattttactttttccaagaattttatttaaagacaaagccaatcactctcttgttttatttctactaagagcaataacaatgaccccatagttaccatttattgaatactgtatgccaaatatgaggttgccctttataaaatattctagtaaatcttctagaatagtaataataatgataataatgataaaccttctatttattcctcaattatgcataaggagtcttagataaattacgcaacttgtctaatatcacgtaactaataagttggaaagtcacatcctttgaaattagatctacctgattacaaagccacagtataaattaaaattacatcttggtactgctttgtgtgacacggattttaaatctgtgcagaatatgaaaaaataattgatttcatacataaaacaatttttaggtgactggctatctgattaagtctttaattttatgtaattgttcagatttttctgagggagcaaatggattgggaaagatagaaaggtattaaagacagctgcaagggctttggtctgagcagctgctcccgtttttggcctatgcaatgcaaggataaaataactgagatggggaaggctgcaggagtagtaggtttaggaaaaattcaagtgctcactcttgcacatgttgagtttgaggtttctattagtcatctaaatagagatgtcacatagccaggtggatatacaaatctggacaccacattagcatatagactgaaatttaaaagaccgaaatgaggtcatcaagaaagtgaatgcaaatagagaaatggtccaagctggaggccctagtggattccaacaattagagccctgggagaccagcaaagaaaaatctgtaggagcaattgctaacattggaggaagaccaaaagagcagtgtgaactaaattgctcacgttaatccagtaattaacctgaatatttctcagaggtcaactaagatgaggactgagaactgaccatcagattcaacaatgtaatctggctttattggagggttaagaaaaaaagcctgattgaactaaatttaaaaataaatgggaggagagaaattggaatccatattcttatgcaacacttttttagcacattgtttcaaagggaagcaaagaaatgggcagcccctggcaaagaaaggaggaataggaataagagcatgttgtgctgagggagaggctccaggagaggatgaaaaactgatgatgtaggatgaaaagtggataatcactagagccatgtccttgagtagatgagaagagaaagaatctacaagagaagagactggatttggtgaagaatggtactatctttaataacagatggaaaggcagagcatgtgggtttacatgctggtaattgtggtgatgggagtctgtgcacatttttggaaaatcaagaagccaggatatcagctgagagtattgttgggggagagaattttggatgtttaagaagtgaaggattcaattcaaggcttcagcatccttctctgtctatatcagtatattgtagaaataacatgattttctatctgtatcatgatgtgagcaagattgaaaaattgatctagtagaacgttatccacaaaatctgctaactaatatttccttttgagaggtcattttacctttttctccgtcaaattctatgattttatgctgatggtctcttctaattccaggccatgtgaccagttttatattattaggcaagtctaacaagtatattattaattaaaatgactaggtaagaaataaaggggttaaacatcacttagagagagaatgatcccagcaaaacttcatttttacatattgacactgaattattaagaacgtcatggatcacaaccacttaactggaaatgtaaacacctaaaatactatgatcaaatcacaattttgcagcttgctgattaggaggccatgtagatacagaattaaatttattacatcatggtaaattatgggcatacattaatttctttaatttgtctttctctacttgacattcaccacacatttacttaaaggaaagaaccataaatattaatatttcataataaattcagaaattcttattacaaatgctttcctttaatatcaaaagggcacacattcagtaacatgattacagtgctttagacagcattatacacactggcagtcacagtcatgcaaaattaatattaatttgattgaactgattaggtgcaaagagtcagatatttctctgaatgctgattgcattattattcactcaacaacccagtataacagtttaaagcatgggctctagtgtcaaagagattcaaattcaaattgccactcttctgctttctagatgaacaaaactttgagttagcttctctgagcctcagttttgttctctaaaaagtgggaattaaagtaggtttttaacttactagggcatttgcaaaaattaaaggaaataatgtatgtaaagcactttatgtcattgccaccctagtcactcaaaagaaaagaaaaaacttcatctttctaaatttatttttgcccagtagattgtgttgaatttgtccctttcttaattgtttttctcttgtccaaaattatcttttcacatttatccaagatccagctccagtgtcgcctctgtcatgtcatcccttcagtctagaggaatggttctttttattttcccaccactagtctgtagatcttttgtatcccttttaaggtctgcagtaggcaagttattcacatgttattgtgcctgccccttcaacttggagctcctagagaatttgaattgtgtttctcctgtttccacttgttttccacacagtagcctatgatacctgtaaacatgtagatcaggccactccatttgcctaatcccaatcctccaatagtttcctgtcacatttctgagaaaatccaaagtcttatccacagcctataagctgtacaatatatggccctggtcctctctctgtcctcactttatttcacactatctccttacacactatcctcaggcaacatgggtgtcgttgcagttcacaaagcataatgtcattgatacataaaagacctattaagtaccagctataagttgcacactattctaggcatttaggatacattagtgaacaaaatagacaaatattcttctgtgtagagtttccactgtagtggggagaagtgcagaaaaacatgtaaaaagtaaatgaaactgtatgtgacagtggggaaaggaaaatgagaagaagtagaggtggtgtggagggacaagaactagagcaaaggataaagggattcgtgagttgtgattttaaatcctccattaagtatgttttctcagggcatttgcagttgctgattttttttgccttgctttctctccagtccacccaatggttccctccaccagttaagtgtctgtgcaaacagaaacatctgtcaacacttctgagaggcccagtctaaacagtgtaaaaaggcatgcctccactcccacattacagctctctactttcttaatcagctttattttcttcattgcatttttactatgtgtaaatctgtgtgtgtgtgtgtgtgtgtgtgtgtgtattcgatgaggaaatatatttttttctgttttattaactgtttcattcctagtatgtaggaacagtttggcatagagttgtcaataaatatttattaaataaattaatgtaggtaatagttagctttagctaatgattattaaatttaaaaggtagagaaaactgaaatttactcattaatgtattatttctgaataattaaaagaactttcattttaaaacctgcttttgatacccatggcacttttttttttttttttttttgagatggagtgtcgctctgtcgcccaggctggagtgcagtggcgcgacctcggctcactgcaagctccgcctcccaggttcacgccattctcctgcctcagcctcccaagtggctgggactacaggcaccagccaccacgcccagctaatttttttttgtattttttagtagagaaagggtttcaccatgttagccacgatggtctccatctcctgacctcgtgatccacccgcctcggcctcccaaagtgctgggattacaggcgtgagccaccgcgcccggcccatggcacttctattcattcattaattcaacaattatttgttgagtgatattattcattcattaattcaacaattattagtcgagtacctataatagtctaggctttatattaagcattggaatacaattcaaaggacaaacagttattttttaaagtcattcttaattattaaaatgctctatctacattattataaaaataaaacacaaaaattgcttgtgaagatcaccacactgtctttgggttaaatcatcattcagtaacggccttagaaacttgattttttttgtcctatatgttacttactacattcttctctttggactacaagcgaagtaaaacatccgtctctggtaatgggttgggaacatgtgaattggcaaatgtgccttttattcttaggagctctggtcctgagtccaatgacactcaagtgattagtgaaatagatctataaagtgtggttaatcatacacgttagatatgtaacttttcaattcaagttgtcatacaacccagcaaaagcagtccacttaaatgccataagatgtaagtatcgttttttcttctctaaatttctacctggacatgacctgatttcaaaaatgtgcccattcaagagtgagtaggactagtttatatcttcacttggtatcaatttactgcaagatagtaaaaaaatctgttacttcctacttgggaatataaataaataatttttctggaacaataaatttaagtaagatcttcattatttttgcaaacaaaatgctaaatacatttttctggaacaataaatttaagtaagatcttcattatttttgcaaacaaaatgctaaatacatttttctggaaattttagagtttctcccagttagataaaatgcaaacacattggaaaatgtaagctttagctactcagctgttaaggtttaatattcctgatactcagctgcaaaggtttaatattcacgatactaaatattcacaatatttccttgtggtcacaaacaaaataaatctgaccatttaagaagaaaggcaggccaggcgcggtggctcacgcctgtaatcccagcactttgggaggccgaggcgggcggatcacgaggtcaggaggtcgagaccatcctggctaaggcagtgaaaccccgtctctactgaaaatacaaaaaaattatccgggcgtgatggcgggtgcctgtagtcccagctacttgggaggctgaggcaggagaacggcgtgaacctgggaggcggagcttgcagtgagccgagatcgcgccactgcactccagcctgggccacagagtgacactccttctcaaaaaaaaaaaaaaaaaaaaaaagaagaaaggcaattctagtagagataagttgactggataaataaaaaataatttaaaaaattaagactggcttattgaaaaacaataaaaacagatgtatcaaaagtaaaatatgctacagctaaatcataatttacagttttaaggaaaaaagtttattccaggaaaactccaaacaataatgattcacatcgttcaaaattttcctctggatccagaagggatgttataatggatgttttaatgcatctttttttttgtattttggtaattaaactataactaaaacccagaaccataaagatataaacaaatgtccaaagcttaaggtgagagacagccagaaaggcatattctggggccagagaatgcctaacgaaccgtatgaacttagatatctactactgattttaaactgatgatgtaatatcttgtgctgtcctaaaattagcagtgaaaatctgccttagtgacacattggggaagaaatgcaatgggatgcatttgtgcaaacattaaagaggctcagcagaggacagaatctggtaggagtggggctgagattatctaaggtaatcagaattgagcttgaagtatgaatctgaagtaaaaggtttcaggcaaatgtaaacattcctctgacatcttctaaaatattaaggtcactgagatacccatgtaaaatcaatacactgtttagacattaaagggaaaaataaaatgatgttccaaaagtcatggattcatttaccaaatattttactgagtttctaaagctatatgaattggtgtggaatgaaatgtgagcaaaacgggaaaaaaattgtcttcataaagtttatcttgcaatagaataaataaccaatttatatatcatggtagaagaaatcagggagaaaatcagagagaaggagtaggggagttgaaaaaatatcttataggtaattagggaacccctcaatgagaatttaacatttgaacagatatgaggtgagaaagggagtcatagagggctcaaagagcataacaggcagagaataagatgcaaatccaaaggtgctaggtaggcagtatagctagggtgtgactgaagaagaaagaggggtttatccaaactgagtaagtgagcaagggagtagtaggtggtgaaagcagagatataacaagaatccacattgtgttggttcttgcatggcattaattggacattgatttttattctaagtaagatcagcaagcaggctgaatgaaactttggaaggatctgagcagtgggatgccataactgaataaatgaccaagattttgaaaggatcattttagcttttggattgagaacagtggatgcagagggttagttagaggggaagaagctagttggccatgtagatgaaagctaattgtggtttatacagggtggcagtggtgaaggtaatgtgaggcatatctggactccaaaaatattttgaaggtagatttggatatgagggaaataggagtcaaagataactccaataattttcctaaagaaatgaaagaatcaggttgtcatcagctgagatggagaaaactacagaagtatcaggtttggagggaagatccagaactcaattgtcaacatgttgagtttgagatatcctttagacatatacatggagatgtcaagtgggtagctgtacatattacctaggatttcagtggagagtactggctatagatataaatttgggaatcctcagtatatagacttaagggagtaagtatagggaaagaaaagaagaggtccaatagctgagccctgtaacatcccaatatgaaagaccagaaaaataaggaagtagcaaaaaatcatattaaaaggaggggccagtaagcattagacaaggacttggtgtttcaccagtgaagcagccctcttttaggctcctgactgaagcacattcctccactatctggataatttggacagcaatccagatggaatgagaaagaaggtgatgtttcccaggccaacccaattgggtatatcaacttgggtgaccaatgaagtgacaaattaccacataataatgttcatattctgactttaagcataataataaacaacatgtgcttgcaatttgatacagggctcaatagcaataccccaaatcatttggagtgctggatgtcagtaataaggaaaatgatatagcttcctagagtaaaattttgacataagcctgtgcccagtaactttcaggtttttttcctcagcataagaatgaattttcaattaaatttatatgtagaagctcaagatataaggcatataacagtggaatgtgtttgtttgaggcagaggtaaaggaaaaaatcagaaaacagcctgctcagagttcccactggagctatccttgaagcatctggacatatccctagagcctgggtaaagcttatgaacatagctttaaaactaccaaaatcctaaaaagaaaagagttcagagatgaaaataactgatattggaagtactcagagaaggtttacatagtattcagggaaaacctgaacccaacagaatagaatgtgccctggctttcatttttatgttcctccttctgcccctacccctcagattaaatattggttgaaatacctctaaaactacacatatcatcatattggtgataaccagagtcctttagcaacaatttgaagtagattttgtttaaagaaaggtaggaaagttatagtccagaagaaaattaaactgatgtgagtaagaatatacacatacagcaaggtttacccattataggaaaacattaactgtatgataagggggaaaatgtgtttacatgtttttggttttgcttttcagaaagagaaacaagatagtgactattctcttccataactatcttggggaaagaagaagttgaaacaaaaagcaggcataataatgaatctacaatgatatctgatatgtatctattttaatcaaatggaagattagccttccagatagcattaaatagaagtgtgactaggaaaataatcttgtacggtccctcaagaggaatatgccagtttatttagagatgtgagcctttcaagaggcatccaaaatagtgaaaagagagatgctaaaaatgtataaaatcaattaaaaagagagaatacaaataagtgtcatgagaaatacaaactggtattaatagtgctcattaaaatgatgaatatcttaggcaattttcatgacctaaaatgatgtatcattggcctcatccatctactacctagaattgggacacatttgtataagactgaaagatgtatcactagtttacaaatataagcagttaagtgatctccccaaaatgttggggtaacttacatttagagtgtaggactgtcaccgcttccttttttcaaagcacatttgtaatatattcatgattgtatccttatagttgtgtgggtaaagttccttaaaccagacacttgaaagatgaacaaattattacgtgttagctaaggatattatgtttttgagttttgagtttattttgaatagtaaagtattagcactcaattttccacctaagatatagtgaaagtaagagcatgatactggggtcaaaaagggcaaattttacttagtattcttttatctcctataaacaaggcagctacattttgggtactacttaaatagctgcaaaaaaacaaacaccctacaacaaaaaataattttcattattttttgatcagaaaattatgccaacaatcctttatagtaaattacctgttatattattttgtactaaacgttttttgcaattaatctgtctttcccttgccagaagaaaagatcccatgtgaaatggtgaataggaaagcacaggtgcaatgcaaggaagaggtgttttgaaaagtgggtctttacatctataagcacttaatgtcaaaagatgctcttcttagagtagttggcatctatgtatatatatgtataaaaccttgtatatataatccagatgcttgctttatgttacttatatgtcaacttgtaaattgagaaaatatagagtagattcatacagttaatctctatatactccattccttaattattaacttcttaggttcaggaccagtccaatcctataatctgtatgttactctagcattaaccagtcccaggtcactataaaatatatatactgattttatatttcactataaaatatatatacttattatatacatatattatatgtataattatagtgacctgggcatatatatatatatcatacattaatgatactatatattattatatgtataatacatattacatatgtataacacatatataacaaaatatatattttatagtgacctggacaaatatatatatatcatatattaatgataatatataattatatatataatatatattatatatgtataacatatatataacaaaataatggttttgaagcaacttggatggagctggaagccattattctaagtgaagtaacacaagagtggaaaaccaaaaactgtaggttctcccttataagtgggagataagctttgagtatgcaaagccatacagtgatataatggacttcagagactcagaagggggagggtggagggtgaccagggataaaaaactacacattaggtacagtgtacactactcggggaacaggcacactaaaatcccagaattcaccactatgtaattcatccatgtaacaaaaatccacttgcaccccaaaaactattgaaataacaaaacaaaaataaatcaatacatacattgctaaaaatgtatggcagtatgggaaatgtcactacgatccctaaataaactgattttattatataaagactatattatacacacacaatatgtttgtatgaatagatataaattatacatatgtgtgtatacatatatacacacatatatatatctgtatgactacataagtatgctgtatataaagaacagcatggatgtcagaaatgtatcttttcagctcatgagaatcatgaggttcctagttgctaaaactatgtacttacacactttaaatggggtcatgatcagggcctaaacatattaatctctgtaagtcaaatatgtcgaggttgtctataatgtgtttgatttgcatggacatgtcctaagcacttggaaagagttgtgaaggaggaattttcacaagacaaaaatcaaaccacatataataaatagtatgatatatatgtgatgacctgactaggaatttgatggcatgagttgaatcctggctctgatacattgtgtagttgaatcctggctctgatacattgtgtagtatctattatgtgtcactaggtaagatacttaacttttgaaatcatgatttctaaggctgttaatgaattttaatgacacaaacctgaaagaaaagattcttgcaaccattatatttggacatctaatttaaggataattagtattgtaggtattaaaataaaatattgattgatttcatttatatattacctctgctaccctccaacatttttctaaacattattataatttcctgatttatttgcccttccttctacttttacttcctgtagctattttatatattattaaatatattataaatatagtatattatagtatattatttatacataagatatagtatatagcctttggtgtttgtcaaagagagagaaatgatgcctaagtcacagaaagagaaagggataattctcaataacaaaaattgtcacatttccttaaaaaacctcaaccacagggctctactaagttgacagaaatgtccagtttcaaaagcaaaatatataaagctcatatttgttattccttttctaaatttgattcataggtcttcaagttatcaattcatgctgttatttacaagattgtagattaactttacgtatatttcctaattaaaggaacatcaaactacgtagaggattcatactaggttaaaaaaaagggggtgggatgggggctctaaagctatctaaaataataactttctgtaagttggaaaataaactattttcaagctttttatgttgttcatcaaaggaatattttcttctaaagtggcctattccaacttataaaaccccaaattttaaggctacattatatgatctgaggcatcatccaaatataattgcatgatatatttgatccaatattattaaaaccttattaaatttaacaaatggcataatcttgaaaattaaggcatgtaaccaaataaacacaatgttgggatatgaatagaatttatctcttgtgctgtttgagtcaccctgcagtatgtctggtaggatgggcaaagtactgcaaacaatgacaaaattaataaaactggaattgtgtgctgcacattatgttcttggcaggaaataaggtgatgctattataaaggacacctgcttccagaaattcaattagaggactctactgcattattttcctaggaacaaaagttaaagtacattttggacgatgtgtattattttggggattgttggggtgagatgttagggtgagcaaggatttttgaggtactcagtatgccaaatcattctttattctctagacactttttcatcttgatgtaaaatttaatcattttatactacactaccttgaatcatagagaaatacacaaattagtaattgatctattttacctatcaaaactattttaatccataaaggatacttttttgcctcaggtctcatttgatgtgcttgaaagcaggtaatggtattatcaatgattatgcaaggtctcaaaatccatgactatctttaaaaagcaagagtcattttgatagttgaaagaagaatgatggttatcagaggctgacaagggtaatgggatggggagggacaaaaaggggctgataaatggatacaaattaaaatgagcatctatttataatagataataggaataaaatccaaagtttggtagtacaatagggtaactgtggttaacaataagttattgaatatttcaacataactagaggagtgggcctaaaatgtttgtaacacaaataaatgataaatgtttgaggttatggatttcccagttagcctgattttatcattatacattttatacttataacaaaatatctcatgtaccccataaatatgtgcaactattatgtacccattaaattaaaattgttttaaaaaacaaagaatgtcactctcctaggaaagtactgacagtctgttgcaactgtttttccaagacatcattactagaaagatgtcatctgattcccgtgtcacacatgggatatatctattacataactctcaataccacaatctaaagggcaatgtagacattaatttgtctcagttgattttccagtttgaaaaaaattgaaatggaactcttttatacattctgacaataatgctaagttcatgatccaagttacctaagacgcacatattaaacgttgcagaggtttttccttggaatttcaattactttcataggttgccctcttgtggccatctgtaaagctactaacaacaaaatgaaaacattgtatgtctttttttccatctagtaaatgcttcgagggtttgttaacacatggtatcttaaaattgacttaataatatgtcaggacaaaattgaaatgaaaaatcttaaatatgaattatagacaaaatcttgattgctgaaaattcagtattggctacaataaaattattcaataaatacaatacctaagtatatgagagtttgctatgattatttattaatttttaaaccatgggcattcattgattcatgaagttgatataaggctttcatttcctaaaataaagttccaatgttatacttcatataatttcaggagaaaggatattttaagatatcataagatgatttaaaaaattctttttttgaactgacatatttaatcaaccgagcacctctatcatcaaagatggattaagtaacaacatgaatacaatcaggcatttaaggtattaagcatcaattgatcccaagctacctatttaagctttccttatttgtaaaagaagtttgagccacatgatctcgactaaatccacaatccactttcttttacctttttttttttttttttttttgatatggctcactctgtcacccaggctggagtgcagtggcgtgatcttggctcactacaacctccaactcccaggtttaagggattctcctgtctcagcctcctaagtagctgggactactggcatgcaccaccatgtctggctgattgctttgtatttttaacggagacggggtttcaccatgttggccagcctggtttcgaactcctgacctcaagtgttccatttgtcttggcctcccaaagtgctgggattacaggtgtgagacaccacgtccagtcataacatctactttctatgtgtcctacttctagttagcaagaactgattagcaatcaatagctcctttctcttttttcttttttcacttcctccaactgatttctagaatgcaagtcaaaatatctattgagtcctctttgtttgaagctgctgtttcctggtcacatttgcaggtttcagaagccattctttttagagcaaagggatccaattgcacataaggcctatagcctcctgttgttttcagtgctcaaatactcaggagtggcccagagccaatacaatggaggaaaaggaccacaggcagagagatgctgagcacactgccctgggtaatctaaattagttgacctttctacctcttccagaagggatatgtgccaaaagataaggtaaaaccagctcagtatgcaccatcacaatgagaaatgaacataaatgagatcatacgagctttgaaaatgtttatgtaacaaggattcaggttatttatatataatatgaattttttaattgtataatataatcaattactataaaaaatttagattccattgaatgagcttcaatattatattctaactaggtagaaatttaaaatgtaggaatcatttaaaatacatttttggtacgaaaagcctttaagattaaaaataactgattaatgaccactacattttttcagtaaatcaataattagtctttttaacagttagaaactctcttttaattttttggggttgggggagggctggatctttcatcttcaaacatcacctctctcatccattcattaccatctatactcaatgccctctcttccacagattcaggtttgtgattaatcagtaaggaacttatggaaggagtgcttaataggtcacagagctacccaaaacctgagaaacctggcttggaaaatagaaacaaggatgaaacgcttaggagtaacctggatcacactaaacattaacctttcattccagcacccatcaagtgaggacacttgtcacagaacactaaatgtcactgattttccaacttccactgcaccctacatggtcccactaggccctaggtcactgttgcctttaagaaatgaacactgctgttgttggtgagccactacacaggatttctgtgatgggcagaattacggcttctcaaagaggtccacatcctaatccctgaagcctgtatgtgttactttatatggccaaaaaagtttacagatgtgattaagttaatgatcttgagattgaaagattatctgggattattcagtggtcccaatgcaatcacaaagtttcttataagagagaggcaggagttcaagggtgagagagtgatttgaagatgcttatcctgctggtttgtggctgaagggaccataaaccaaggaatgcagggagactcttgcagttggaaaaggcaaacaagtagattcttccttagagtctccagtggaacacagcctggctaacgctatgattttagcccagtaagaccaatttcaagtttctgacctccagataaataagataataaagttatgtagttttaaactataaaattatagtaatttgttgtaggtgcaagaggaaacatgtacaattgcccaatgcagatgcttctttgatcatcagctttcaactccagtccttattgggtgcatcagacttgccaggcccaaaagatgcagctactccctaactacaagaaaggctggaaaaagccagtatttttgtagcttctatagaacatacaggttacacttcccctaagaagtatatgatgaagaattccctgaggatacggaaggtattgagaagcccctcaaaaggacaaatatctcctattatcacactttcttattatcattattctttggactctgatataatcagcttttggaagcctaatagtcttgtcctgatgactctgataaactatttccattccttcccagattaataccttcaacagctcaaagcaagaccaaaaaacttcagaaactaagacttttgatttagctctcagagataaaggctaatttctacggtagctcaacctagatctatttcaaacataatataaaaagaaaaataaattttttctatataattgcgtaatgctttctttaaaaagaattgtgcttccaggccctgtaacatttttatgtaaagatgtctatggaaaggctatatatatatatatatattttttttttttttccagacagagtctagctctgttggccaggctggagggcagtggcacaatctcagctcactacaacctctgcctcccagtctcaccatcctcctcccacagcctcccaagtagctgggactacaggcgctcgctaccatgccaggctcatttttgtatttttttgtagagatagagttttgccatgttgcccaggctgatctcaaactcctgggctcaagcgagccacctgcctcagtttcccaaagtgctggaattacacgcatgagccatagtgcttggctggaaagtctatcaaattttttaacctgattcttattattagatattgattttaatgctactagcaatgttatcctaacagaacatttccagttattacagtgaatataaaatttggattatggaattgaatttgttggtgttgtctgatgaaaaaaaatactgctcaagagtcaggatctaaattctggaacattgaatgaatgaatggccttgtgaaaattaatttttttgagcccagttcttcttaatcctctgtcttacctaaccccaagatccgatgatatactaaaaggaagggaaaacaatttaaaaggttgtataaaattataaattcttatatagaaatacagagaaaaaaggaaagttcaaagtatacgtttttcattctattaaaacatttcttctgttgatacatggggatctaactcaagaattctagaaccttgaaattggaagataccatttcaactaagttgcaacataatttccacagtgtctactattcagtgttcatgcttctgtaagcgagttcatcatttgcaaatatatccaagagcaagactggctctgacctattggacttacagtcgccaaacacctcgcctcaagtataaagtgatagtaatcatcatattttcctcatgggttagtaatgtgtgatgtagtggcatgacataatgcctttagtgacttggcatggcatctggcacacaataactatttagtacatcttagctattaatatcaataataaggacaaattaaatatgtattaagtgtatagcatttgtatcagttcttggggaaatatactatgttcacttattccatatattttacttttataaaccattaacatatacaaagggcaggtatttttaaatatacttcttatcaaaatacaactttagaaaatattcattaacagaaaatgcagaagtgagaacttggtttgtgttttataattttaagtattttgtagaccatgaaatactctcaatataaaaggaaggtaaagaaatcaacagtgtcataaactacagttgtattttttttattatagtaatcacagacatcaccccaaatcattctgtaaatatttggcaatgctagttttgttactccatcagatgaaattattcaatttcccttaaaaatcatccttacataatttgaaaaacatataatgaataccactatatatatatgtaaatatatatatgttgtagatattgagagacacaaaatatcatctcttatctagaaattttcaagtgtacattgcattaaaattcttaaaatgcaaaagtagtttgcaaagagatcaagtccatatatacatgtaatagtttgaatgaaggaaaaactctatattgagctgaaattctttgctccttcattcttgccctctttgcctttccaattctcttgctgtatcattacctttctttaactcctggtaggaattacacaatatgtttaatttctcacctctgtcaggaataagaaaggaaatatgcaagctacaaatgcagtagctgttttagtgtctgagccaaaaaagcaaatcaggatgtgtataaggggtcccgttttaactggcaaaagcaatctgtgtcctgaggggatttacaaggccatggatactctgagctgctgtactcttctgttcccagccctgtggaccctggcattctgatagggctctagtgtagttctccatatactgattttcagtggcattggagcccatactgcaatctcagcttagtttctgcctgactaggaaaagtaatgattactgtcgttgaatcactctgcgttatatccacttggattatcacattgaatattcatgcccacccttttgatgtagtaaaaacttgatcataatcacgtctagtaaatgatgaatgtggcatttgtgctcaggcttctgtctgacttcaaaatctgtgagtgtggctatttttattacaatgtccttccaccttaatggagctataggaaaaggaaatattttacaatctcatacactttgaatacatctgggatttctctttcttatccaaaagatacaagagtagcctgcagagaggcttagggatgactagacagaaagagtattgaaatatttaatgaaccacatgctggagtcatgtgctaggtacagggttgggtactggagatttggtgataaatttttcattgtccccaccatttagttgctggcaatgttcttgagaggcagacatgcagacaatgtgatacaacatattctgaagttcacctggggacccaggcaagacaactgcactataatcatggctaggttaggcaggacagcaaaaaaaaaatacccaaagaggcaacttctaaattggtcctttaaagttaaagaggagcttgccaggcagagaaaggaaagttagatataggaatagaacatttcaggcaggagaaattttatgagcaaaggaaacaaactaaggatcgcatttatatagtgaaaattggataattaagtagataatgagattaaatggagaatattagacaagataggagagtataaaattagccataattccttattaggatggtatttaaggtaattttgtttttgttttgtgtttggagcaggggggagaggaaggtgggtaatagagaggttgcttatgtttatattaggagctcaagaaaatatgtgccaaaactgagaagaccaggtacttaaaactctgtcagacaatgctttggcaatgcttggaggtgaacagctattcaaaagcactctcttgtgttaaactggtgttaactttgtaatggcttaaaatataagttaaaatgttacattaattttttccagtaatgcattttttgtttgcctcacccaatatagatccaaataagagaacttcttgcatttccagaaatgtctgtaacattgcaatagcaggttttgttctcatgggctgctctgtataattggttagtttgaaggttggcatctttttgtagcttgcaatatgaattttggagctaagggtttaaaaatgtggataaggcaagacgtcccctccattctttctcgaaatgttcctgcttcaagtgactaatcctatttttgtaatgaaacgagaatgatttctgtaagtttattttgtggaatgaaaaaaaatgtttgagctgtttcattttgtattctttaaagcacagagcacgtttctggcctttggttgaactgatgaagcatcccaatccagctgtaactttgctatactgcagagttggaaaatctgtcaatatcttcctgcaagtgagctgttttcatgtcttaaacatgaattttgtgtggttaaaatcagttcatcacaccagaggcttctgtattgacctcttgtgaaaagtggaataatttttcttgaaggaacaatgctgcatattataatacaagtttcagaggcattatttgaattatcataattagttttgagaaccacatgaggcactgtgatcatttttgcttcaaccattaaacataattctgaaaattccagaggtaaagagaagtctatattatttacccacattttcacccttgcttgtttttttcttcttttctggtgttccaaatttccttcttttgttatttcccaatagtatgggtaatgtgtcctttaaaattttccctaaatattgtctttatcaaagaacactacataatagctctaacttccaacatatcttcattgtcattaataggtactaggagacattattttaaaacatcttgcttgcttctcagtatgtgatacaaaattaggattttattgctgcatgattggctcagattttctgatgtgagacaatgggagcaacgatgaaagtgtttgcattttattctaataaatttcaaatggaaaatctattgaaatgtcccctttccttctagaatctctactgcttatctgtcaaatataaatcaaggtgggcatactttagagtaagaatctcctgaaccttggtgactttctttataactctctttgcattttaggcagtataattattaaatttgttgctttgacttcaaaaataaataagagctgtcactcatcaatacacacattattctattaaaggaatatatacacacactcactgtttcacttactataattgtataaaaatatgtgacagaaaataataattttattaggtttatggattctttgggtcaagaattttgaaagatcacagtagtgatggcttacccttgtgcaagaatgtctgtagcctcaaccaggaaatcatgaaatgacctcacacctggggtctacagcctcaaccaggaagacatgaaatgacctcagacctggcagctgaaatcacctggaggtgtctttattcagatgtgtggtggctggtgctggctttcattggggactccagccctgctgttagctggaacagcaccacacctgacatgtccatgcggcctctttgtatgtattagtttgagctccctcacagaaaaaaaagccaagtggaagctagattgcctataacctagccttggaagtctcctaacataatttctgccgaagtcacaaactctctcagatcaagttggaaggagtatcaaagtcacactttaagaagaacatgtggaataagagatactactgtggccattttgggaaaatgcaatctctctctctcacacacacacacacacacacacacgtgaaatgtttgaattttagaaacaaagatatcttgtattagtatttatttatgcaaaacattttaccattaatctctacacctacttagatttctatgttttttaatctttttttctgtttctgccaaaagtaacactcactgttaaatgtgaaagaatatggaaatatgttacaaaataatctttttctcagtcttcaataatagcttttgatcctatctcatacctctgttctatccctctagacattaatctctattggcgccagttaatagtcctcaaacgtaaatctgattgtatcaatcataactctctgattttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgctaccacgcccggctaattttttgtatttttagtagagacggggtttcactgtgttagccaggatggtctcgatctcctgacctcgtgatccgcccgcctcggcctcccaaagtgctgggattacaggcgtgagccaccgcgcccggccaactctctgatattaaaaaaaaaaaaagtaaaggaaaagagacagctcacaagattattttccaaatccttagaatgaaattttggtttgttttgttttttgttttgagacagagtcttgttctgtagctcaggctggagtacagtggcgcaagctcagctcgctgcaacctctgcctcccaggttcaagtgattcttgtgcctcagcctcctgagtagctgggattacaggcatgtaccaccacgcccaagtaaattttgtacttttagtagagatagggtttcactatgtgggccaggctggtctcaaactcctgacctcaagtgatcctcctgccttggcctcccaaagtgctgggtagaatgaaatttattaagacacttcaaaattgtcaaactacctttgttccatttttcttaaaatggaattttctccctctaaccattcattgttgtataacttacttcctaagaacacatcttataatttaattactctatatcttttttttttctttttgtgagacggagtttcactcttgttgcccaggctggagtgcaatggtgtgatctcggctcactgcaacctctgtctcctgggttcaagcgattctcctgcctcagcctcccaagtagctgggattacaggcatgcgctaccacgccaggctaatttttttttttttttttttttttttttttttttttttttttttttttagtagagatggggtttctctatgttggtcaggctggtcccgaactcccaacctcaggtgttccgcccgcctcggcctcccaaactgctgagattacaggcatgagccaccgtgcccagccaacaatttccttttttctagattggtcttccttttcctaaactgtatttccctttatctacctgtcaaatatttggattcttccatacctaactcaaggtatggccatctctacccctacctcccctcacatggaatcatttcatacaaataatctttcagaacttacagcattgtagcatttgcttacctgcctgattcctctgttacactatgagccttctaagggtaggaatcaagcactagataataacatttgttcatccatttatactgagtatttatatgccatgaaagatgattagccatggcaactgatggcaattggttccagtcacctcaaagcttgtaggctaatgtggaaaagagacaacagtagacatattttttctttgtcctgcacatgtatcatgtgccatataccatggtctactcttccacaaaaaagcacagtttcaaattatctggttttattgaaaacaaagaaaaaggacatacatatctttaaaaggtataggtatagattttaaacgagatataataataaaatacttactccctttccacgagctatacgctatcttttgctcagtcacagaagaagaaaacttgtattctttttccccattacccgactatttttcctagttattgcttcaaatgtcctctgctttgaaatttatacatcactatttattcctcattattcttccttcttcttgtcatctcatccttttcccattcctccctagtcacttatgtcatttaatattgactttaactcttgaataacttccttatttcagcatcaattcttatcaccaccctgtatgacttgaaaatctactcaagatcatctgactgcatggcagaactatttactaaaatatagaatgtaggagaaaaataagggtagtaatgaatttgtacttcaaggtcttatgtgccatccaagtaaagtggatctagagctcagaaaaaaacctaaggaataaataatataaatatttatagataaagagataagtttatcttcctaggaattgataattattatagctacaaagagagccataagttagatgatttttatgaagagagaaaagtaaagagttgaggatgaatcttaaagcaatgtttctttgatcaatataagatgaatgcaagatgatcgctttataaatttgggatatgtacataaggatttcttagggttctgtacctagtatggtaaaatagagactgtaatttcagattttcttgttttgtcataaattttctttttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctgttttgtcataaattttctttcccactttaatatacttcagaaatgtctttccatatttcttctctagtgtcctgtcacttttcttttccttcctttgaaggaagtacttgttattaagggaattgtccaaagtctttagtttgtcaaatatgaaagccagtaatcttgttcatcactcagtatctctctcatgaagaaacaaaataaaactggaaaagcaataacaactaccagatgagtagtgtaggagtatgcttaactagcatcaatttccccctgcttttttttcttttaaaacatgttgctctagatcaaatttccaaataccatctgcaagaaaaacaacatttagcacatctctgacaaaagaaaatagaaactacaatagaacattcactcccaagcctagaaatatccccaacatatcaaaatactacccacagcctagaaaaataaaacacaaccacccacatttcttcccacctccagcatgactcaaacacacacattctttttaaccacaattacaattacaaagaacatctactcggtaaaaaaaatatatatatatatagtattcctaaagtcagcaataaaatataatgtattatgcagttacaacaggtgaaatgtttttagatttaaataaagaaagctgagatatatgtgtttttcataaaagttataaatgttttcttaattgataaacaatatcatctttcacataatatatgctaaatcaatgtcttttgaataggactgaaaataacgatataatatttcactgtagaatttgcattgatatcgcaatactaaattatatacgtgaggacaaggttgttgataatctagacaacctctgccctatggtgagccatacaggaaagaatctccatttaagaagcaaaacacatcaccctaataaaatgaatataagtttgcttttgaaggcagcagaagatgccaaaatttcttatataaattgaaattattatttatacctgctagtgctacgtgtatactcacttatgaggaaggagtgttagtttttgaaatatttgaagtttcggaaaacttagctgtatttaatgaccctcaaatatgagtatgattatacataaacatgtgtgtatatgtatctaaatttaatgtctgtgtaacatttgaaggactatcataaaattttggagtgatttatattatgaatcctgcatcttattgttattcagtgaaaatactccctgaagagttctttacctatacgatacattgcaatgtgataatcaaacacagaaagcaggagatacaaaagaagtctgtagaggaataagattctaacagttggtgatgataggagtgactagaaacaggatgagccaaaactcagaacgacaaacaacaacaaaatatcgtcttatcctacgtatctaatcacacttgccaaataatcataatttaattttcaaaattcctcaatatttagttttggctgcttgctcttttccttgcacagacttttgctccatattttctttattcacaacttttcaactatcttcttgatatggggatctttatctatgacttctatctaaaactccagtttaaattttctagtgccccatcatccatttccattgacagtacaattaaactttgtcgaaaacagaattaatttcaagcgagtttttccttctgagatgtgcttttgttataaccaggatactattcacaatactaccaagaaaatataaatcctaaaaataataaactcatgccattttgagcccctagaacattaagtacatagttatttattttgcttgcattatttcataatgctcctaatcacccaatgagctagcaaccatcatttacagtttttttttgcaaatgaagaaacacatgagaccttaaaaaaaattaagttgtttgcataagcctagtttttagggaagggaattggtgataaaatgaaatcgattctttattgatacataattgcacatatttataggatacatgtggtatttttatacatgtacataatgtgtaatgctcaaatcagggcaattaaggatatccataacctcaaacgcttttcatttctttgtgttgggaacatttcaaatcttctcttccagctattttgaaatatataacaggtgttaaatatagtctggaatgggttttaatcaaggtcaacttcaccgcaagtatttaaccacataaattttattatttctcattaactaagtcacctagttaaaataatttaactaggcttttctccctttgtcacttatttcatagattccaaatctcattgattattatctcaccatatgtagcatttccacttccatggccacaattcagattacagcaaattacaaaagtgaccacagttctttactgatctgcccattgccaaggtacgcacaccttgaatctaacctgtccggtgattgactgtggcccaaagaatgccccagaagtgaggctgtatgagttctgaatctgtgtctcaatagattttcatgccactgctctcagtctggagccacgggccactgctgcctattgaagacacctggtccagcctgttgggggatgaaggaccccacaatatgatgagtcgtctcagctgaaccattttagaacagccaggttccttgatctgacaactgaccacagtcatataaacaagcccagccaagttcacctgagccttgcccacatcagcagaactgccctgtagagccaacctcaaattcccaccccatagaatcataggtgaaatgaatatttactattttaaaacactaagtgtctaaggagaactaagtgtcagggtgtcttattatgcatcaaagtgtagcttatccattcaggaaaactctgctctagtcaaactgaacttcttactattctcccacttttgtacttgcatactatattttaacactttcatattcttgcattcatgtgttactgattaaattcattgaatattttatcctatcatatgacacaattctagttatccaaggcttgcagtatcaaataatggagatgatttcaatgatttatatcattgttatatatatgtagatatatacatgtatagataggtgatagataaatgtattgatatttcaactatatgatttcaattatatatattttatctcaaagactctgttataataagacttatacacatatatacacacaaaagcttacatatctgaaagttaaagaggtaaaacaaaaaagtaggaaaaatagcagattagctccagttatagaacaacttctatgcagagttatgtaagattttatgcagttattttatctctctggccttagcttttacatctgtcagaaaacttatcaccctcctatgttcctatttgtaacaaaagaattttcttggaatgttaataataatgttaataaaaactgaaaatatatgcagttccttccatgttgcaactattgtactaaagaatgctgtgtaatgtccttagtacagtgttacaataagggacaatggatataaaacaagcattgccccttattataaaagtataataatatatgtaatatatatatacacacacataatagatactatatatctattatatacatacatgtatgtatctattatatacatacatgtatgtatctattatatacatacatgtatatgtatgtatgtattatatacatacatgtatatgtatgtatgtattatatacatacatgtatatgtatgtatgtattatatacatacatgtatatgtatgtatgtattacatacatgtatatgtatgtatgtattacatacatatataacatgtattacatatgtgttgtaagaatgaaatgaacatatttatgttatatacacacaaatgtaaaaaatgtgtatatataacatatgtaataatatatgtaatatacacacatatataaattatatatctcttatgtgtatataatatatattttatatagtgtatatatctatgacatttattattacatgttatatatacacgtatatattttacatatatgttatatgtgtatatatatttcataaatatattcattttattcttaaaacatatatatccaaattacttaaaatatcattataaaaataaaatatactatcattcaacactcaattcagttggttaaaagtcaaagggattatgatttgaaactcattcagaataactgtcacatatctctctgaaggataggttttcaatagacatcaagaaactgaaaaataaacaccaaagacccctcaaccactaaaatacttttgcagacaccttccctataatttctattaattatcctgcataatgatttctagtaattacacaaagtccaataagtctacagcttctagttctttagactctggaatactttcattagatgcaacaaattatgaatgaaaataagtcgaagtagaatgtttacttgaattacatttggtaataagaatagagagataaatattgttataaccaatcaatcctggtgggcaggattatttgagttatggatcttgggaaaaaataacgatatacaggttggatgatgtgacagtgagatggtttcttatcagactgagtaactgaatttggagtcacctgaaggtaggttatcaaaatcaggtggggaaaatctggctcaacaaaatcccatgtttaaaacaatatataatttcattataaaatattttattattctgcgattttgtcgtagaagagtgatatgacttgaggtcttcaagtagtaaggtaatttggcattctaaagcatagagtgattttaaaagagataaaatcaatgttccttttctgtttggggaagggctgttttccagttctgagcttcccattaaaagaggaatagcaacaaacttttccccaattttcgaaagcaaactgagatgaattgatgtcaaatgggaaacatttaaaagaaccagcaccttgaccaacaaaaatgtcaagtttttttgaattaaattccataaaatgttatgtgcattaaacatatgctgttaaaaatacagataatacaccacagaaagattctataaaaataatcatttttaaggatacagtagtgtgttgtattataccttttacattatgataaaatttacttttgctagataatctatacctcagtatgggtaaatgatgcattactatattctattgtctgaaaatccatcaagactcactcaggcaaatagaaatgatgtttacatgaatatagctatcacatcgctggttatatgtaagttggtgaacacactaaatatatccccttaagtttggattccttatttttaaaataaagcttttctagattaggtcatattcatagttcctgatagctctgttattttaagctaaatcttagttctaagataattaatacttataaaaaagtaatcattagcaagtacaatattgcagacttgtattgagtcataacatgaaaaactgacaaaattttcaaattctattttctacctttttagttttttcttcagaagtagtatggtgctttctttctatactaatttaaaataaataaactgtcagtaatttaaaacattattattctgttaatatttgttttccattttctgtaacatggttaagcatgtgttcccacaaggtggtgctctttatttaaaaattacaacaggaagcagttttgttctatgtaagcatagtgctcaatgatgatacagattgagcatgattttaagtcgctaaatgagcagtgaaaatgcatttattactgaaaacttattttcatttgatttttattttttaaatgctaaaagtataaaacattttggtagcaatttcagttattaagaatttagaggttttaaaagttcagaaaatgcatagtagccataaacaaaaacacaaagggaggaatagtaaaaataaaattttggctggaacagaaattcttctctggaaataaagaaaagctagaatataacatagaaatactatatttaaaccttctaatattaaactaagtacagaggagtcatatactaagcacacttttttaacctgaatttaggtattcagaaggaaaaggaaataaagaaagagagataaagggaaagagagaaggaaggaaggaaggaaggagaagaaagagaaagaaggaacttttaaaaagaaattgaatagtggtattaattttactcatcatatttttcaaatattatatttcctgactgtctggtccctcagttccttcaagactcatacagttttacatctcaccctgctgaggcccaacttaatgttcaatattttacatgatttgcttacaccacccctcagcataaaccaaattatttttctggtaaccacctaaaggaagaataatatgcaccaatactgaaaaaaaatagataagagttttatttctacttcggatgtaaaaagtgtgaagggaatattgatcccaggctaaaaatgagaaagaggtaggtaattctgaaaagtattatttttttcttaaacattcagaaagctgagtacttaagacgtccctctgagatgaacaaaattccaaaggttgacaagttcctttgaggaaagacaggacacacaaactgtttaattatcagcagaacatggagccaagtgaaagcagccataaaagtgggtagtagggaggcaagtaacattttaaaaattcttaagacctagcgtgggctatcatgagaagtcagaattcctgagggcaccattccaagggaagtctgcacctgcttggacaccagctcttttacaagaggggttcagctactcctggagacaggtaggaaaagagaacaagacaatctgctgctagaggaagggcaagatcctgtctagcatccaacatttagtcctgctttgataaccaaagccatctgcccatgggagagagacaggaaacccttccataagacgcaggcaaagattggctgcactggcaaagagacaggagacactcttaccccttcctcctaggccaaggtcagctgccatgaagaaaggtatagaagtcttactcctccaaccagccctttacagtaggaaaagccatctgctactgagggaggagtaagacaccaacttaattccagaattctacaatgatatagtatattgctacaggggaaaggcaggaaatcagcctgtagaaacacccaatcattcaaggcagaggtcagctgtcttgaaggagggctagaaaacttgattgcaccctagaccctctagagaacaggaagggaaatgaagaaagacccagtgctgaggtttggtgcagagagccagcataagactggggctggaggagaactatgaagttccaatctcccctttcctttgctcctaccatgagactggcagtaagtaggaagccacaatagtctattgctagggaaggcacaggaatgcaaagagaaagccctcactcctctttcaacacagtcatgcaaagtcttctgaaagttaaaaatggaagaggaacattttgacaaaccctctgacattgcaatactcatacaaattataacataggcgcagtccataaaaggaagaattttaagcctgtgtttcactgaatgtgtccatagtgacactaaagcccaaatcaagctcaactactttctgctaactcaaactccaagttactggcctgtgagataaaggggagtggacattcaggaatacaaatatttacctcagtgtcttctgtgttttttaaccaatgcaatgtttggtatggaaggaaggagggaaggaatgaaagaaggaagggaaggagatgaaggtggggggagggaagcagggagaaaaggaggaaggaaaaaaagttctagtgtaaagcaacaaaatagtccatagaaccagaaacatagaaattcaggatgatgacactttcaggcagagatatgaaattaaaaattatggataatttgaaggaactggttaaaaaaaaagggggggggagcgtgtataaacaaatggggaatttcaacacaaatttggaaactataaataaaagaatcaaatacaaataccagaaattaaaaattaattatcagagatttaaacattcccttaattgggcttagtagcagaccagacatagtagaggaaagatcagtgaacttgaaaatgggttaataggagttatccacactgaagcatattgagaaacaaaatggaaaaacagaaaacagaacatctaaaagctgtaagacagtatcaaatggtcttatatgcaaatatattttccaaaaataatgaaaaaagaacaaatcatacattcaaaaagttcagagaattctaagaatgataagaggaaaagcgtaaccagaaaaatcgtagtaaaattattaaaaaccaaatatggctgggtgcggtggctcacgcctgtaatcccagcactttgggaggtcgaggtgagcagatcacgaggtcaggagatcgagaccatcctggctaacatggtgaaaccctgtctctactaaaagtacaaaaaattagccgggcgtggtggcgggtgcttgtagtcccagctactcaggaggctgaggcaggagaatggcgtgaaccggggtggtggagcttgcagtgagccaagatcgtgccactacactccagcctggtcaacagagcaagactctgtctcaaatatatatatatatataatatacatataatataatatatattatatatactataaaatatatagtatatataatatataatataatatataacatatataatataatatatattatatatatataaaatcttgaagacatcatcaagagaaaaagaggaactatgattaaaaattaaaggaggcttcttgtcagaagcattgaaagctagaagacaagggagcaacacttaaccaaaaggaaaaaaaaaactcaatctagaactctataaatatagaatataattttatccagaattacagaaaaagtataatatctcatgacccattatgttttagtaaaggagtaaggttagttcaacaactgaaatcaatgtatacaattcactggaaaagaaaaatcacattattttctcaatcaataaaaagcaagaaagacaaattaataaaattaaaatcaattcatacatacaaaaaaacttttagaaaactaggaatagaaaagaacttgctcagtttaaaaggggaaaattattaaaatgaaatgaaacacaacaaagtataaaatttcacagctgacattcatctatgtaaaaaaagctattagaactaatagtgtatacagtaagattgcatgatacaaagttaatataaaaaatcaatagtaagttgatacactatcaacaaaaaatggaaattaaaatattaaaacaattttgagaaaattttaaaagacctaaataaatgagaggatattccatattcatggatcaggagattaaatatgggtaagatatcaattctccttaaattgatttatatatcctatgtaatctcggtgactctcatgcagggttttttctttttttgtttatgtagaaattgacaagctgattctaaaatttactcagaacgtgaaggcctttattaagtaaaacaataaggaaaaataagaacaaaattgtagctctttcaaggattagtataaaattgcagtaataatgactctattattggcaaaaagatagacttacagatcaatggaaaagaagagagtccaaaacagaccaaaacatatatggtcacttgattttggcaaaatactatggtaatttaaggaagaaatcatagtttttttttaaagaaatataactagaacaattggctagccatatgagaaaaaatatttacatgccatacacaaaaattaatcattcacagatcataagtctaaatgtgagagctaaattcatagattctaaaagaaaaagcaggacaaaatctttgtcacctttatttagagaaaaatttctatataggcctcaaaaacaaggaaaaaaataaattggacttaatcaaaattaaaattgctctttgaaaggcactgttagaataaataaaaaggcatgcaacagattcagataaaatatttataaaacacatatctgataatggctttgtccactcactacataaaagaactctgaaacctccataacaagaagattaaaaagtaactttaatgggcatatagacagccaataaatgcatgaccacatgttcaatgtcattacttaacaagaaatggaaagtgcaaactgaataagatatgacatatccactaaaatgactaaaattaggagtgacaataccaagtgctgctgaggttgtggatcaatttagaattctcatacattattgttgatgatgccaaatgacatttcattttggcaaatgtatgccattttcttacaaagttaaatatgcactcattggaaaacatagaaattctacttgtaggtatctgctcaagaggttttaatatatatttgaatatttagagcagatttgttcataatatctgaaaattagaaatggccttaatatctatcaaatggcaactggataaacaaactgcggtatatgtatataacagaaaactattcaacaataaagaggaactattttacactactgataccgcaaaaccatagaagaatcttaaaagcattgtgctaagtgaaataagtcatattgtgtgattcctttgatataaaattccagaattgtcaaaactatcatgacaaaaagtagatcaatggttgatatggtattagtgtcagtatagtctgactcaaaaggggcccagggaaatttttagggccatgggaatgttccatatattgattgtcatggtgattaaagaactacatacatttttcaaaactaatcaaattatgtttttgtttttgttttttttttttcctgagacggagtcttgctctgttgcccaggctggagtgcagtggtgcgatcttggctcactgcaagctccgccttccagattcacgccattctcctgcctcagcctccccagtagctgggactacaggcgcccgccactgcacccagctaattttttgtatttttagtagagacggggcttcaccgggttagccaggatggtctcgatctcctgacctcgtgatctgcccacctcggcctcccaaagtgctgggattacaggcgtgagccaccgagcccagcaaaattgtgtatttttaaaaatgtggattgtactctttctctattgtacctgagtaaaaaaattaaatataccggataacttgtactattagtctttaacatgccttctttctaaaggattttcaaaaataatttgagtatttttcatttttttcttaaggctttcaaataaaatccctaatgcataagagcaaatctaccatgtatagacttatatcctataggaaataagagaaagagaatgttctggagcaagggaatgaaattaaatgtataatttagggaggtaaaactagattagtttagggaggtaaaactagattgctgaggttgcagggtaggcacgggttgaagtttagaaacctatgcaatatttctcaaataatcaattttttcctctttaattccaagtggaagattaagaatcaaaagaaatatttggcctgaagccagagattttagatttagctacctgcagtggaagctatgattgttcttgaccaccgtaaaaatgtaggtaggaacgaagagaaacatatggccaaagactgaatttcaagacaagctcactgaatacagtgggagaaaggagtctccaggcagaaatagaacagttttaaattctacggagagggcaagagaagtgaagaatgaaattaggtcactggattcaattattacagatacagatataattttcaagcattctgttttagatggaggttaaaaatcttttcacataaaatggagggaatcatagttgagagactgtagtaggagatataatgtactaatttgaggaatctggctatatagtaaagctgtagaccccaactgggaggatattatagtttcataaaaggatcttcagcataggggacattccaaagcagagaaaagtgagttaatggaaaggaagagactgctggagggaaaaggaatatctgaaggtttaagttcccccaaggagctgggagataaatgagagcagtaacatgggtaaaaaccaagagagatggaaaaactgttctaatctattaagatgtaaaacagagatttattcttcctgcaggcagaaacattaacaaaactttttttttcaaaaaaatttgagtaaatagttgaaagtcaatgtatctgtattgtattacacttacatgaccaaaacttaaacatgctattttctttttgtcttttcttttcttactactctctctttccctctacttgactctttccctcaaggtcagcttctgatgtaatgattcaaaattgtgttacttcagtggtgttatgactgaatgctacaagagtcttaaagtcttcattatagttaccaaaagattatcacaaatcctcacataacagtgaaatgcaagtttattcttacagatgagaaaactgatgctctgtgagaataagtggcttgtctaaaatcaaagagctcataagtgataaaattggaattaaactcttgggtcatttcttaggacttcattcctatctcacataaccacaatattcaagaaatattatctgttttgttctttcctttggtattattggcttttgaagatagcatccccttgtgattaattacaaagaggagtttccacagttgacagttttgaccagccaaaagaaaactagtgatcttaattccatttctgccaataacaagatgcgaccgtaggcaggttatttgctctttctgaacgttgatttctttatttgtaaagtaaggtatacagttatacagtctgtaagatcttttctagttctacatttctatgagtctaaaagtaggatgactgtgaaagaccagttctaccttggagatgagccaaatttgaaattggctatttgtttatagccttcttcactcttcacttggattttacatataaatgctatttttaaaaagtcatactagataaactggctgcaaaatttaaaacagaataccattgaggttttcggctcatgaagctataaaaagcagtgtgaactataattgtggccttacaaagttatcattggcgatttgcttcagaatttcatttccatctcatcttacatagtaaaaaaaacaacacaaagactaaagacccagaaatctcagagagctactcagaatgtattgctgaggaaaattttccctaagatattaattaggtagaaagtcctgaatgcagtcatttgactaattaatcctcatttacataaaaataaatcagttatatcaattactgtggggcaatagaatgtggttccccacctccccgtctttccttctgtaatataagattcatacattttcttcctgacagctagttatttagtgtcctttactgcacatttttcctctaatttgcttcattgttggtttggtcttagatttctttcctcccatctttctacttgctctttgtagatggtctcactattcccatatcattatatattatttacatactgttatccctgaaatttacatctcaatccatatgaagaattcacctacgccaaactaaagaacattgcccttttcttcccactcccaaccccacccaaatctttcttatgttctctgttttggtaaatgtcatgagcatctatccagtagttccccagacttaggagccatctttaattttcctcaatatacgaatccaacccatcagcaagtccccaattctaacttcataatatatctcaacccaattcacttccctactgctatgaccctaaaccaaactcccaccacttacctgaactcctgtattagcctagccctttaccagattctttttggttcagtccttgttctatttcacttaattttaagagcaaccagcataatatttttaaaacataaatcttgtcatgtaattccatagtacttccacttccatcattttccatagtacttggaataaaatccagactcctacaggacctagcatgattagctgttgcctctcactccaataccattttatgccactttgcctttagctcactacatttctgtcacagttagatcctttgttccttgtcttagtatcttagtggtgctgtagcaaattaccacaaatggatcccagacatccaaaaccaagttgtcagtagatttgtttccttctaaaagctccaaaagaggatctcttccatgcctccctcccagattctggtggttgttagcaatccttggcattccatagattgtagaggtatcactccaatctctgtctccatttcagatggcattctcctgcaccagtcattagatttagggcccaacctaaatccaggttgatttcaagatctttaactaatggcatctataaaaatcatattaccaaataaggtcacattctgaggttctaggtggatataaattttgaggggacaatatttaacccactgcatttcttctgctatttcatctccctgatcttcagatggtccatcttctgaaaatcacttcctcagagaagtcttccttgatttccttcctttcttcatcatagctccctgctgtttccttcacaatgccagccaaacaagtatcatttcagtggcatagtttgtatataatatatgtatatgtgaatacatactaaatatagatatgagtaaacatataaatatagtaatatgtgcgtataagtgtatatactttgtgttatcagctaagaatatgggaacatttcttaatttaactgtcatggcatatactcaaaaaaagccagtaaacaactggagtattcaaggaatggaaaaaaattaaaaaaaaatcatctgtagaatgaaaagtactagcgaagaagaaaaaaatttaaaaaatctgtggatttaaaaaataataataaaatgagaaaataatgtaaatgtaaagaaaagatacagagtgataacaccttgtattatataagatgttgaaaaaaacatctattttatactgattttttttcttaggctgagagatagtaagtcccaatattaacaaatgtaaaataaacaaaacataattgtaagtaaaaactgcgagacacttgatcactattttaaaagcctactaacataaaatcctaactaattactatcaacgatgtatggatcttggtgatttgtttatagaattaaatttctgcacagaagaacaaaacaaaaagaattgcttcataagtcttcctcctagcatgtttttctggctatataatgagtatatagacctagcatttatggaataaacccaactatctcctgaggtcatattctgtgtattgcttcatttaattaactaattataaaataaacatgagctccaaaggagaccgtaagctccagatcagaaagcagccacaccagcaccttaattgcagtccattaaacactaagcagaggattcatctaagatgttcccagacttctgactcccagaaactgagattgttattttaagtcattaaggttgcgtcaatttgttacgcagcaatagaaaatgaatacacctaataaaacaacttgggaagcgcttcttctttttaactgtctgttagagcttttaataggtggtataattccttccttaaatgattgtagaattcactggtgaagccatttggtcctgaagttttctttgtgagaggagatttttaattgaagattttttcttttatgtgaagtatcacctgaattttttatttcttgaattaacttggttgaagtgtgtttttctaggaatttgtccatttcatccacaattttagattcatcagtataaattctgttgaaaatatcgtcttatctttgattgtctgtaggacctatagtgatatactcttactgagttctgctattgtttatctgcaccttctcacttgtttatttgatgaacccgccagagagttgtcaatgttaattttcccccaaaaatcaacttttgcctttatcctctatattaaatattccaatatattttattaatttctgctactaacaccattatttttttctatatattttaggttttatttacttgtttttccctaggttcttagattaaatgtttatataattgatttttagcctttatttttctaatacatatttttaaaaatatattataaatttctctctaagttgggttttaactgccttccacatgtgtcaatatgtagtatctcaaaatgaatcaaaaaaattcttatttgtacttgaattattttttggccaatgggttaattagaagtgtctatcttgttttccaaaaattttagcactttttagttattatttttaaaattttcatgtttagtgttaactactagctgaactctgctgttaaaagaaaatgtattctatatgatttcaattctttgacaattaatgtgtttatctgtatatggccttcatttggtcaatttggggaaataaagtaagcgctctatatatgtcaccaaggccaagcttatttatcacattgctcagattattatctttacagactttatattctagtccaatcagatctgcggagaagtaaaataaaatgttctaccatgattgaggcttttctattctccttttgattctgttaatttttgtatgtatattttaaatatatgttattagatgtataaacattaaaaatttttctacctacctggtacaccaacttcaatattgaaagctctctttttaaatctattattttttgaaagaccatggttattgacattaatgtagttatgtaggctttttagttagtattttatggtataccttttctatcactttagtttcaacctttatttaattatcatatttgttctctcttatctgttattgtctgtaggatctagctgctcttctcgaggagtatctttgtggcgtattttagaatttttttgtaaatacatggtttcaaaaacattcttgaattttatcttgaattgaccatttttctacttatatttaatgcaatttcttacatgcttttgtttaaaagttagaatgatgatgttggttgtaatcagtttttatttaaattcttgacctgttagagaatggtgatttaaattaggtgaaatctagtgtttctgaataggtgtatgcggaagatttctccagacttcgccatgcacaatatgtccatgtaacaaagctgcatttgtaccccctaaatctataactcaagaaaataaataaaaataattttgcagaaggagttgtcaatagaagaaaaatagtcattcatgtagattagccattgtaatctgtgataaaggaaagaaaaatttttaaaaataggattttctataaaagttctcaccatgcttcaatcaaaatataaattatgtctatgagtaaaatataagaatatccagagaatttattatataaatgatttagttactttcagagaactttggtgaactcttttggtaaaatattaaatattaaatatatataattttaactcctcttcctataatacttataaatcttctaaatgtactttaatagattaaaatacctctttgaaaaataatttaatagccgatcataaaatctttagggcatattcctattatgtggtattctggaatcaacatagattttaattgtaagtaataattctgcagaatctcaactttaatttattatgaatatacaatcagatccatttttaaagtgcctgtagtggttataattaatgttaagtgaaaaaaatgcataaatttcacgttttgctgattaatgtttccctgactgtaagcacttgaaaagactgtctagttacagaagaaaagctagaacaagttattttccttccagatgagtgctccttaacacagagacatagctcccctgggaaggttaatgctgccgccaatcttctggagacccagagaggggaaagggaagaatcccaagccaaagaggtttgcaatttcctacaaagccaaagtttaatgaatactaatgacagaacagggatggatccttggaaaactagctcatttcttatcttgccaaaagagatagaatgcagtaccaacttactggggtccatggagaagcaacagaagctaccttggacctgtacacgtcctgttgcctcgggctatcctggagattggccttcagactcaccttcttagagagccatcttcattctttctggaatgactaagcaagtatcaaccctaatctaactgagattgaacaggctattaggctacacagtcacagggaggatgtttagggttccctagaaaaagtaaataattttgaaaaagatttctaagaatcaatttcaattttattttctaaataaatttggcaattaaatgcaaactgatgtaccttaaacagttgcagtagctagcttttgtaattgctaaagtctgtagaattgaaatacctttggaccaagaaaagaaagatccttgatttattcccatacataatgaagatcttaatgtaatgcaaattagttatttaagacctggttcaacatctacctctcaaaacaagtcttccaaaaaaataaaaataacccccccaacccaaattaccatgattatttccatataatgcaaaattaatcatttatttatgtactcatttttacacttgttaatcatgtgttaaaaagaaatgattgctggctgggtgtggtggcttacacctgtaatcccagggagtgggaggccgaggcgtgtgggtaacctgaggtcaggagtttgagaccagcctgaccaacaaggagaaatcccatctctactaaaaatacaaaattagctgggcattgtgtcatatgcctgtagtcacagctacttgggaggctgaggcaggagaatcacttgaacccaggaggcagaggttgtggtgagcccagatcgtgccattgcactccagcctgggcaacaagagcaaaactccatctcaaaaaaaaaaaaaaaagaaaagaaaagaaaaaaaaaaatgattgctaaccaattagagtgcaaaaatttaaagtaaagggtcaatattttttattttttataaagtgctaagaatagtactaagtgtacaacagacattactaatatgctttctctataagcctttatctttacttcatatttttcacattttaatgagtaattatatgtataaagctgtattcatccatctgttttttccagaaaaacatctatctttgataaaaagtaaaaatcgtttaactttattgtgttagatgagaacagtctaattagaaaccagtctcttgttaagaatttaaaagatcaagaaacctgttctatttgctgtagaagaatatacgtatatatgtgtgtgtatatgtgcatacatatacatatatgatatataaaaatatgttacatatgttttatatatgtttaagggttgtatataaatgccttccaacttacatgcaaagaaacaaatgtatgtctaataaacataaatagaaaaggaagggagaaaaaaagaacaaaatacaaacatttgcaatttctatggttaaaatgatatttccatttttgacaaaactatggaattctagggagcaaaaacacttgaagtaaaataatttatattgcactttaaataatttaaccaggaagttgaatatatattaatatttattttgcatattttgccctatttcattaacactgattttccttcacaagcctttctttaaatacctttttcctttagattagttataaattaacagtacaacggagggcggttccaagatggccaaataggaacagctccagtctacagctcccagcatgagcaatgcagaagacggatgatttctgcatttccaactgaggtactgggttcatctcactggggattgtcagacagtgggtgcaggacagtggtacagtgcaccaagtgtgagccgaagcagggcgaggcatcacctcacccgggaagcgcaaggggtcaaggaattccctttcctagccaaggaaaggggtgacagacagcacctggaaaatcaggtcactcccaccctaatactgcactttcttagcaaacggcacacccagagattatatccttcacctggctcgaagggttctacgcccatggagccttgctcattgctagcacagcagtctgagatcaaactgcaaagtggcaatgaggctgggagaggggcgcccgccattgctgaggcttgaagaggtaaacaaagcagcggggaagctagaactgggtggagcccactgcagctcaaggaggccctgcctgcctctgtagactccacctctgggggcaaggaatagccaaacaaaaggcagcagaaacctctgcagactttaatgtccctgtctgacagcttggaagacagtactggttctcccagcatgcagcttgagatctgagaacggacagactgcctcctcaagtgagtccctgacccctgagtagcctaactgggaggcaccccctagtacgggcagactgacacctcacacggccgggtacccctctgagacaaaacttccagaggaatgatcaggcagcaatatttgctgttcaccaatattcgatattctgcagcctccacgctccaggcaaacagggttggagggaactctggcaaattccaacagacctgcagctgagggtcctgactgttagaaggaaaactaacaaacagaaaggacacccacaccaaaaccccatctgtacatcaccatcatcaaagaccaaaggtatataaaaccacaaagatggggaaaaaagcagagcagaaaaactgaaaattctaaaaatcagagctcctttcctcctccaaaggaacgcagctcctcaccagcaacggaacaaagatggatggagaatgactttgacgagttgagagaagaaggcttcagatgatcaaacttcccgaggtaaaggaggaagttcgaacccatggcaaaaaagttaaaaaccttgaaaaaagattagatgaatggctaactagaataaccaatgcagagaaatccttaaaggacctgatggacctgaaaaccttggcacgagaactacgtgacaaatgcacaagcttcagtagctgattcgatcaactggaagaaagggtatcagcgatggaagatgaaatgaatgaaatgaagtgagaagagaagttcagagaaaaaagaataaaaagaaaataacaaagcctccaagaaatatgggactatgtgaaaagaccaaatctacgtcccattggtgtacctgaaagtgatggggagaaaggaaccaagttggaaaacactctgcaggatattatccaggagaacttccccaatctagcaaggcaggccaacattcaaattcaggaaatacagagaacgccacaaagatactcctcgagaagagcaactccaagacacataatcgtcagattcaccaaagttgaaatgaaagaaaaaatgttaagtgcagccagagagaaaggtcgggttacccacaaagggaatcccatcagactaacagtggatctctcggcagaaactctacaagccagatgagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgcactaaaagagctcctgaaggaagcactaaacatggaaaggaacaaccagtaacagccactgcaaaaacatgccaaattgtaaagaccatcgaggctaggaagaaactgcatcaactaacgagcaaaataaccagctaacatcataatgacaggatcaaattcacacgttaacaatattgaccttaaatgtaaatgagctaaatgctccaattaaaagacacagactggcaaactggataaagagtcaagacccatctgtgtactgtattcaggaaacccatctcacgtgcagagacacacataggctcaaaataaagggatggaggaagatctaccaagcaaatggaaaacagaaaaaggcagggtttgcaatcctagtctctggtaaaacagactttaaaccaacaaagatcaaaagagacaaagaaggccattacataatggtaaagggatcaattcaacaagaagagctaactatcctagatatatatgcgcccaatacaggaacacccagattcataaagcaagtccttagagacctacaaagagacttagactcccacacaataattatgggagactttaacaccccactgtcaacattagacagatcaatgagacagaaagttaacaaggatatccaggaattgaactcagctctgcaccaagcagacctaatagacatctacagaactctccaccccaaataaacagtttatacattcttctcagcaccacaccgcacttgttccaaaattgaccacatagttggaagtaaagctctcctcagcaaatctaaaagaacagaaattataacaaactgtctctcagaccacagtgcaatcaaactagaattcaggattaagaaactcattcaaaaccactcaactacatggaaactgaacaacctgctcctgaatgactactgggtatataacgaaatgaaggcacaaataaagatgttcttcgaaaccaacgagaacaaagacacaacataccagaatctctgggacacatttaaagcaatgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaagataagagcagaactgaaggagatagagacataaaaaaacccttcaaaaaatcaatgaatccaggagctggtttttggaagagatcaacaaagtcgatagaccactagcaagactaataaagaagaaaagagagaagaatcaaatagacgcaataaacaatgataaaggggatattaccaccaatcccacggaaatacaaactaccatcagagaatactataaacacctctatgcaaacaaactagaaaatctagaagaaatggataaattcctcgacacatacaccctcccaagactaaaccaggaagaagttgaatctctgaatagaccaataacaggctctgaaattgaggctataattaatagcttaccaaccaaaaaaagtccaggaccagatggattcacagccgaattctaccagaggtacaaggaggagctggtaccattccatctgaaactattccaatcaattgaaaaagaagtaatcctccctaactcattttatgaggccagcatcatcctgataccaaagcctggcagagacacaacaaaaaaaagagaattttcaaccaatatccctgatgaatctcaatgcaaaaatcctcagtaaaatactggccaactgaatccagcaacatatcaaaaagcttatccaccatgatcaagtgggcttcatccctgggatgcaaggctggttcaacatatgcaaatcaataaatgtaatccagcatataaacagaaccaacaacaaaaaccacatgattatctcaatagatgcagaaaaggcctttgacaaaattcaacagcccttcatgctaaaaactctcaataaattaggtattgatgggacatatctcaaaataataagagctatttatgacaaacccacagccaatatcatactggaaggcattccctttgaaaactggcacaagacagggagtccctctctcgccactcctattcaacacagtgtgggaagttctggccagggcaatcaggcaggaggaggaaataaagggtattcaattaggaaaagaggaagtcaaattgtccctgtttgcagatgacatgattgtatatctagaaaaccccatcgtctcagcccaaaacctccttaagctgataagcaacttcagcaaagtctcaggatacaaaatcaatctgcaaaaatcacaaacattcttatacaccaataacagacaaacagagagccaaatcatgagtgaactcccattcacaattgcttcaaagataataaaatacctaggaatccaacttacaatggatggaaggacctcttcaaggagaactacaaaccactgctcaacgaaataaaagaggatacaaacaaatggaagaacattccatgctcatggataggaagaatcaatatcatgaaaatggccatactgcccaagggaatttatagattcaatgccattcccatcaagctaccaatgactttcttcacagaattggaaaaaaccactttaaagttcatatggaaccaaaaaagagcccacattgccaagtcaatcctaagccaaaagaacaaagctggaggcatcacactacctgacttcaaactatactacaaggctacagtaaccaaaacagcatggtactggtaccaaaacagagatatagaccaatggaacagaatagagccctcagaaataatgccacacatctacaaccatctgatgtttgacaaacctgacaaaaacaagaaatggggaaaggattccctatttaataaatggtgctgggaaagctgactaaccatacttagaaagctgaaactggatcccttccttacaccttatacaaaaataaattcaacatggattaaagacttaaatgttagacctaaaaccataaaaaccctagaagaaaacctaggcaataccattcaggacacaggcatgggcaaggacttcatgtctaaaacaccaaaagcaatggcaaaagaagccaaaattggcaaatgggatctaattaaactaaagagcttctgcacagcaaaagaaactaccatcagagtgaacaggcaacctacagaatgggagaaaatttttgcaatctactcatctgacaaagggctaatatccagaatctacaaagaactcaaacaaatttacaagaaaaaaacaaaaaaccccatcaaaaagtgggcaaaggatatgaacagacacttctcaaaagaagacatttatgcagccaaaagacacatgaaaaaatgctcatcactggccatcagagaaatgcaaatcaaaaccacaataagataccatctcacaccagttagaatggtgatcattaaaaagtcaggaaacaacaggtgctggagaggatgtggagaaataggaacacttttacactgttggtgggactgtaaactagttcaaccattgtggaagtcactgtggcgattcctcagggatctagaactagaaatactgtttgacccagccatcccattactgggtacatacccaaaggattataaatcatgctgctataaagacacatgcacatgcatgtttattgcagcactattcacaatagcaaagacttggaaccaacccgaatgtccaacaatgatagactggattaagaaaatgtggcacatatacaccatggaatactatgcagccataaaaaaggatgagttaatgtcctttgtagggacatggatgaagctggaaaccatcattctcagcaaactatcacaaggacaaaaaaccaaacaccacatgttctcactcataggtgggaattgaacaatgagaacacatggacacaggaaggggaacatcacacaccggggcctgttgtcgggtgggggcaggggggagggatagcattaggagatatacctaatgtaaatgatgagttaatgggtacagcacaccaacatggcacatgtatacatatgtaacaaacctgcacgttgtgcacatgtaccctaaaacttcaagtgtaataaaaataaacgtgaaaaaaatttacggtacatcaaaaggaagactctttttctaacccagagttgtttcattactcagagcttctcaaataatttgacagatacagcaaaaaattatttctaaaatgttttctatcacattaatcatcagaatgattaaacaatatgttaagatatttccaaaatgcttcccacatttgtaacacgtaacactcagtgttagcataaacttaacttttaggtctttcaggtgttagtctgaaagttcctatttctttgctcacttctatatttaacataatttaaatttttgattatggaaaactacatttgcatgtgccctctaagtagtttgattgtgttgaaatatagatgcttaagtagttctatatcatagcagttacagtggtaaacatttagagaggacttgcgtttgccaggcaggtttggagcactctacattgctggctcattaaatagaaccatcttgtaaaagatcctgttttcatcataatcacatggtttaagaaatagaggcagaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaaagaactcaaacaaatttacaagaaaaaaacaaccccatcaacaagtgggcgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttctacactgttggtgggactgtaaactagttcaaccattgtggaattcagtgtggcgattcctcaaggatctagaactagaaatactgtttgacccagccatcccattattgggtatatacccaaaggattataaatcatgctgctataaagacacatgcacatgcatgtttattgcagcactattcacaatagcaaagacttggaaccaacccaaatatccaacaatgatagactggattaagaaaatgtggcacatatacaccatggaatattatgcagccataaaaaatgatgagttcatgtcctttgtagggacacggatgaagctggaaaccatcattctcagcaaactatcacaaggacaaaaaaccaaacaccacatgttctcactcataggtgggaattgaataatgagaacacatggacacaggaaggggaacatcacacaccggggcctgttgtggggtggagagagtggggagggatagcatttggagatatacctaatgttaattgacgagttactgggtgcagcacaccagcatggcacatgtatacatatgtaactaacctgcacgttgtgcacacgtaccctaaaacttaaagtataataaaaaataaaaaaaagaaaaagaaatagaggcacaaagaagaaagtaaatttgctcaaggttacaaacagctatcaagaggttgagtcaaaaatcaaattgaggctgactttccagagtccacactctacaccactacatcttatgctattttgcaaggattacaagaaattgaaatcaaaggtttatataaaatatggtttgcacacaatattgtatactttctataattttattaacttttaataaattgtagtctgaactgactctatgtgtacacttgacactaattattttggaaactttcctagcagttaccctttatcatctttggggcatatacaaaatgttaaccattctacatcaccaagcttctccagcatgtttatcctagtgttctgtgctttttctcttttacctactttccactatatcttcccctcagacttttcactgtgcctttgaaacctctattttacataaaacaatctttcctattttatcactttgttgaaggagcccatcatcactttacctcaacgaaaatagatttaaatggcttcataggttgcaccaataggatgcttttccaaattcctcagctcacttaacttcagaaagcagtgttagcacctttcttgaaaaccattagaatttccaacccattactcctccattctaaagtagaaccatctctactttggtgctcacaccatctgactattcctcctgttactcctccccatcattaataactaaaaatggcatggtctttttaacatgtaaatgaagttagttaatgaaatgacttcaattcaaacaagcaactacaatcaagtaacagatcccaaataaataataccttcatctttcatcaatcttgttattaaacaggctttgtcatatattccctctacatgtctggacttcagcttgagcagattcataactttccagtcacttagagttacaggaataaatctcattgtggatatccagaccattttcaagttcagaatatccagtacagcccaccaccaaaatttaagttacttatttaacagagaacttttctgatcaccccaccttgaactactagaaaagaggaagatgatccactttttcacctgcattctatctgcttcataggtctttcttctaggttggggcagggatatgaaagtgggttacaggaaaaaaagcaaagttttataagactggtgacttctatgttccaggtgccaaaatactggacttctaaattgggactcattagaggattctttggaggtcctcccatggggacatcccatgctacacagatcattgacataggcaattgctatttgctttctgactaaccatttgcctcctgccaccacctcacatttcagtttatattcttggcaaaacagctgacatcctattaattcttaatactggatcccattgccctagcaggcagtcatcatataaagggttctattatccttctacttcatcagtctggcccatgggaagctcatgtacctttgacacaccaaattcttgttgtaaagaccactcttactgctattctttctcactggcctaatttaggttagcttaaccagacttctacctcccaaatttactggagaagaaacaaacatctgattcagtggtcttgcatgtccgcaaactccaaggaatgcacattaatttatttcttctcttaccttacatctaacccatggaagtacttgatatattgctgaaaaaatatcaaaatacgaaaataccactgcttctttctatgagtcattgctttgggtccaccctcatttggctaaggagaagcacacacttccctccacagagtaaaaaccctgcagtactccctaccagctgacagctctctgctaatgagtcatctggtcttctctaagagagaataatagtggtgattcatagtggcaggactgatgctgccattattacaagtctgtggtgaatatgtctaacacttctccaaagaatgtggggatacttatcatcaatggcactatgttttggggttttaaagataactatgattcaacaatggaaacctcatttcacattttttaactcctgcattttttgaagttttcaattactggttcacactattacaatctgagacctgttatcatcatcattcttgtttaatttatgtttattaaatacttattgaaggcatactatgtgccagcgttggtggtccagcattaaaccagacagaaatttctgctctcataaggtttctattccaatgatgttaaacaatgtaactaagacatacggcattctaaatttgtccctttgattttctctactgttatttcttccagtggtcaacatttaaaggtttccctgggtcctatttctttccctaccataaaattctattaatactgattttgtaagttttttttcatttgctattgtcatttttactaccactactatagtctgaagttcacctttgtaattttattccagaattattataataccctcaatctcctttttccatgcagtatgctgctagagttatcattgtgagcacacaaatatgtccatgtaaatcgtgtgctcattaacatctgttctaattcattcattcaaccaatagttattgaggaactcatatgccaagtattataaatctttattctataatagtgaaagaaagagacaaggcttgtaactatgtaaagtttatattctagtagaaaaatataaacaatcatcctataggatcagaaaaaataatattgagtgttcacggaaaactctgttaaagtgacaataaaacaaagacctaaagaaagtgaggcagtaagccatgaggatatctgaggggacagcatggcacaaagaaggaaaaatgacaagcgtattgtcccttaccagtaataaacttgtctgggtaaaggggacagcaatggctagtgcagcctaagtggataagctatggagaaaaaggtagaaggtgagttcctagaatcatcgtaagggaaggaagtaatgaagagtctcagaaaccactccatgagctttgggaattttattgtgatgggaagctaacatagctttaaggctaaatgtaacatattgcaatttacatttcataaaacctgtccttggttcatagagactggacagatgagaaagaatggtggctttaaacacagtggtagttttggaggattctaaataaattgtgaagacaaagccgaattatgactttaagtgtttggcttttgagaagggtagcatgaagtagcccttaactgagaggggaaaatagcaggaggtttgtaagagtgatagagggaatcagaagttcaatttttaacttgttatgttttaaattcctatcagatatacaagtggacatgtcaaatgtttagtcatatacacaaatctgaagttcaagggagtgatctaacctggaaatataaatttttcagttattattatttaagtagaacttatgctgtgaaatagattgggccatcaagggcctgaatgtagatagaaaacattgcagggcccacaaaaatgattcatccaacactgtggcctcccggttccttaatatcatcaattccaattagcctcagtccctctttatttcatcacccatgtctatgaccacaatctggaatttactagtacctggaaatattttggttctgaaatgcttaaaccaagcacacaggtaatgacaaaacacactcaaatcttatctccttaaaataattgtgcctcaatcccatctcctctattggctattgcttcctctgacttcctgcataaccaagctcttaaaatagttctctacagtcactgaatacagttgttagtcttccatttaatctctcaggcccctggaaacttgattttacctaaattactctactacaattactctcaccaagataatttcttcttgttaaatacaatgaacatagtttgtgaactctcaacatcatgaaactgctaataaccctcttgccatcctctctttaacttggcattaatgattctcacatttctggtatcccatccttggacccatctctgttttgtcttttttgaggcacattcttcctctgacctttacttaagtgcttttctttctcaggctttattctgaactctctcatcttataactctatatacatgttttttgggaggatgatgtcatcaactccaatagctttaattaagtcttctacatgtccaaataaatagctttaaatgagacctcacctttaaatttccaaatcattcatatattcccaactcagctcaacttaacatgtctaaaactgaatccctcatttcccccttgaaaatgctctatctcgttggtttcttgtcacgatgaatggtaccttcatccactcaattgccaaaccagaaagttccaatatcagccttgacttctcaataggcctcagtctgcttccaaacaaccacctattcttgtatgttcaccatgttctcagtatctcatgagtcaatccattcttctccattcttgttgtcaccttacaggcttttattaaccatctaatttttttaaaaaataatgtcaagtttctcctgtgatattgccctcagttattgttataatctagggagacagacaaaaaaaaagtcaccatgatcattttcatcactatcctttggaagaaagactgcaagtcttttcataggtctctttgctttagtcttttctctaattcgctctccaactggtaacaagaaaatgtttctaaagggaagatctcgttgactcttctgtttaaagacttcaatgcttccctttggtctttagtataaagtacaaattccttccatgtaatttatcatattcttgcccaggcttaactttctagccttctatctcacctttatctgccatgcccaggttattttatactttactacatgacgttattttctcattttttacttatgcagatgctgtttcctctgctgaatataccatggtccccccatcacttggcgaacttcaattcattctacaattggcaagaaataaattattattttctatttgccttgcttgtttctccagcccctttctattcccatcaattgcattatgtgatactcttacttgctttcatctcatcttgtgcttacatgatattataattggtttttgccaaactgttcattcaagtatattgtaagattctgaaatgagtaactgtgtattgattatcagtgtctccaaaacctaaccaaatgctatagtacagcctagcacatagtgtacactcaaatatatattgaatttgaaataaacaaataggaaaatgaaaggaaataatataacaatataaggttgaaatacaacaatataaggttgaaataatttaaattaggacacgattcagattaatattattttattatcttatctgttgaagtaaatgagtagaacattgtcacttttgaataatcaaattaaaatcagttttgtagatttttaaactctaagaccatttacaatttaaaatatatataatttggtctaaacagcacactcagaaaattgaaattgttttaaattctgtggtgtgtttatctaaattgctaaggaccatcaggaagacaattaaaatgagaacagaaagtacaattctgtttcctcagtggggaaaaaaaacctaatagagcttaagaatgttcaggacagtgtgcatatcaagcccaaggatatgaattagatgggtaatcacttattcatcacactctagaaataaagagaaccattagcatttaggaaaaaaactaaacttagaacatttaaaagtattaagttctatagggagcaaaatgtatagatcttattattccaaagaaataaatagaaagaaaacaaggaagaaactgaataccttcagtggtattcttgctataattactatatgaggcaatgaagtagatttaatttaaatcctgataataacattttgtaacatacaatgaaacatcttcacatttgaccaatgtatgttacaacgaaacatgctctggaatgtctcatgtagtctctttattagatttttgtcaatatcagcccttaaaaaacatcagaaataataagaaagtaaatagctacataacaatcaaaatattttcctaaaccaaattgcaaagagaaacacctttcattgtgtatatacagactctgcttgagtctgttatcactaaacttaactcgtatggccaagctgatccactaaatcctacctgttgacttacacctagtccacagtctacagacaattctggcaccagggcaggggttgtcttaaaaattacacctctctcctactggctcatgggttcaacacaagaagggatccttcacactgctggttacacactgacctgcacaactacagctctccagatagcaggttcatgctttacagatacataacagagttcatgcattgcaccccagtacttcagtattcaaagtcctcttggccataggtaccagacatggatatactttaccctggccttgccaggggttggctgacaatgtggggcactttgattctttacagttcccaagttttttacattttaatattgctcatatttaaaacataaaacactatgacaaagtggtatatttacaaagcactatttaatttaataacgaattttgcactttcaattttgattatctagtttcttttcctttgtacttctatgtaaatataaattctatgctcttatgctggaggttaatctgtgatcaaatttttatgaatggaaacatatgccaaatatagaatatcttttgatataattttcaaagacagctttaagttaatatttaacagatactatttttttctccaatgataaaagcatttattttctaaaataattatgtgatttggaaaaatctgcaagttgtgtttgctgctacaattaatttacagtttctgaattaaaatccttttcagaaacaggccatttgtaaaattttgaatcacccttgaaaatcatgaatgagtgattttctttttctttattaacattaaaactgagaattttcaataaaatctattgaattttcaataaaatctatttaacacttattgttaaaaatattaatacaaaattctcctagagttctcaaatttattcttaccagatatgcaaatttacttataatgacatttgcaaatttgacacaaccttctatatatgccttaccatttgaaataacaaacttcactcttttttctaatgcttcagaaataacatttatgtgtacccacagcaaaatttgcaattttaaacataccattaacatttcaatatacctctgagatttctattacactggcaaagaaattacttgacagctatgcatccttatgagagatcattcactcaatacttgatgtattctgttcaataaatgaaaaaatataagactttgaatttcttaccaatgaaaacatcatcatagaatggtttctagaaaaagcatagcttttgaagtagacaatagtattttgatgatctattaaaatgacattttttagagaaaggaaaaaatacactttgggaggccaaggcaggcagatcacttgaagtcaggagttcaagaccagcctgaccaacacggtgaaaccctgtatctactagaaatacaaaaattagttgggcatgctggcgcatgcctgtgatctcagctactcgctaggctgaagcaggagaaccctttgaacccaaaaggcagaggctgcagtgagatcaggctactgcactcccatctgggtgacagacagaacaagactccgtctcaaaaaaatttttttttaattttaaaaaggagaaaattattttaaaaacttgaaattgatttagattatgtataatttaatctgactttcagttttctaacttggaggcaaaaacaatagcttcattcattgctttattcttaaataatggaagtaaccctagatactattgggctaaatacctagataccttagatacttagggctaaagaaaatgactgttacatagctcccggcagtatgttctagatagctccttaacaatgggagacactaaattaatgtgtactactgaacccctagattagctaagcccttatgcactctgaaatgttcataatgttttccactctacaaaatgttataaaataagcacaatcattgaaacttcagaaaacgtaagtataaaataaccatcatggtatagcacagccaagaaagaactatcctcttcacaatattataagttgttttaaaagaaaaaaatctatctatctaagtatacatatatagattgatatactatacacacatacacacacacacacacacacacatatatatatagagagagagagataaagttgtataactcatgcctattcacttttatttattgggaatgacattgatgtcgtttgccttcaggataccatttttcctttctgtgacctttattttctccctgcaaaaggattttttcaacaactaggccacatacccattcaatctttcatgtttagaaacatgctttcttagagggtatgacaaactaacttattttaacatgtaaataatggataagatctttatcagtacttagcagaagacagatattttattttgctttgaacaagagacaaatcctttgaaaccaactaatctctaactgtagaattcttccaggaatcagtgaacagttgagggaagtattttgaaggtagtagatctacttttctgatgtaagttgaattctatgggcaagcactgtgcaaggcagaagggtaaaattacatcacataagcactcacctgaaatacttaggtaaaagactggccattaatcctgtcaatatactttctgggttgacttacatttcatcttgccttacattgtaatgtaataggtctaggggataaatacaagcagctgtctgcagccaatacatttttccacataaatacttatgataaaaataaaaagaaggaaaagaactataatacattttttagccatactttaggagcaacttgatgaaaattagataacaccgtgagacatatctgagtgagaaagagctagaacagaaagttatctctctaacaactcactggtgttttaatggagttaaagtacttcacctacatgcctatgtgaagaacagctaaaaagtgataacactgagttctgtatgttccacattaaatttcattttgctaaacaaaaagcaagtaatgacaaaaatgtatgcattgactatttgttgatataagttgaatctgtcttattactttagatatactttgaatttattttggatctcaagcatgaagtcatagggatgtcatctctatcagtgttttctgaaatctgacatcacagaaaggactaagatgttccaataatagaacatcaagcttttgttgctgcttgtaaattataattcatagaaactttagaacactttataaactttaatttcctggaagcttcctgaattaagtagaaaagaacaatgtccagagtcaatactatttatcacatggacataatttttctcagtaactagaaaatatattgcaacccaaatactatactcatatttagaaaaacaaactctccagttagtagaacataaattactgagatattctaataaagattttattcctatttttaaagccaataaattgagataaatttttatgagttgttaaaactttttaataaaaacaccagcccacacctcaaagcaatttcatacttctgttattagtttctataatagctgtatttataaaaagtacctgcatatgacaaataatatacaagcaatcaactgataatctggtgtgtacacaattcaattcatcaatagttaaatttaatgaagaatctaacttaccggtggatcagcccccttagaaccagccagccctcctgttagggattcgatatcctgaaaaggggagaggtgttgattgtaaagtgctactcaacagcatgaagaatcccccagtcccacagtgtaataatttatttagctgcaaagttagggcatgtcagctattttattatttttttgcaatcttggacactgtagtactatacaaatagtctacatctaaacatctagatattctctccaactctggaagtctataaaaagaaaaacatgtaaacagatttttttaaatatgcagaagtttcatctttgaagagctgaagtgagagcagaaaaaagaaaatttaagaaaacttcagtttaacgtactattttgaaaaatattaaacccatggaaaatgtttaacctaaaaatatttaatttttttttattttttatgaatacataatagttgtacatatttatgacatatgatattttgatgtaagtatttgatgtgtaataatcaaatttaagtccatcacctcaaacatttatcatttcattgttttggaaacgttccaaatatgctcttctggctatcatgaaatatacagtaaattattgttaacaacagtcgccctattgtgctactgaacattatatcttattcattttatctaactgtagataaaaatattaaccaaatcttcttttttcaccacctcccaactagccttcccagtctgtggtaaccaccattctattcactacctccatgagatcatttttttttatagctcttacatatgagtaagaacaggtgacatttatctttttgtgcctggctgattttacctaatattctccaggatcatccatgctgttgcaaattttaaaaattataactatggtctactctatttctacacatagagtataaaaatataaagagatcgatttttaacctttaataggtaaccacagaaggtcatgcttgagtaatgactatagttgttaaatttataaatggggaaataggaaatggtgtgataagctgtagaggctgtgacctgtttatagggacaactacaactcagccctatcagttctaaggctttggttccagggttactaatgattatatgacttattcaaaagaagttgcaattctaggttttaaagtaaaatcacccaggtttttagtgtttgcaactgatttaagttgtaaaccgtccctcatccctcccaaatgaaaaaaacacaactctctgctaaaaggctgctggaaaggagttttgggttaaatcgaatggttacacttcttggctaaaaatgttctttcttatgactctgatcacctcttatctgtttgcatctagttggaaagacagggatgaagaggggggaatatagttgcattaagaaagcaaaaaagaaggataattaagtcccaattgaagtaatggaaatttaaatgcctatgatgaggaaaaaggccaatattttgatataattaagaggacttatgctactaattcacttaggacttaatcagatgattttccccttatattgaaaaagggaggactcttaataatacattatggggctgggatgagcatgtgatggaaacgttcaaggaaggggacagggaaggatggtgttataactgtttctatctgaaatgctaactgtgaaaaggaacataatgggtaatgaatttattcatgcatagtctattaaaggtcacaaatgacaaggagtacttaccaagaaaattattaaatggtctcctttctaatggaaatgtatatatattttttctctacccagaatccttttgagaaactactccttcccctctcccattctagctacaaaagaggctaacaaaaattgcttcaaatattgtagggacctgccagagaattaaggcaatatagaatctgaaaaacataatggtagagtttaagtccttgattgtatcatttgaggaatgtttgaaatgagatgttctctctgcctgcaattcagcttaaaatagatttctggctctgaaaagtaaaaatatcctaattatatcggcattttttgggtctgtttgtaaaaggcccaccctctccatcctgttcaaatgctttattccaacatcatgcccaacataaaaaaaatcaactcatctaaattatctgatcttacatgttctttagcattcttattgtcacttaagtaaattttgtctttgtataattaaaacaaagcatcaaacacatgtataaattgacaaggaatattaatatccttatcaaatccaaagataaaacataacttaaaattgtcttaaaatctcatggaatgaacaacattaggtagtaaaatgactaaaatattagatttacagaaaataaaacacacagcttgcactgtttgataatattctgctatgaccatactgaaaagtttctgttcatgtaaaatgttatttccaattatacttaaaatgaaaaaaagataccaagtgcatttggagttaatacatgtctttctttgtagaaaggcatataagttatattaatgatataaattttaatgaagctatcagagggataatagagaaactgatgtggataacaagtattttagcaatttagtcaatgcattttctcatattttgtaaagtttgatcattaagatttcttatctaagtaagttgtgccaagtttcagatttttaaaattttaagctctttgtgattatcatgtcttgagaaaaaatgagaaagaagaatgtagaagatgaatgaaaagggcaataaattttgtagtttttaacacattgaattcaaaatcaattacgaattcatggctctaaatagtatacagatgtatattcttatctctaaatgggtaagttgtaaattgaatgtaaatcattcaattgtaaaaaaatgtttgagttcatgttctattttgagtgtaagttgaaaaggagtgtcctacttggagagaggtccaagttaaacacggcttatcagttcatgcaaaaggaattttctcaggtgtgcataatgaacataagtgtgcatggatacatttatgttgtaaaataatagataaaacaaatacttgaggaactctggacatatgattactacatagctttcaaatgataactaaaagtgagtcaatatttttgatggttgttgaatattttatctgcaaagtataagtaaaatctttggcaaatgtgtctattttcttatttcaatatattttatatagataacaacaaaaggggacatcaaatagtataaacattgacttcctagaaagttttttgacttactattgtaaaaatattatttgtttaattaaaacactcaaaacatcattttatttttaactaggctacagaatttatttaaccatattgcataccatattgaggtcatcatttgtatctaatagataataaaatagctactactcagtgaacagttgctatgtgccaggtacttttataagtgctttgtagacattaatgccataataaacttatgttagttaattattttctcacttaaaaggttagatagtttacatgactcatacagtatcatagagctattaagaaatgggttataaaacatatacataggactccaaacctgtatttttttaattaccagtcctagtgaacagtttcaccctggtaccctggtgacactgcacatatctatgttggcgatgcaggtaaggctaaaccacaggctggtaaatcttgatggaatatcccgtgactctcccagaacatgacaaaggaggcagtcttatgaggagcttttacatagctatttcttatttgcctccctcacactagtgaggcatgggacttcccacacctcacacctccctacaccaggtccatcttcaggatatcaaactacttaggtgcagtatggaattggctcctacctaacaatacagcccacttctcttgttgcctatcatttgacccatccagttcagtgttgtccagtggaaattgggaccagggtcagaattagagcaggtaagtgaggtgcctatagtgcaaaatttaagtaggtgctggttcttagggtcatacaactgctgacctgcacttgtataatcttgatagtgagcaccttattaaattttgtgccctaagcacctcacttgtctcatctgaatcctggcctttctagggacctgaggagctgaaacaatggtagccttctttatgctgactgtgtaagtaacaaacataaaaccatttggattcatcgtctccttatcactcgaatctgtagaagtgtagcaagcacctacgccatgtggttgctcagggactgcatgctgcttcacactggtatcctcaatcatatgaatttttatcatcaatgctgaatgaaataaactagtatgtattaattatataagaaacttcatttcttaaacatcatttcagataatgaaagcttcattttcctctccaaggtgtgaaaaacctaagtggggttattagccagtccttaacacagctgtgcagattcagtttttcaacactggaaagttctgttcctggcatgaaaacccagtaaaccaaggatggccagtgaatcagaagtcttaaagcttgggaaggttgagctccaggaagagtgaggtgatcagtgtcagagctctaagtagagtgagacttagggcattctcagacttgaggagtctacattgcactgcatttgtaatagtggttgttcgcctgcacctttgctccctggcctcctgcttcaagaattggcatatttttcccttgacaaacactttgaatgatggagctatagggattaataatgtggctctcagtgtaagccatcaagttcagatactgtaagtcttgcttcctttgtgtgcaagtgaaaaaaaaaaaggatattaggatttcaggtctttctcagagctgttgctggattcttatttttatccctgaagagcaggatcagccaattatgttaaagaaaaatatgataaaataatttggctatcgaatacagtaagaatgaacaaataaaattctaaagagttagttgactctcgcatcgcatatcccacaagacccaagagatcttcaaacctgagagttatatttaaagttaatatcaggttttaagctttcacttgttcaaaaagtcacttaatgtaatatgaaaatacttaaaacattataataattgtcaattatgggcattttaaaatttcagatttatgcattgttatgggttaaattatgttccctgaaaattcagatgttgaaatcttaaccctcagtacctaagaatgtaactgtgtttgaatgtaaggtctttaatgaggtgattaagaagattgatccaatatgactggttgtccttataagaagcggaagagatagcagggatgtgtgcacactgagcaaaggccatatgagaacacaagaagaaggcagcaatttctaagccatggagagcaccctcagaagaaataaaatctgcaaacaccttcatcttggaattctagccccagaactgtgagaaaatacatttatattgtttaagtcactcagtctgtggtattttgttacaggagccctagaaaactaatgcatgcatatttgtaatttgggactagtttttagattctttgggaaaagttaacatatttcaatatagagtacataagagttcattaagcagtctataaaaaaagtcagtatcagtggaatcaatgtgaaatagtaaaatgaccatttctgtcaaatggttatatttaaaattatttcaagtctttaaaatatttaatgaagtattatgtatatgttaaaacttgacaaaatttattgtattcaaaatattgaaattaagcatttctctcatctcctttatagaaaaatttctcaaaattcccctctcccactactttctgttgacatgccctattgtgcccaccacatcactgcaactcctcttatcaaggttgccaatgacatcctatcgttcaaatttaatttttcatgttctgtcatcatatttcttgatcgctaagcttcagtcgacacagctgactactccatctttattgaaatacttttcccttttggctttcatttattttcacccgctacatgattttatttagtactgtggctctaaatataatgcatgttgataaattttgaatttctatcttcagcttcaacttatcctctgagatccatactgctacttcaatctccacttagatgtattatagccatgtaaaatgcaataatgcaaaattaaactcttgattccatcacaactcttcccttaaattaggttcccatcccagtgattgccatcttattaaatgacatcaccattcacccagttgctcaggtccaaatccatcagcaaaccccactaagtctattgtaaaaatactacttgaatttgactacatctcattaccttcattcctgtcatcctaatcccttgtactatatcaataatatctatcacataaactgaaaaaaataatatatatatatatatagctttctaactgttgtccatgaatttgttatctccctctcccctatatattctccacatagtagcccaactatccatttaaattttaagttagatcacattgctgtcttgaccaaaaccctaaatggtttcccagcaatcttaaaacaaaacacaaacttattgctatgctctgccatgccctgtatgatttggctcttggctatctctctgactatatcttttgccgttctccctctgtcctgccttctcagacacaatggcgtccttattattccaaaaaatattcaaaatttggcttgtatctcaaggcctttgcccatgcttttcctgcttcttagggtgcttatttctagatgtcctcatccattttgtgttgctataaaggatgacctgaggctcggtaataaaaattaaataaagaaaaaaaaggtttatttggtgcagaattctgaggccagaaagttcaagattggacttctgcatctgagcagggccttaggctgcccccacctatggcagaaggccaaggggagccagctgtgtgaaagagtgaggaggtgccaggctctttgtaacaaccagctctcatgggaactaataaagagagaacccactcacccccaagggagggcattaatctattcatgagggatctgtcccatgacccaaacacctcatagtaggtaccatttccaacattaggtgtcaaatttcaacatgaggtttgaaggggacaaacattaaaaccatagcagtagatatcctcctatttaactcacccacttcattcaggtcttagcataccaaaattctgaatcaccttccaaaactaattatctaaatcagtcaaggttccacctgaacaaactgacaaactcggagactatacagaagaacatttaataaaggtatgatttatagaggtatggatagtttacagggtccagagaaatggtggtacatggggactagcaacagctagacattgcaaccacccttaaacctaaagaaggtgcaagaacaatgtagtcaagagtccagcaagaggtgaatacctatcatcagcctatagaacagcttgccacacagtggagactcaataactacttattgaataatacaattattgaatgaatgatgtgatactatttttacatatataaaaagctgaatctcagagtacatatggtgaagtgtgtcttatttttgtataactgtatcactttgaaagcatggctgaaagcaataatgtttgcacaataaatctttataaaatgcctgagtgaataaactaataaatgacttgccccaaatcacacagctggtgaatgcttgaaagaagctttgaaatcccaagtgttataactccaagcccagcatattttctgttccatcatatatcactaatgagacatcctcctgaaagaaaaactcctcaactctgtattttctcatctcttgaggtactaagtttctatatattacatggtttctagtgcatcagaaggaaaaatgcaaaattatttaatagtcaataaacaatacattaaattcatcctctggttaaatactgccaatgcttccaattaaaggtctgacaccttaatcattgtacaatcaataaatcaatgcttgaaaatttgacctaacatgtatgtctggcattaataaatggttcaaatatgttaaactaaaaatcaataatgtttatttttatgtaacatctcatagtgtgttggttcacagcactgggaataagtaatagaagataaaatttattttaaacaaatcattcactttttcacacaaggcttaatggaaacaacctttcatcaccgaataccagctccttaaggcaagcatccaaataatgaagctgagtttgttaatgaggcatcttcctcctcaaccagacttaagcagttagtgtttccttgacaacattatagggtaaatttcctgggaggcatagaataagcaggaaacatacagaccaattttataaatttttcctatgtaagccaaaaggtgtcctttttaattattctttaaaacaaaaaaaggggaaatatctctttctttactttgagtataggccagcctgaatctgaattttccttaagccacacaattaattccttcaaaaaagagcagttgagcaaattttgtggctgaggcactgtactcttcatgggaggacacaatgaggagtaaatcaaggtcacaggtttcatagtattcagagtcatgacatgctctctgactttaaggatttttcagtccaaaagcacataaatctgcagaacaacatgaggaagaattttgagaaatgtggtgttaaaattataacagacaggggttgtggtgttaaattttatagtgtgacaattagtttgggtatttcatattgccagattgtactttatttttgaatgcatattgggtaagtgtctccaggaactggttgagtaacataataattaacatttattaagcatttactgaaacacacaccatgctaagagctctactgccgcattaggtaacatcgtaactctcttagccattattatttccaccatttcaagatgatgaaactgggtctttcagagtttaaatgacttaacaaaggtcacacagccaataagtattcaaaccaaagaggctgattccagaggcaatgatttttaacaatgatgctctcttgaatgaattgaggtatgagaaaagagtagggagaacttcttggcatgcatatggtgacttggaaaaaaacataaatacttattcactatctgaagaagaaatgcaacaaattgcaggcagaataattctgaggtggctgatatcctctgatgggaggatgattatccttgattgacctgtaaatgtaagagctgagaacatcagatttagccaaaaagtaaaattcccaaaatcttggctatatatttctaatttcaaagtcttctacctgaattcaaacctaactaggaaatataatgtgtatcaaaggcacaagtgtttcaatagtgcataagaatagggctttctgaagaaagtgccagagattcaggttctacattttccacttcataaattttgtgtgtcgctttttcttgtccattcctttccatatggctgaggcgataaagggaatgttttgctaattcctgactcagtctcaatcaatttctgttttccaacttttccacactgatgcatccttgctatctcaaactcactatatccaaataagacatcatcttctttatcagccattgccatggccaaccgccaatttcctattcctgttgatgttttcaataagcagttagttatccagtctaggtttatggatgttaatagagttttcccttactctggtatgcatattccaatccagtctagttttccttgtaaatatctgcttagttgattgccttctttcatttaccattgcatttaccagcttagttcaaaacctcattttattttcccctgacccctggctttttccaaaacagtgtctttgttgagttcctttttccactctcactttcatatcatcttttcttccaaccagttcccaaagtgtggcctgaggaccaccaccagcagcagcagcaacatcacctaggaactcataagacatgcaatttcttgggccctacctgaattcggctgcatctgaaactgtttaacacaccctccaagtgagtctgatgcaggctaaggttggagaaccactaccccagagtgatgtattttaaatgcaaatatagacaggttacttctgtactcaaaatacttaagtaaggtccccattcccaggaaggaaagataatcaaacctctgtacatgtggttttccattgtcatcatacatttctgaactacttttttcacttcaccttttaccactttccaaaaaagaaaccctgcactcttatcataatgaatcctgcacttccttattgtgacaagtgttttcttttatgtttctgcaccacggattcttatgtctagaaagccacccctaccttgtgggtgaatgtaattcatcctttgaaactcagtctaggcaccatctcctctggggaggctttcctgagtccctcagaccgaagggagggttctactctagcacaacagaggtactgtcccaagaaactttgcctgaggggtagtcaacagctctccaattttacttcaagcctgcaaaatgtaagacacatgcaaaaatagacagcttagtgatccagagaacaggttcaagcctggctttactacctactatctgtgtgaccttaggctaattgctttatgttctttacagaaaataaatcaatctatgtcctagtacacaaattagaaaggtttggaatatttattataataattaatattaattttaataattcatggaaagctacctattgataacttacagtaaacaatattaattattattattcatgtaataatacataggtacagtctagttacacatgtgtaaaataaagataggctatggatacagattacataaagatatatgttaaaacagataagcattagaatacatgtaaataagacccaaatatagactaatcttaggtataaatctccattagatttctagagattattttgcctgaaagggaaggaaacctaagattcattttatttccccacatagtcttacaacttttatgcatttctatggctttggttattaaacatttttcaccagtcatattaaagcatattattttcattcttcctaataaaaaaatgagtaatctttttgctgtacattaaaaactatgtattgggtaacatgtataccataaacccatacaaatttattcctctttaaatgtgttatttgatatcacaggtttatataccatgatgtgggaagctttaagtaggttagaaatgtgctatagccactgagaagaagaattcaacatttaaatgagaatatcaatattataatcctagatacacataatttatgggagactcacttttgtttgatggatcggaggctcaattactgtaattctaatttataattaagtcttcaattacatgatgcttagatcttctcctatctgacacaaaatgcaaacaaataactagaaaaatataataccacataatttaattttaaaaatcaggttttattttcaactcagtaaatagtagcctaaaatactggcttaaaaaaaaaaaacttggagattagcctatcggaagtgatttttgtaagagggaagaataaaatactgtcttttccaactgttaataactgcagttcctctgactgtggtaccttaaggcaatttatcagtctgattcataaataaccacaaggcagaattttttgtgaactgaaagcaaaaacagggcaagtggtttattaaatatatatatatatatatatatctgcttttaaaatagatacttctaataatagatatttctaatacatatttatttaaccgtatctctcccttactggaatttaggtattaagccaattaatataaacagtttcaaggtaatcataataagctggcaagaaaacagatgatctatattcaaattcaagttcacacttctagaaaaaattggcataggattttcagctgaatattaagtattttatggtcatatattaattttggaagtaatagccttggaggaattagatagagctagggggagagatgagatcttaaatttaaaaaaaaacagcaattagcaacactatccaaaatcagatatgcaaaatttgtgaaaggaagtctaatttggaacctaagaaacatgcagaaaaattccctttgcattgctgttttctttgggaaagaaattcaccaagttctaaatcataataagttaatttcaaatttattttttattttttagttcagtttttgaaataagtgatgatcataatgttaacaagaaatagcaaaagaacatatgatttatctatttttcttctgggcagctccatttcaattgatgctaccaggattctattatgaataaatgtttataataccaaataatactattgaatggaaatgtaactgactgatatcagagcataaaatgcattgatgttatgttattcaagtaattgagactatagcataatgtaggagttgtagagcacagcatagagctggagatttagagtcgatcatagaacattctatagtcattaaatgttctacagacagtcttgttctccttttcatccactcaagctccccctccccaaaatacaactaaaataaagctttaaagtttataatattctttcatttactgggatcaatttagaatattttatatccttatctctcctttccttaatatttctaggacatatttttcattacttatacttcctcccaaatgtaactgacagcattcaaatgagccacaccaccaggtaagaatttcaaagtgcatacaatgctaagttccttggggttagtgcagtggcaaagtctggatatttcttttgtttgagagcaatcaaaacagacgatacagacagtccttacttggcacagtacagtgttaactgtctttaccttgcatggctccatgaaatcagttactataaagcagggacatggctcccctggttctggtatgtactggtttcagtaaacacagtacagtaccactcaaagcaagaatatagtggcattttaatggcagataaatcttcatccctttgcctccagcataccttaaactggattgtgaatcttgaatgcatagtgcagtggctatgtaacacaatattaaaattggaatctttctcaattttagctttggtccaaaggccaaaaataatgtggtgatgaccagtatttccatatccttaagcaaggagctacatcaagccatgtgaaaatattgtaaaacagattctgccagaattgataaacattgtctcttaatgagagcattattggcaaattaggcaggaaatttcttcatggaaagtatactgaatttgaatttcaggatttttcgcatctttacacttaggcaccaaagtctattcctgtctcactcctcaccctcccactcctcctcccccaacacacagaggtgactattcctgaggaccagatttgagctgcagagtgggcagtgcatcttaaagtgcttgacctaagaggactgctagaaaagtaaagcaacgtggcccatgggtaaactactaaattccattccatgtgaagagtatattaatttcctattgcttctgtaatgaatttccacaaattagtgacttaaaataacacaaatttattatttcacagatttgaaggttagaatctaaaaatcaaggtgttggcaggggctatgttccttctgcagacttcagaggagaatccatttccttgccttatccagcttttaaaggctgcatgcattttttggcttatggcctcttcctccatcttcaaagagcattatttcaatctctagttctatgttcacatctctttttctaacactaacccttttgcctccttcttataaggactcttacattggatgcacctagctaattcagaattctctctccatctcaagattcttaaccgacctaatgttctcacacccacaatgtcccaaaggtaacatagccacatgtcctgggatataagatgcagacattttgggggttccttatgcagcctaccacaaggggtaattaaaaatgtaagttagaacaggcttggcctgaatgtaagaataccttggattcaaaccaaattaaactttcttgaccagcccaggcaggagtgacctctccatccactgaacttccattatacttattttcatctatatattgcctgatattatcattctatgtgttttctttccacataaatcctaactctcttagcataggtttatccatacctctctatattctgtaatgtttcaataaatatgttgattcgagaaaaataaatggaaagacagtttcagtgggcagtttcctgtgtgtgggaggactctgccttaaagtatcctctttcagtacctgaaattccttttattatatactgctttctgttctgtggcattgaatgctcaggcacaatgacaagataacaccttattggaattagtcaccaatactaagtgaatcatttcaacagattttgcctgaacctccactgcaaactcattaggaggaagtatattaagttagtcattcttttattgtacagattgcatttgccaagtgtctttcacataagattaattcaacaaggacctattaatggataatagttagctaaaagcaaactttaattagctgtggaaaggagataagtaacttttgaccaggggaaacaccaagaaacagtatttagcaaggaagaaattgtccaaaagagaaagaagaaaaagataaattttattttataatattctttagaatgtctttggaaattgtgataggaagactctaaaatggttcctagtgatttctacctcctggtattcacacccttgtgtaatccccctctcttacatgtagatgtttaggcctagtaaaaatatggttaagtgttgggatgtcttcttgtctctcctgtgattaggttactatagactgactttctctcttcctctctctctctctctgacacacacacacatacacaaacacagacacacacacacacacacacacacaaaacctgtctgggggaagttgccacactgtacagcttatgggaagatcaaggtagcaagaaactgatgtctcatgccaaccactagccaggaaaggaagcttgccaagctcaggttaagtgaattcagaagttgctcctcccacagtttgagcctgagctgatgtcagccctagctgatactttgattgcagccttgtgagagatctggagtctgaggacccagctaaaccgtgccaaattcctacccacagatattatgaaataatataaattgttttaagccagtaagtgttcaggtaattatttacacaggaataaataactaattttagagtcaatattcatatatttctaatctgttattgagttttctatgttcaccatacaagtgctcattataaaataaaaatattttacaggttgaatctttttagaccaatgaatccataaaagaaataagcaattttcttcctctggattttatggtctggtattataattctaattacacttcgaaaagcaaagcgatgttagaaaaacaataataaatgatcattcaattgattgatgttgacaactatcaatatgaatcataaaattgtacacataacttgtactgtatctgcttccacacatattttcatagtattggtcaattttgaatgtataacaatcattaaatttctaagaaaaacatttttgtggtgataaattctaggtggagttttgataccctaaagccatataactatcaataaagatataaaattctatgacgaaaaagcagttatttttaattatttataaatagcttggcctagttgacaataatgtttaaaaagcaactaatttttagttgctgaatatatcatcacagtagatgatttatacttttttaaacctgaaatactttctaacataagtactccttagtcaatatctctgaccacataatgaaaatatctatccaactcatttttacctagtgttttggaataaatgaggcagtttaagtctcttttcaggaagcattataaagtgtataagagataatatgatatagtcttatatatcataaggttagatgtttgtccccacccaaatctcatgtcgaattttaatccccagtgttggaggtggggtctggtgggtggtgtttggatcatgggggcagatccctcataactcggtgatgtcttggtaatagtgagttctcatgagatctgctcatcaaagagtgtgtggaacctcccctctaactttcttttggttgctcctgctttcaccgtgtgatgtccctgttcccccttcacttcccaccatgactgaaagctctctgaggcttctccagaagccaagcagatgcccacaccatgctccttgtaaagcctgcagaactgtaagccaatttaaattacccagtctcatatatttctttgtagcaatgcaagaatggcctaatacagaaaattggtaccaggagtttggggcactgctataaaaatacctaaaaatgtggaagtgactgtgtaactgggtaacgggcagaggttggaagagtttggagggctcagaagaatacaaagagataagggaaagtttggaacttcttagagactggttaaatggctgtgactaaaatgctaatagtaatatggatggtaaggtccaggtgtcaaggtcttagatggaaatgaggaacttacaggaactggagcaaagtttacacatgttatgccttagcaaagatcttggctgcattctgttcctactatagggatctgtggaagtttaaactaaagagtgatgattagggtatttgatgaaagaaatttctaattaacaaagtgttcaagatgtggtctggctacttttaatagcctatgttcagatacaggggcaaaaaaaaatgacctaagattggaatttatgtttaaaaaaacaatgcataaagtttggaaaatccataccctggccatgtgatagagaaagaaaagagtttttatttttccaggagagaaattcaaggaggctgaagagcaaccacttgctagagaaatttgcataactaaaagggacccaagtgctgatagccaagacaatggaaaaaggcctcaaaagcatttcagaaaactgtgtggcagcccctcacatccatcacaggcctggagacctaggaagaaagaatggtttcatgggccagacctggggccaccactgtcctgtgcagccttcttggcatcctggttgctcctgctccagccttggatcaaagggttccagatactgctagtgctgccagatactgatagtgcaaaagccactgaaagccttggtggcttccatgtggtgttaagcctgtaggtgtacagagtacaggagtgaatgaggtttggtgctatctgcctagattgcagaggatgtattgaatagcctcagtgcccaggcaaaagcctgctgcaggggcagagtccccacagagagcctctcctagggaagctccaatgggaaaagttggattggagcccccacacaggttccccatgagggcactgcatagtgaagctatgagagagaggctaccaccctccagatcagagaactgtagatccaccagcagcttgcaacctgtgcctggagaagccacaggcattcaacaacctgtgagagcagcctggtgcttaactttgcaaagacacagaagtggagctttccaaggccttgggagtccaccccttgcaccagtttgccctggatatgggatacggaataaagattatttgggagctttaaaatttaatgactatcctctttggtttcataattgcatgaggtctacagcccctttcttttggctaatttctccttattggagtatgtttgcctaatgcctataactgcattgaatcttggaaataactaatttgttttttatttttcaggctcataggtggaagggaattgctttatctctgctgagactttgaacttttgagtttacactggaattagttaaaaatttgagggacttttgagaaggcatgattgtattttgcaatgtgagaaggacatgagatttgggaggggccagcagtaaaatgatatagtttgaatatttgtccccaccctacttttatgtggaattgtagtcccagtgctgaagatagggcctggtggaaggtgtctggatcataggagcatatccttcatggcttgatggtgtctttgtggtagtaagctcttgcgagatctggtcatttaaaatgtggcacctccctatcccctcttgcttgctcctacttttgccatgtgatatgcctgttcccccttcaccttctgccatgattgaaagctccctgaggcttcttcagaagccaagcaaatgccagcaccatgcttcctgtaaaacctacaaaactgtgagccaattaaactttttttctttgtaaattacccagccaggtatttctttgcagcaatgcaaaaatggcctaatacaagatactttttaaaaaaacaatataaattatttcccttttcataagcatttgcaaatgattcagccttactctgttcagaaaaacaccagccaaaaaataaaaatatagtttcattagcaaacttttctgctcaaatgatcatctctatacagcaattgtttttggcttcttctgaatgtttttgcactttatatttcccaactctggtttcctttggcaattccctgacctcatttcttaattctcagtgctatgttatataattgtctgaataagcagtatccccccaaaatgagacaaatttattgagaattttgcaatcagaaaatcagcaaaaaggctaatttaatattaacatattgtgatttttgtgtggtgtaattgagtgttggtattaatacaagagctttaggcctaggatgcctggatttgaatattggctctgacactgtacagatgtgtaaccttgggctagttacttaagagttttgtgttttaatttcccacatataaaacttacgtaacaatagtacctgcctctgatgattcttgggaaggtaaatgtgtacacacagcaaatgcaaataagggttaagtggcagtagcacaaatagcaatagtagcagcagtagtagacagtgaaatactgacttgatgtgctttgtttaaattttgatttgcacattggcaggaggataaatctggtcttgtcaattcctctactgggtctgtggctgcaggctcttaactctcatcatccagtcatgaagaatgtggtagcataatttcatcaggaagtattgggacccagtgaagggtgaggaaaaagactgacatattgcatatttgcatatttaaaccttgcatatttaatttacacacttatgaaggaacctagtcttgcttatgaagcaaagacataagccaagtttaacaaatctgacaatatttttacagatcgaatggggacctcattgaacagggtctcttatactcatcctgtgcataatggcctcagcgaaactttttctttattaaacatactgctatgttttcagttgttcatactttgcttttgattgagcagtttattaagatatgtgatgaattcttcacccagtaaaggaattaaagattatttgacacttccttggtgataggcagaaaataagttaacctattaaaatgcaatccaattagtcttgacctatatgatcccccgctactagatgaaaagatattctctgatccttaaaccttatgcacttgaaaagaaatagagtcctaccttttgaccttaatttcttttctcttgagaaataggtttttttgacatgtgaagttagagaatattaatcttaaactcaggtttgttatgagtctagaagcttctttgtcattgttgaaatgaatcatagacagacaatgcctaatgagagaaatggcaggattactagaaaatgtagatctccctgaatttctaaattttgcttaattaatatgtttaaaatgtataatgaattaagcataaaaagtaaaacatctttcccattctctttcaattgaaaggaattatcagaaagtgtatacactccaagtgacatatttctcagtaaatcttttttaggccctttaggctattctgattcattaaatgtcacacagtatgagaaattacataaattatgatacattatttaaaaacttatttagagactaaaattaagtattctatttataattcttttcctttgcaataactatcagctcagactggataagtatatctaattaatctgaggaaggaaaggggaaaaagccatggaaattaagtaagtcacatttaagattattaaagttttataagccacttcagctaaaaaatctatacaggaatatgtcaaactatttgatttagatttacattattcagagcaagacaattcaaattctttagtaataacattcgtccagaaactacaagatagcatagttttccttagtaaactgaaaatcaatcagtagaaaaacttttccaaaatgttacaaatgctcccatatgtctgtctccttcactatttagaacatttcctctagaccaagactttgctttgttcactggtctatttccaggcacctggatcaatcagtgtctgcatatgataggctctctctcaataagtagagttgaatgcctagatgaatatactatttcaattcaagtcaggctagaatgatcaatcaaggaaatatccaacattaatttttaagaaaacaaactagatatcatgtttggaacctgaatgcagtaatactatagccaatgtgataagaataatcctatacagacacatttgttgagcaatatttttaaagaagccacttaaaatgtagtaatataaatgtcaccatggatataagtattcaagaacagaaacattaaggtgacaaaagtaaagattccaagacttactctgagaatttctgattcgataggccaggagttgaaaaactttgtttctaagaaagaagatttattcatgtagaattgctatgagttgaatgtcccctccaaaactcatgttgaaatgtaattaccattgtgatggtgttaagaggtgggacccttatgaggtagtaaaaccatgagggttttgtcctcataaatgaattagtgctgttattgcagaagcaagtttctgataaaagtgagtttagccccctcatgctctcactcttaaacatgctttcttgcccttctaccttccaccatgagatgacacagcaagaaggccctagccagatgaggaccccttgactttggatttcctagcctccagaactgtaaaaaataaatttcccttatttataaattagcctgtgttatgctgttatcacagcacaaaatgaacttaagagaagaatggttgtgaataaagagccagaggaaagaacatgaagaattagaagtgtcaggaaataaatattttgtttatcatttgaagtaaaccctttgttgcaaatgagtttgcatatattttggccattccctatgcctgtggaagaagggtaggtatgagatgcacagtttagaagtgttactaatttcaacctatctagtcctttatacacacacacacacacacaccacaaacacacacatctagtggaaacaaaaaggttcattgatttttctcctttaaagtagtggttttgagtagactgtatatgagttatctattgtatgttccatgacaattaacatttgttgtaataaaatgcattttagcaaaacagactttattataagcgttggtagagctaagatttttactatctatgagtagctttgaaagcagacatttctactaactcagaaaagccttagatcacatatttcactatcaagtaatatgcagaattaggccatgcatctattataaaaccacagaaaaattttagaaataaaacattataggattaaagaaattgtaagaaattactaaaggagatatagagagtatagcacatttcatgtgatctactcatgtcctcaaacattagtaaaagataaaacaagatgactttaatggtgacttaaaattgatttgtttctataggggtttaaaagtttgatagtgttgagtaaagactttactctggtaaacattataccaaattattttgataaatatattaatacatcaaaagcatttttaaattttcatgatttcaatattgtacaatttttgcagagatatttgcttcttagtataaaggttttttcaccatttatcataaaaattttatgtaaccaaaattatgtagtggtaaaattgctttcttcatagtcatagtaatattataagctcttattgaagacatataaacataaaataataatatcctctctaaaacaaaaaaaaaatagcttctttcttgactatttgaattatatttaggttagttaagtataatctaaatgaaagaaaaaacaaattattgcattctaagattatgccataaacctaaatgtttgcttttagtggatttcatcaccatggttgatctctatcatataatattaagcaatttcaattattctctctgaatacacatgtcttaaccctgaatcatcctccaagtatcttcctatctctctagtccatgtagaactaaaagagtaatacacatttatctttctccatatctaacttattcaattcctaacctgtctctgcatccacatttctattgaatcttattttgccaagagtaaaataaccttaatatattgctaaataaaattcttactggatgttcatagtacataatatagttgactcttcaatccttgaaattttaacccatgaaacttgtcttcatctttcatgaaaatattggactttcccatatcctatgaccatttgtcttcatactgcttcatggatgcctcttcacctgagctcccctgaaatggtggtgttcttcagtttaatccttgaccatatatcttcatactctgtaatccttttggatgatctcatccattcacagagtcataatcactagcaatgatatatactgatgatggctaaacctttatctcttctagtgtttattttcactgagacacataaaatataatgttatatataaaatatgtaaatgaaaatatttttaaattagttactaatcaaatgcagagttctacaactgtatgtctacagctttcaaattaaaaaacaaaacttaaaattcccattctcatgctttataaagatttttgtctaccaaatataaaatctgtcataacatgcagaaaattaaatgatgaattataagaataaaatatggaacctggaaaccctctctgaccagaataggtttggtttttgttttgttttaacaaattccaaagcatatggttctgggaaatgtgtttccaaacaattttctagcattatttaaagattactagttccacttctggcattgtgcactatgtctgaatttatacattgactgcatacagtgtttagaaggataaaaaaataaaatgataaccaaaaattatcacagaaatattccagagaacagttaccaaaaaagactatggagaaaacaaaaaccaaaataactaacatcggttggatatacatattgattagttggatataaataaatcagttggttataaaattgagtgaaaataaaaattttgtgtggagataaactttactaagaatgctcatagtttaaatttcttttatttatatactataaaaattatttttaatgtcactgacaagttgcacccaaatttggattaaaaggtttggaagataaagaagaaacaaaccatggagaagtgagtaaattcggtaagaactttgaataagtaaaggtatacaagattttaagactgacagcttgggttccagaatgaaacggcttccttctgcacatacaggttatatggcaaattagcctctgtgaactgcattttctcatctgtgagatgcaggccatcatggtgcacaatacaaaggattgttggaaagattaaatgaaatgttacagtgcttgacatttagtcatcattcagcaaatgtcacctataactaagtgtagctgctgtaactgctgctattactgctcattacaggtgggaagttgacctgctgcctccatattagggctggggtcaaactgattcatgcatttagagagagttatgagggtaccatcttgaagaaaccacacaatgttggaacactgttaatacatccatccacataattttgatccctgagacaagaagaatttatggggttagaggcagtagaatttaggggttagagcctgggctttgtgtcaggctacttgggctcaaatcacggctctgaaactttctaaatgcattatcttaattaagttatgtaacctctttatttatctgtaaaatgaagataaaaattataactgactaaatgggttgtgaaatttaaaaagcacattttatataaatcactagatagtttatgagacatagtgctcaataaataaatatcaatcagtgcctaatattctactattctttctgtcagtatgttgtaaaaaatagtaatacagttctccattaaaactatacaaataaagcttattatttgtgtttcatttcgtcagtcacacaactgttctgatgaaccccgaactgaactctttgtctcatttaaatcaacccataagagtaaactatacactttatgggaagactaaaaaaaaaaaaaaaaaaaaagtaagaagaaagtggctgcaacttagatttacaagatttaagtaagtgaggaaagagaaagagaaacaacaggaagctgaagactggaaaaagtgagagaaaatgtgggatgtaagctggcatttcttatcacttgctcctagcagctggctgctggagaggagtaagaaaaacagggcagccagcaaacacccagggcataagttctcattctgagacctacccccaccatcaatgacactgtggctgcttgtatctagtgccacagcacagattatgctgatgtagttccacacatgcatcccttcagtacacaaatgtgttgtagcacttcccagtctaaatgtgtcttttcttggtccattttctttccccagttactataaatttttctattgccattgactgccaaatttttaatgttgtcttcactagtttctccactatattacccacttcgctctgacctagctttaaatcccatcactccagtgaaatcaatcttgtctatatcaccaaattattttaatccacttcattaaatgtcagtagcaattactgaagttgtctacactctatttgtcaaaacagtggcgttgatgatcacagtaaggattgtgggttttaattaaaatgtacagaaagccactgaaaggattttggcaggggaagcctccaatgacactaggctctttgggctttattcttacttctctggtttctccttgtcaaacaaaattctaaattccagttgttatagactaaatgctgtgtgccctaaaaattcatattttgaacccctaaatcccaatgcgatcatattagaagacagagtgttttggaggtaattaggtttagatatgattatgagggtgaagcccctattatcaaactagtgcccatataaaacaggaaagtggcactggagcttcttccctcccccgtgtgaggacacaccaagaaggcaactatctgcaagccagaaagagagcttttaccaagaaccaaatctaccagcctttaatcttggacttcccagcctctagaattatgagcaacaaatgtctgttgtttaagccacctggtctgtggtattttgttacagcagcacaagtagactaagacgccggtgttccccagagttcagtccacagacctcttctcttttttctctacacttcttcttgaggggtttctacccagtttcataaccttattaaaggctacttactgtcaatgagtttcatatttgtacttttgcaaattctcctctgagctacagatttttatagcaatctgtttatcagacatcttattagacatctcacagacacctcatactaaataagtttaaaatttctcttttttacagccccaattttttctccttcttagacttctctatctgaaaaaatcattccaacaaaaccagaaaaactgctagtcatccttgatttttattcttcctcaatccccaagtcctatcccttaagtagtcctatcaatccaatgtacagaatccaatgtatagcatcttcttttcatcactactgctgctcaactgtaccaacccactaacttgtaacagaaaaactaaaatatgtccctcactgttatcacattcaccctcttgccctccttctccacttgcttcagcagacttctctgctagtatggatcatgcccttcattactccatacttttgaaataaagcccaatttccttattgtggcctaaaaatcccaccataatcccgtgccttggctacacctcacctccacctcacctcactcatggctctgacgagctcactgagtccctagatgcaccgagcatcttcctaatgccactgtgtaccaagctgtgtcttacatatgatactctttctctctggaacgctctttcttctgctcttcgtaaggcaattgtttattaatccttcagacctcagcttaaatgttgcctactcacagagtccttgttcacttcaagtatcttgatttgacttattattctattcctcaaccatttgttccttcattgaattaagataaaattattttatacctatttgttgtttacctgtttgttgtttgtatttctgctaacacaaataacacagacataggatcttgtctcttgtattcactaagggatgcttagttctagtacatttcctggactttgcagcactcaatatgtgaaatgaatgaactcaagaatgaaagagacattcaatgtacacttaaatagtgaagtagggtgtgcaaattataacattaaacaggttaaactgtgttgttgtgtagtagagtttcaatattaaacataattgtcatccaaaaatattatagctcaattaacaagtatttattgaacccagtacctattctgtgcccaaaatactgcctggtgttatgaagaaggttgagtaaaaaataaaatggtcactgattttaaaggttataatattttagaggagctaaggtataaacacacaaaacaacttgaaaaggatatataaaatgacttcatgatgagaaaaacacctgtgaaatatgtaataaaacttaatgatagcaaatgaaacttgtctttgatgggagtgacctcaaacacccaaggcccttcagaaagggagcatcaatgagaacagataaaataaaagacaagtgcagacttcactaaaataggaaaattaaattacccatatacttgcacatacaaggttcatttgccttgggaagttttaatacccacaattctgaatttttctataagttatattaaaaagccaagggacattacttgaggatagcaacttaaatataatatataaatatttattaagaacctatcttgtgggctgggcacggtggctcatacctgtaatcccagcactttgggaggccgaggcaggtggatcacctgaggtcaggagtttgagaccagcctgaccaacatggtgaaatcctgtctctactaaaaatacaaaaattagctgggcatggtggcacatgcctgtaatcccagctacttgggaggcggaggcaggagagtcatttgaacctgggaggcagaggttgcagtgagccaagattgtgtcattgcactccaacctgggcaacaagagtgaaactctgtctaaaaaaaaaaaaaaaaaaaaaaaaaaaagaacccatcttctgtccagcctctacctggtgtattgttacaaaaatgaaagatacggccgggcgcagtggctcactcctataatcccagcagtttgggaggccgaggcgggcagatcacgaggtcaggagatcgagactatcctatcctggccaacacggtgaaaccccatctctactaaagaatacaaaaaaattagctgggcttggtggtgggcgcctgtaatcccagctacagaggaggctgaggcaggagaatggcatgaacctgggaggcggagcttgcagtgagctgagattgcaccactgcactccagcctggggtgacagaacaagactaggtctcaaaaaaaaaaaaaaaaaagaaaagaaaagaaaaggaagatacagtacctactcacagagtgtccatagtccagttggagggagaaggaaggaagataatcctatgaacctcaaatcaatatacattgcaacaggtggtatgtaaaagatacaagcacaatatctcagtgaattaatacaatagattcttggggagtaaagattttctccacacagagccaaagacccttactgaaaggtaaaaatgcaaaaactcaaaccaaacaaggtgattcagttgattattttgtcatgatgcatgactgtctcatcagccagttgaattttccactgtagtaatcatttttactgaaaaataggttctcttttgtagaaactgtagtttataggaaatcatttgagtcacacattaagtcatgttctaaagtttcagtgtccaattcagcagctactagtcacagataggtatttagcacttgaaatgtggctatttgccacgtgttaaaatgatattttggatatattgatttaaacaaaaatatactattaaaagtatttttttatttatttttcttatttcaaaatgggacttttcaaaaatttgaaactgcatgtgtatctcacattgtatttctactgggcaatgctgctctaaaaagtttatgaaacaagttaatactatttttcaggaataggatgggaccaacttagaagattagacattgtccaatacggagtttgcaaaattctttctaaaacaatatgtaatataaataaggaagcataaaagtttaacactatgtactgcataagtattgtcttatccatgtgggaaagcactgagcacttttaaaaatatggttccatctagggaggctatattacatattttcaattaaatttgaaatgcatttacagtattgtgctactgtagcagagaacttcataactatctttactgttacttttatgaagctatttattgtgctacttttgttgcttccacaaccttaaaaattatacaaaaatgcatatattttttatttatgtataatactttccatttgaattcattgatttctaatagaacttttttataagttaaagctaaagagaaaagtctaaataaacatcaggtagaaatgtatagtaatacccggccgtgtgaggtgtcagtctgcccctaccggggggtgcctcccagttaggctgctcaggggtcaggggtcagggacccacttgaagaggcagcccgcatagccaagacaatcctaagccaaaagaacaaagctggaggcatcctgacttcaaactatactacaaggctacagtaaccaaaacagcatggtactggtaccaaaacagagatacagatcaatggaacagaacagagccctcagaaataacaccgcatatctacaactatctgatctttgacaaacttgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaatcataaaaaccctagaaaaaaacctaggcattaccattcaggacataggcacgggaaaggacttcatgtctaaaacaccaaaagcaatggcaacaaaagccaaaattgacaaatgggatctaattaaactaaagagtttctgcacagcaaaagaaactaccatcagagtgaacaggcaacccacaaaatgggagaaaattttcacaacctactcatctgacaaagggctaatatccagaatctacaatgaactcaaacaaatttacaagaaaaaaacaaacaaccccatcaaaaagtgggcgaaggacatgaacagtcacttctcagaagaagacatttatgcagccaaaaaacacatgaaaaaatgctcaccatcactggccatcagagcaatgcaaatcaaagccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccgtttgacccagccatcccattactgggtatatacccaaaggactataaatcatgctgctataaagacacatgcacacgtatgtttattgcggcactattcacaatagcaaagacttggaaccaatccaaatatccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacatcacatattctcactcataggtgggaattgaacaatgacaacacatggacgcaggaaggggaacatcacactctggggactgttgtggggtggggggaggggggagggatagcattgggagatatacctaatgctagatgacgagttagtgggtgcagcgcaccagcatgtcacatgtatacatatgtaactaacctgcatattgtgcacatgtaccctaaaacttaaagtataataataaaaaaacaaaaaaaatggaaatttaacaaaatagaaaaaaaaagaaatgtatagtaataatatacattgtgtttatttttatgtttttaattggaagaaaaattttaaaaacagagggtggtatataatttaaaaccaaattgaaaatggcttcagatgttcagcatctatttgtaaaccaaactaaagatatggagactcatccaccaattattgtaaaattttaaagaatgaaattagaatttacttttaacttagtgaacctcatgcaaaaagttttcttaagttattttgaaaaaaaagtattacttgtaaaagaattataactgagatttatgtagctgagttaacatgaagcaatagtgacatgcaatagcattaaactaagtggatagttacactagttctgtgaagtgtcttaaaactgattgttactatctactttgtttagggaatctctgttaatataagagactcagtttacaaccttcttcaaatgattaggaataacacagctgttaaaatgcatgagattacactgtaatagcattctttacctaataacaaatcaggccacaaatactaatgaacataatcactgggcccttaatggaagatgtctgctaattttgaaagctttacaattagctgtgattcaatgaacctgaatccatgttaaattaaactgttagggaagacaaaacagtgttgtttcaggcaggcaatgctaaaggttctaactgaattttctcaaggcaaggtaattttaaagataaaattgttctcttcttttgttactgtaaaagtgaagctctgcttcatttataaattgtactcagattaaaaacccccttttattttattttttaaattaataacctaccagagccatcggactgccaatgtttcaaaccttctctctcatctttcttattgttcaggttcctcacatagggcttctttctgcccagctctgcaagcctattccagccttagaatccttacccttgctgttccctcttcctagaaggctctgctccttgctcctctcataaatggctccttttcatttaagtctcagttcaaagacagcattccagagttttcttttaaagtgctcaccacttcccctaatgtaggaagggaattattcctttctttttgtcagatccatcatcaaattttgatttattttgttaatttttttgcttgtttattgttggattttccattatggaaactacactccatgagagcataaaccattatttagataataactgccataaacaaactaccattaacaaatggttggtacacacacacacacgcatgcataccacacatacacacacacatagactcacaaataaatatatttgtaaatatgtcatatatattttacaaagttaatttttttgctatttgctagcaaggttttttctattaaaaatatattatgagagctttcaaagtcaataagcagatccctgtagcaaatttataacagctatagggtgttccaccatttcagtacactagattatcaaatctcctgtgttgaatacttatattagcaccatacttttttactactataaatagtagtttgtctcttattttttaaatagatatttttcacttgcctgattgttttctcaggataaatccctgtaaattaaattgctaaataaataagaatatacatattttaaattatggctcatattgccatactgtcttcccaaaatattttaccagtttcttcttaaataaacattatataaatcttggccatattgaaattatgaatacttgccaattcaataggggataatatataatttcttttttaataaattatggcctttgcctattcttctactggaaagtttattttttgttgatttctaagatctattcacatattaagactttaatatctatagtaaaattactctcagttataaatacttttccaatatttatatgtattttatatatcttggggcatatatctttagttgctttacagtaaaatctgttttcccttcaggatttttgagtttagtattaactttaaaaatgggcaccttccacccaagactatgaaaattgcacactctctctcacacacacacacatacacacacacaatgtacatctaatacttatcacacatgtacatgctatatattgtatttataaaatattttatatttccaaaaactgttgtaatgttttagatttaaatatttaatcaagaagttttaaattttgtttaatcaacatgtaataattacagtgacatgtaaatgatgtacagtataatacatgcaggtataaatatagtttgagtatttcttatctgaaatgcttaaaatcagaagtgtttcagattgagtattttttaggattttggaatatttacatatacataatgagatatctgtgatcagcacccaagtctaaacacaaaattcatttatgtttcatatacatcttatacacatagaactgagatattttcatataatattttaaataattttatgcatgaaacaaagttttgactgtgttttgactgcaacctgtcacatgaggtcaggtatggaatttttcacttgtgacatcagtcagcactcaaaaagttttgggtgttggagcatttgggatttcagaattgcacattagctatgctcaatctgtatgtatatccacctgaattttctttaaacactactaaggttttgctacttagaagtaaaatctttggtcaagcacagtgcctcacacctgaaatcccagctctttgggaggccgagaagagaaccacttgagcccaggagttcaagaccagcttggaaacatagagagacctcttcaccattaaaaatcaaaaacattagccaggtgtggtacacatctgtggtcccagtgacttgggaggctgaggtgggaggattgcttgcacccaggaatttgaggctgcaataagccatgattgcaccactgcactctgccctggacaacagagtgagattctgtctcaaaaaataaaaataaaaagaatatgaaatattcaaccaacatataattaattgttatgggagctataaatagaaagtattatctctctcaattggctttgatcattataaacacacacatacacatagaaacacacacatccaccgtttaacccacagaaatgaaatgccaagattttcatgcattgtaaatccccatataaactaaactatatgaactaattatagaatactatctatctatttatctatctatctatgtagtcatttctagattctctattatctcctattgtttcttcattgatcccagtataattattgtgctatagtaataacacctgtatacctggtggtgggcaattctacacttaccattcagaattgtcccatttccacatagtttttgtttgtgaatgaatacaaataagaatggttttctacttaatacttgcctattagtgccaacatcagcttgactctactaaaaggcacacaagtgtatctttccgtctctgtggtgaagcttctcttttgggatgggctatacttacatttttttttttttaattaggaggaatatttccaaatgtccttcagcaagccagtatggtaccttatcagtgccccaatgcaaagctccaaagcaaacaaaggaaaactctactgtaagtgctcaaataaccatttcttatacttctgatacaatgaaaaaaaaaatttcttcaaaatttttcagttgcatgagaaaataataattcaacattgtgcaaaagaagattatattagaatattttacaaaagtcattctcatacgttttatacttacagatatattatatttttaaaacattattttaaaggagaattaacatcaattatactaatatgttctgtgtaaaacaacttagcaccacttttttaaaaaggcattaattcaataactactatgctggttgaaagaaaaagcaaaatttgagtttcacataacattggtctcattttcatcctgaattttaaacaaaagtctataaacaagattagagaaatcgttttataaatttgaatgttgagatttatataaatatgccattataagagtttgatacaaagtacttaatattttctattgatatgttccaaagagaacctcacaaagaatattttttctgtatggcaggaaaaatgctaaaatcccttaattgcaaatgtgaatttcccagctgacattaattttggtttataaggatgcacattaaaagcagtgttgcctaagctcctaaatataaacttagagtaagagtttagtaataagtatcagttatagaggctatgtgtataggttgcattttagaattccttggtgtttttagtcatgactaatgaacagcccactctcaaatatattctgaaggtagatagtttgaaacatcgtgatttaacaggtgccttactgggtgactcagccccttcactctgactctaacaataacataaaaggatttttttttttaagtgggacatcacttttttttttttaatcaagcacaaaaaaagactcttacgctttcaattgtgctgtctttaacttggattatggaactgccacctcgtcagttctcaagttctctttaaatgttctgatattttcaaccacatctccaagagaagtgatggtgtgactagagtctcactaaataatgaaagcttgctttattttataagttaactgttctaaaggcaagggctggagcctacatctcaaagtctaaaatgtcacgattaacttttttcattttctttgtcttctttgctcataatacaattaaatattatgccaaatttttacctgtgtgatacatagccatgattaatatttttgaaatgattttaatactttagtacaaaattattagaaaatatgataaataataatacagcttttttgggggggtctgattgaatgctaagagctttaagcacattaatttaattaagcttcaaagcaaacttatgaggctggtactatttgtattcctctttgacatatgagaaaattgacacaccaaaaaattaagacacttgcccaaggccacccagctaagagtaacaaaattgggactcaaagtcaggaagactgcttttgctatatactctggaagagtatgatctctagttagatacaaagtgcttaataatttctattgataggtctcaaagagaaccttacaaataatgttgtttctgtatatgaaaaaatgctttagtacctttaattaactaatactcttctacagcttccatagtctgcaattatggcagggtcataatgaaaataaaagagacaccatttcctttacccagcaatgccaattcctacagttatacagcaaccccaattcaatcactcctagttctggaagtcccagtgtgctagtggtgtctcataggcttgctaatgtaggtatcctatagcatattgttcaggtcactgctatgaagtttattgctgtctaattttactcttgggttaacctgattcactcatcaaaaaaattgattgtgtctgtaactattcccatcattgagaaaatagtggagaacaaaactaaatccttgttcttataaagcttatattctagagaaatgtgaacagtgacaatttgtctgttagtaataaatgctgttgatgaaaaagtcgaagatagaggatatcattttatgcagaatggtaggggtaggtctcaataataagatgacatttggaacaaagaccttaatgaaatgaggaacgatctgtgaagatcactggaagaagactattttaggaagagttctgaggaccatccaggggaccagcgtaattggagaaaagaaaacaaagaggtaagtagtatgtggtcagagagagagaggtggtcagaccaaatggtaaatatgtatagaagcataaatatgtccttatatacatataataagtagatacattcatacacactttcatgcattcaattctatgtattgaaggtagagcaaagatgattaagtgctggctgatatattttgggggagaaagaaaattaaatctaggatgacttcgaaattctggcctaagcaactaaaagaatgggatctattacaaaggtatgaaaggcagctgagtgagcaatttcttagaaggtgaatgagaattaggtattcaagttataaacattttaggcttgatattcctatttaatgtcaaaggaagatattaaacaaccagttgccaatgtgagtcttccttgaggaggaataaaacatctagggttgccacgttgtgaattatattgaatgccctcgaatagataagcacaccctcagagtggttatagaaagaaaaggcagaagaccagccttggatatgttgatattttgaagctgggaagatatgaaagtggttattttgttagactctgaagaaatagagggtctgagtatccttcagacaatatcccataatatgttttgcaaaaacagttttcataaaacatatgtggttgatttcatggagatattgtactttaattacaactgtggtaagaccctttgactttagcaatgaaccaaaatgaatataagggtattcttttatgcaaataaaagctctatttatgaggacatatatgttaatgcttgataggaattgctctagcagcacatgtcagctcttaacatttcgaggaggtagtggtagaggatttgatatataattatctgtaaatagtcaatgggtgttaatgaagtggaaagtttgttccaaactccctatgtcattcttcttcatattaaactggcagacaagaggaggtcaaattgttaaagaaatagatgtactccttggtcctaattttacaagatggcacaagaaccctggaacatacattcaaatttctcaatatacagagtacaaaatagaaataacacaatttgtacataggattctagtcctaggaatactctttgtacatttggtaagactgtgtgaactgtttatcttcattcacttcttttcccatttattaatcttaagagaatttaattatatcaatagctgaatctactacatgttaatacatattaatagcgaaatcggtatgtgttcttaaatttgtgcttgtgctctatggtttgtatacagaataatttattttttaagtaggagattgcaaataaaattacattttctcagatgatatcagattaagcctcaggtgaagaaaagctactggatatgagcaggttaggatatggtcaagctttacgtgctttttctcagcttttttcccccagtaagattaaggtgatgtccataacaatggtcagaggaatacatttgctctcagtttccatgaatataaactttaatgcttgggtgaataatgagaaatatatttgtaattttagaatgttttgcaagctgcatgtataaaactttgtcaaggaaatctatatcacataaaacaatcgtacaatcacgataaaagtatattcccatgaaatttagaaaagctaatggcattatgctcccttgatttcatattatcttgtcttttttactattaaaaattaaataattaaaatcaaatttggactattattgtgaacacaattatagtttcttacaaatgactgaccttaataaacaatttttttaaattttaactcacagttcaattaaaaactttaattagaactggaataaatttattaaattttctgtaacaaatatttaatatatttattgagtaaataaattaataacatgtaatattcatatagtttcagaaatactttgttttaatattaataggtaagatcataactagtaataatggctaattgttcatttattaccattaagtttatatttatctacatataatgtagaataacaatttttataagtattaaattataatctaaatacataaagtttgttctagaatgtgaaccaaagctacaaaattaattttactgatttcatccactgtattgccttattttctatgtgaacaaagagctggatcagcaaaacatttggatgagttgtagtttgtgttgccaaagaagagcatagagctaattagcctatataggaaataagctcatgcttttcaactctttagaactatagtctaaatactgagatagtaaaattgccaaacagtccataaaatttgcatgacatttatttaaaatatcaagtataatccatggtgattgagattctatttctcacccagaagttcttcaactagatagtaaaatacttggaaagtaccaacacacacacacacacacacacacaagcacacacatagggcgttctcttcacactgtcggtggaaaacacgaaagcaaaaataaatgcctaaaaatgcatgttagaagtgatgctttaaacgtagttttgttactggacttacacctgtgaagtcagaaaaacttcttggaagcttttgttacattttcatgtatttcactttttaaaattattacttctgttagcagatttgtgctaaaaatgtcttcctaggtaagacagcaaatgtgctcagaaagaggtgcgaatgctttggataaataaatgttaccagctagacaagcagcagctggtaaccagaaaaaaggaagttcccaccaggaaagaaaaaagatttttctgaatagaataagtcagaaaaaaaaaatgacaaggtatggcatcataggccttgttgaactaaagacatttcatgatctgaagtaatgtaattgtaagaatccatgagatagtgggacaacatgggagtttaatctggggtcagcaagctttttctgtagtgggccagatagcaaatattttagtctatgtaggctacatactctctgttgcaactattcaaatttgcttttgtaccaagaaagcagtcatacacattatataaatgaatgattatggctgagttccaatacaactttatggatgctgaaatttgcatttcatataattttgatgtggcatgaaacagtgttcttcttttgttcttttcaaccctttaaaaatgtaacaagtgttcttatcttatgggtgatgtccagatttggcccatagatcatagtttgctagcttcaggcctaaatcatcatagaactgcaggaaatccaacactggtggataataatagtacctttatattaatgagcctctttttaattgaattgtaagatgcttgcaagtgaagagggtaaaggtgctgggtgtacttattttcctttgttatttgtttatatgactatcttcacccagaagcataatgagagctcaaataaaccagtgtgctgctcttcctaaaatagttagggccttcaaaactaatatagtcattcaaaattacttaattgagcaccaatatatgccaggcactgtcctgggtgctaggaaaacaatagtgaatgaaagaaacaaattaacctcaagaagcttacctttcaggattgtgtcttaggacaagctccatgtaaggagaatctgagatgtggattcttgtatatgtgatgcaatggcaaagtgctctcaggaggaggggaatggggaagaaggacaaggcaaaacataaaaaaaaacctaaacaagaatatggacttagcttcagactaccgtcaaattgatcccatggagaaaatctgaagtagaaactgtaccacagttagctgtactctgaggcaagggggctggacttttgtactcctgtccctcactggagaggcacctcctatttggcctgagggtaatgcttccaagggagacaggaacattcctgagtggtcattagagagatctgggcataaaactaacatcatccactacagaagggtgacaaataataaatataaatattaaacatttttaatatgtcaggtagtgacatggctttgtggctagaggaagacagagaaagatataggtagagggattgattactcttttacatcaagtggccaaggaagtcctctgtgataatgtgaaatttcagaagagaactgaggaaactgagtcccagtcattcagttatctgagggaagaggagttttaaatcaagacagaactagccttagaatgttctagaatgtgtgagaagtgggatgtggctgaagtgttaaggatgagtggagaggtagaaactgaagctagatgaaaggggtcatgacagattacatagggccttgaagaacattgtaatgtgttcagcttttaccctaagaaacaaaagcaccaagtgctacaagtatgtgcattatacttgtagaacccagacgggctctcaaaaaccatctggtctaacttctcaattttagagatttgtacagtggaaaatctctttgaagataaaagacaaggatagagttctaaaatgtatggaaagtgacttcccatttaatacatttgaagaaaatgctgctataaatatttgaacagtttctacagattatgttcatttgtttaagtcctgaatcttaatgtcatcccatcaatggcaaaactgtgagaggatgagagacagctggctgatgcacagaggatgcatgctcactgtctgacgttggcttggcatttattctagctgtaatttcagcacgttgggaaagggaaatagtgataataatttcaagcaagtgagctgtattttctttacatgcagtggtcagctactgccaagatgactatagctccataaattgttatttccaccaaatccaatgcaaaatattttatgtttaaattgacaaataaagaacaaaaaactattcttggaagataatcattaagtagttataaagcaatttaaaaataacattgcatatgaattcccattaacaatagtggtatcttgtgacttctattagtttgaaagaaatattccacttcatgttagtactggacttcatagaaatatttattagtgggttcagccctctgttgttggtgttgttcaatgtatagtaactatacccaatgtttctaataattcaaaaatatttttatgttccaatgcaaagccatatcttgttttcttgaaagagaatttcttacatttccagctctaccttaaatggtccatatcctagctctgatgtcaattctcctatatgcaagttctgatcttaattctgcttcctgattctttgctattaaaaagttctctggggtgatgattacccctgacggaggagatgtccttgaaacagaagcctaattttcatctcctgtgtcatacttcttcttcctccttttaaatatgttgaactaccaatgacatcaaaaagaaatttaagccaaagtgaagcatttggaggaattaaaaagttttaactgaacatctttatatatcttagtttaattaaatctataattaaaacagcattgaagcatacatcttaaaaagatcacagatgaaaaattcagttatttcctgaaatttcaataatatatacatattctaatatctaggtgaaacaaatacatttcaaaatgtgttgtttaagttcactgaccttaaaaaagcaacatattgctgataaataacatcatgacatacttagcttaatttacataaataagcttttaaaaatatatagaatatttcagtgtaagggaacatttattccatttgcttacagttaaagagttatgtttgtcttattaataaattatatccattctatctgtatttagagttagtaaatttacctgtaaaattgtgtccattctatctgcatttagagttagtaaatttaaaaaaaaatgtaatttaaacatagtctggcattccctaccttaagaggtcaagtgtaaattcttgtgaaattacctgtaatataattggtgaagaagcatggcctacatctgcccaggttttaaatttcaaataaaagcaactccctaattgttactctcttctgtgcagaaacacttgctctcaacaggattctttaattaggaaaagaaatgtttctgtaaaaggctcttactgattatacagtaaaatgctttgggggaaaaattgctttaaattactgacactaaatacatttggatctgcatgtcaaatgcacatactaacttcattcttggatagccaagagctacacacataagtggacctaaaatgggtagaatataaaacttcagttagaatgtcatctgtcactttccctggtttccctgcacagcacttgtttgccccttttggtaaagagatctcaacttctttgggatgctacctgtcttcaatacacaataggaccaccaattaaagaactgcacccttctagccaaggtatggccctgtgactcaaattaggctgcctcaattctctgacctgggagtaaattttgaacagagttccatgaaggtggaaaacaattagaggtaattcatcttatgtacaaacaccttatcaattgtcccttagttcctgctcaatccttgatccccatttttttctggaatataactattgggtttcctttttgtgactgagctgacttgtatacacttaataaattttttttgtttgtttttttggctttagttagccagaatcaacttttgttacttacaaccaaagatccctaactaataacagctcataaaaatgattaaatattccatgttcaaaagcatttaaattgaaatgtttgaaatgtttctaataacaaatcagttaaaatcggcacataagatgaactataaatcttaagttgggaagcacagcaacaggcaggcaggtgattatgaaatggatgaatgatagcgtcctagctaaaaaaaaaaaaaaaggtggccgtttttattgcctagctgcagctatcagaaactacattaatattacagaaaaggggaagtgtaaagcctctagtgaaatgaagaaaggggtgcagaaagggccaactgtggagaatctttcatgttgaccccagaggttttcctagaaaaatttccctgaccaattttctttaatgatggttctactctctaggactatatattttgcttcgcatgtattctaagcttattgcattcctcaatgcatttataaactccaattgggaagggactatggttactattttttctatatctggtagagtgattgttcagaaattctattccattaacacctaatacacacacacataaacacacacacacacacacaaacatacacacacatatgcatacatctagtggcaattttatctctacaacttctcccagtgattagctatctgctattaagacatgatttcaaaagaattgggggtctcacaaagcataaagcttatcccccctcacccctgttccaccacctacacatgctaattcaacctgagagtgactaaaagtttacgatgagaaaaatattatttttactacaagtcttttataaaagcaactcaaccttttttgtcataatttcatgacagagcactgatatcatagcagccacacattttttagtcacataaaactggcttcatctttcactgtttgtttgatctgggataaaacaagcattctctctaaacatctagaaaaaacaaggtaataataacatcaacctcagaagggtttagcaaggatttcagtgagatataacagtgtctgatatattataagcacataatagatattactattattattatttaaaacaatgtgctgtacaatcataatatatctgcagtggtggtgtaggacattagtttagatatctgatttctaattgttattagtgtccaggaaaaaaaaatcagtgtttcataggacactttcctcagggcatttagatctaaaataatattttttattgtacaacttcatacagatgatgcaatatataaagtagatataacctaggagtattcaatgtgactcattcctcagtcttccccaagccccacgtttctcccagccaagattaatcttaacaaaaaaatcaagtagtcacataccttgccataatattagaagacagtgtatgacaatcatcattaagaacttgatgtcaaatatatcaacttgtctctgacagatttttctctaaatgagatttactgtccatcaagtcatatatttatgatcttaaatgtacttattactagtatcttatccccaaatctaaataggctagatctgacattgacctttattaaaattacaggtagttatgcttttgtagtttctccctaaaatttaaaaagtaatttctccttaatcaacaaaggtttgtctgacatcttagaaccccaggagagataggagataggaacactatctcaattccatattaagcttcaatttcccacagcaaaatcccttgaggaatagttcctgtattttcctccctttgccttctggaatgcaaatcaggacgctacctcaggcaggttccagttcctacgaaggaagttttatattatcaaaatattaaatttatgttccaaatcacctcatttcaactctcctaaggacaactcctcttctgaaaaaaaacaaaacaaaaacagttcaagggatgtttatgtaagcacgctgtgctaccttcatacaatatgatttttattcaaaatttctcttctgaagattcatgaggatgcattttgcaaagtataaaagatattaattacctgttcaacttgtcaggttcagaaaatacatgaataacacatcaattagcaatatataacaccaaagaacaggacataacctaagaatttaacctcctatgatctgcctagcttcaatttaaagtctaaaggcacaagtgcacatattaaagcatataagcaaatatattcagaaacctagtgttaagaatattctgtgtttttaccttgctgcttcatatttctctgctctactaactgcatgcaaaccctttaaaacctataattaatatctcaaaatgctaactagttcactgcactcttcctgcctgtatttaaatataaaagataaaggggacacagtttgccagtctacagaaaatgcacagccaacctgcacaagctgccacataatttatggtgaggattaaatgaaatgatatatgacacatatacaattagttcagacacagacagctgaaagaatgttaataagtcaaaagtcaatgaactttcttaagattcatgaaaacaatgaccaaatatgtaactctgtaaaaactatccatactgtggtttggggggaaataaatgaaatgcattcttagctgtcattatagtcacctattctgtcattggtattttaattctaacacacttcccaggtgtccatgaaaagaattacacttctttcataaaaaacgatgtcatcactttatagaacacaattatctatacacattgaaaagcttccagttgagtttattaaattcttgcaaacacaactattgtaatgcaaattagagaatataaagacactctagaatttctgtctacaaagcaagctcactgagaaaactctgcatattataatgggataattcccctttaagttgctttatatctgaaagcataaatcagagggtaaaattaagatacatttttccttcatgactgtaaataaaataaattgtaaatggtattatctgttaattttatctaaattatcagctaaaatgtttgagattgaagtacattttgggatatttcaaaatattattacttcactcatttcaaataatcaagctatctacaaatataagaaaagtgaaacagggaaaggtgactgtttcataagagaatattcccaatcatcttttggcttggttacaatgctctatctctaaatgtgaataatcttaagaaacaatgttagaggatttataggatatcttcttttaaaaggccatatttgacattgttaatagtgattgttaatcgttctacataaagtttccaaataacattgtgttatgcctgactgataatgtaaaagctctataattataagcaatgacaagatgttattaaattgcttatgtaattttgagccttctatttatttatttatcatttttataaatttagggggtacaaatgcagttttcttacatgaatacattgtttcatggtgaagtctgtgcttttagtgtaaccacaacccaaataatgcacattgtacccattaggtaacttttcatccctcaaccccctcccactctctcacctttctgagtctccagtgtttattatttcactctcttatgtccacatgtatgcattatttagctcccaattataattgagaacattcgactttcttttttgagttatttcacctaatttaagacaatggcctccagttctatccttgttgctgcaaaagacatgatttcatcctttttttatgactaagcagtatcccatgatatgtatatataccacatttttgtttacccagtcatctattgatgggcacttagattcattccatatctctgctatagtgaatagtgctgcaataaacataagggggaaggtgttttttgatataatgatttctgttcctttgggtagatagccagtggtgggattgctggatccaatagtagttctatttttagttctttgagcaatctccatactgtttcctacagaaattgtactaatttacattcccatgaacagtgtataataggtcctttttctccacaccctcatcagcgtctgttattttttgacttttaattatagccattctaaccggtttaaggtggtatctcattgtgattttaatttgcatttctctgatgattagtgatgttgaacattttttcatacacatgttgcaaattgcctatataattaattcagctttttttcagttatgtcagatcaagggaacaaaaataatatcataatttagaaaaacttacataataagattaggtctacataatctatatattaaattccatacaatgagtaagtttttttccccaaactcccttagaaaatacatacattttaccataatagaagacacatcaagaaacaatttaaaaattggagccaatagagaccacagtttctgatcacagtgcattaaagataacactaataaatttagaaaagaaacaaaacatattcccatcagtaggaaaggaaaaacaattaatcaattgtttagttcttttaaactgcagaatattaatacactgcctatccgaacctattagaaggaaaccaaagagttctcaggaaaaaattagggtcttaaaatccatgttaatgaagaagaaaaatttaaaataaatgagttaaacatctaactcataaagttagaaaaaatatataaacttagagaaagtagaataaagtattttaaaatgataaaaatataaattgataaataagaaaacatacattgtagagatgataaaggaaataaaagtaagttgaaagaaacaagcacagacaaccctttgaataatctaatcaagaaataagggggaggagaaagaatggaagcataaagtaaaaaagaaaaatgacaataggtaaataatagataccataaaaaccttaagaggacctagagtgctttccagtaatcaatactataaaaaaccttaagaggacctagagtgctttccagtaatcatactctataccctaatcatattttctttcactctcttaggaaactatttcacctcttctagactcaaacttccaagtcctctctcatattcactttcaatggatgcccttgctccctacttcactgaagaaattgagtcaaccagaagagaacttccaccaactccccaatcacatcttcccacctattaccatctctactgatatcctataacatctcattaactatcatcgaaaaaataatgtatttttctactaaagccattccatacttttcctctaaaactactcgaagacagtactccaggaagtcccatccctctctcataaatcacaaatgtatggttctcaaatagattatttctatcagcatatgtccttgaaaacatcctgatatctgtctggaggaaaagaaaactttctttctcttaaccccactttactcatcagctaccacctgttcatctcttcccatttttagtaaaattccttgaaacaaccctttatacttgaaatcttttctcctactcctcttcttttaaagtcactgaaacctggattttgtccaccttgagctactgaaaacttgcagaaagagggtaatatgctagaccctgtataagtttgggaatgttcatagttgagttagacaccagctttgcttctgagaagtttctaatgtaaaacagtaatcaccttccctagaattacaaacaattcaaatcaacagagaaactaccactaagtaccaaaacaaaacaaaacaacccacagatggcccatgtattgctattcgctcaaaaaagattatatggcctgcctcttattgtgtgaactgtagtatctgcatctggggtaagtgagctttccacaccattgcctttaagcttagctttggccaacagaatgtaagtagaagtactgctgtgatgcaacaaaatccctgagaaccattgaatgacctgccaattgctctttttagttcctactgcttcaagaatggcatgtctctgattgaagctactttttagctgggtcttagaataaagaagacatgtgggacagagccaaagccaaggtggccaatatggtgcaaaaaggagaaacaaatcttttttgttgcaaaccacagagatttggcttttgttgttatggcaacatattctagcaaaagctaattgatgcagcccaatttaatggtgcctgaaaagcattaggccaaggaattctgggttccttccatacatttcagaccatgtcatatcaaatcaaaataatgctatttttctccatcacaagcttatttatataactaaaggttcatgagcaccttctgaattcatagtactaggagtcagaaataaattcttttcaattgtatttaactttctattggctcatttagctcttctgttcgccacttcttggctgtttcgaacattaatttacaaaagacagtttttcactaaccatcaaaagaagaaaacttagaatgatagaaaagtaatataatttcattgccatttaatcctattaacatagttcaagtatttctccttgtttctatgctgtttctttggggatctctacttttgctactcaaatagtcaaacagaggcatctgagagcttgttaaaaatgaaggctccaaggccccacccaagacctactgaaacagaatctgcattttaacaaagtctccagctgagatgcacattaacatttgagaggctgtggtttataaaaaaacaagttctcctttttactagatgttctttttcatagatctggagtagttaacagccaggatcattttttctttttatgaaactttcaggtgatcctgatgtaagagatttatataatacattttgagaaaaatcaatttaggcttagctgagtatgtctgaatctccagttttgacacttagtactagttgcatggctctgtgaaaactacttctccaaaattcatttcttccatccatggtgaagttactacctatttctatttcacgggtttataaggttctatcagatagtgtacaaaatatctcactgttaactgcaaaggagactaaaacaaatgcaaagttgaaacatattaggaacataataaaatgtgttgattaatatgatgaatgtgtaaatgaatactattcaactctaatgcaataagaagaaataacacaaaggaatgatattaggttatgggaaaatactgccaaaggctgacacagtctctgctggtttggactattgccttcacttttggttgtttgttgtttgtatttgatatctctccaccaagtccaagagcaaaaaggctaagaatggttgagagtatcttttcttatagggctatttaaaatagtcatgactttcaatcacataaacataatattaaaaatgtcaatggcaaaaaataattcaatataaacacaaagtaaaaatcttccttccccaaacatctttatgctcagtctcactccccactttcaatcatttatgtttccaggttttctgttattttccactacagcataattttaaatagtgcaagatgagaaaattagtacaactatacttccttctacttgctatccccctctccttctctcagcttctattatctaaattttaataaaaactatagtttgttctgtaactatatctagattttccttgtatttcctatagattacaatttttaaaaataagaacatttaaaatgttataaaattactgttgttttgcagaaccaagaaaaaatattgaacaaacgcagaagacagatttccttgccattaaaactgctttttagtaaagcagttgaatttgataacccagaaaaagaattctaaggtgactaccagaaaaagagtaaacttatttcaaaacattctgacctatttaacaaaattcagcaatgtgatagatggtattgagagataggtggacagatgggtaaatgggatggaggaagaaaggacatttttaaggaaattctcaactcatctatctgtagtcaactctgaaaagataataaaaccacatatttataccaaaagaacgtacaattatgggctacatatatgtaaacatcaagacactttcattacgaaatatcaaaattgttttggaagtgaatggacccttgaccaaaaaactgttaataattttattaacttaaataagtattacaataaaaaattaggaagagaaacaaaagatctgtttttttatagggtccaaatagtgttatatctacatttttagaatgactacattagcattttcatcactgaacttgaataaatggactcatttaaataattagcacttagaaggcacactaaccatggtcacacagaaaaatttcataaatgataaaacattcaagaaatcgggatttatttttagagcaagtcctctggatacttttgaaatgcatcaagccctagtgacaacgttggacatactgaaaacaattgtctttctgtatcctacactgtactttgcagtgaattcctgactttgatattgtgaatagtttcagatatgcagcacatactttattattggagatatttttaaaagtagcctcaagtgcggtaaacagaacagccccccaaggatatctactcagtaatctgtggaacctgtgaatatgttacatacatagcaaatggaactttgcaaatataattaaggttacggaatttaaaataggaagaatatcctggattatgggtctaatcacctgaggccttaaaagtagcaacatttctccagctggagtctcagagctgcagcagaaggaaaagtaaggagatctgaagcaagggaaggaactgatcagaccattgttggtttgaagacagatggggaaaaattaggatgaatgcagcccacttaaggtattgaaaagttgcccaccatagccagtaagaaagctgggacttcagttccacaaccgcaaggattgaattcagccaacaagtggaatgagcttggaaagggatttgtccccagaactgtcagaaaagaatgtagcctttgctgacaccttaattttagctctgtgagagtctaagcaaaagacccagttggctcaaggtctacctgaacttctgacccacagaattgtgagataataaatgtgttaagccactaaatttgtgatcacgtgttacagcagcaaaaggaaaactaataccatatgttcctttcctcctttgcatagagaaagttctacacattatgctcctattttgaatatacccattttccatgataaattgagcctggctaaattaaatgaatattaagaactattcaaatccaagtgtattagtctgctctcatactgatatgaagaaatatctgaatctgggtaatttacaaaggaaagaagtttaaatgactcacagttccacattgctggggaggcctcaggaaatttactatcatggcggaaggcaaaagagaagcaggtaacttcttcacaggtggcaggacagagtgagggcaagcaggggaaatgccagatgcttatgaaaccatcagatctcatgagaactctctcattatgacaagaacagcatgggggaaaccactcccatgatccaattacctcaacctggtcccacccttgacatgtggggattattgggattataatttgaggtgagatttgggtggggacacagagctattatttctggtttcacaaaacaaacacttggaccagaatttattctgtcctcaaatggaaaagcaactaaccttgatatgtctgctatatgttagataacaaattaggaaatttgtaaataatattttatgtaaagttcaccatgttccaattaaatgttattaccctaaacctgagttaatctaactacagggtaatagttgtttatatgagaattggtctagaaggcacgaaaagtataaatgagttcttgttatgacaaaaaaaaaacctagaaatttctgagttaggtgcattagtaccctttataaagaatgaagaatccctatttaaaaaatgtagtagtttttgattaaaactgttacatctctgttgctcctgccatcctggtactgctgctcttattgcaactgccagagcttccacacactaacatcacttccactgctacgcactaccctactacaaggctcagttgaaactcacagccttggtcttcagaagccctgttttggatgctgttctatgggtcctacactggctgttcaaaatgctttgttctctttcatcccattttcttcttttcttgtctgaactcagcagttaaaggaaggctatatctggtctgtctggagagattgagatggaaatgtaactttccagtgttttttccatttctgcacataacagtgtgaaatacctgaatctgaaggtttagcactttttttgtaatttctcttggctatgaatgtgggtctcatttacttttcaaaaataaagatttgagacacagggaggttcagtgggttaaggtaacttgaaacccaaacttcaaacattgcgagcaaatgcattttctgtctcaagtttcacaaaagagccttactgtgcttatatctcaccataaaaatctaaacatttgcttttaaagacacttcagttaattaaaaatatataaggttgaaatagtattaaaagtgatatatcattatatgagtatatcaatttagagtgctggttaatgtgagggttcagaaaacagacaaccttgggtagaattggaactctgccatatactatctttgcaaactagagaaggtgagttaatccctctatgtcagtttccttatctgtaaaaggggaataataatagtacctctagtcatagaatggtggttcagattaagtttgttatatatgtaaagtccttaaaactatgcctggagttcagcaagctcttaaacatgagctatcaattctggttctgattctagtcactaaagagtcagcagtgcaggggtgggtggggagttctaaataattgtattaaagaaagcatgatgaaaagatgaaagttaattcttcaagcctatgtcacaggatgatatgagaaacacatgtgaatataacatggactgtgacaatatataaagtaattagaaaatatcatatgtgtaagggctcagaaaatgtatcaccactcaaatatctttcttaaaatgcttacttagaaatacattccttcaggcaaagtgatgaaatcaaatgtaaaatataaaaatggacaaatggtgactacaagaatgatagaatcattcaaattgaacatattaatagcatttaaataattgctaatagcttaatttcaaatctgaatgcaactttagactggattttgcagtaaaaataccgcataaaagtttttaataataaataacactttatgttaatacaaattggaaagtccagtgtggggaaaagagcaaggacagagaagtattcaattcttcctctttatatgttggaccagaagatggaatgattactttcctgattataccaaataaagaaatatggatgatgtttttttttaaaaaaaaaaaaaaaacactcacacacacaacaggttccactagtttagttacaaacaatgtgtatttcttacatatactgcagaagagaaaaggcaacaaaacccatttcaacagccaaagcaaaaaagcaaaataatatcaaggaaggaaaaagaggaaataaaaaattaatgacatagataattgctcatgatatgttaagtgaaaatgcagtgtataaaattacatatagtatgcttctaattttgagaatagcatctttctcttagtgtaaaagatgataaagaccatcgacctaaattgaactttaagtaattatagatgcagaaacttgaatattttctacaaagcacacaaaaaaagcagtacaaggaaacaacttccaagaacagacccaaaattaaacacagtcaatatgtaattcaaagtagaaaatcaccaaaataggtattataaactgtgttgaaaattaacttagagcagaccagtaaaaagcaaacaactttcttagttacgtctggccttgtatttttgataaatttattactgaaatattttataaattaatacaacaatcttttattgtctctatatagtagaaatatatatattatggttaagtttatgatggtaaagtacataaaattccagttttaaagtgtgagacatagttcttaagaatatctctctttttaggttttaggttaaataacttctccagaaatataaagcaactagtacgcatcaagtgtttaatccttgttcttgactttctttgactctaaaatcttaaatgctttaaggaagattgcgttttaaaagtacaatggatgtaaattttcagttatgcagtatgaataagttcaagagatctgctgtacaccattgagcctatagttaatactgtattgtgcacttaaaattttgttaagagggtagatctcatgttaagtgttcttaccacaataaaaaataataaaataaaatgagggaatcttaaatttaaatcttgtctctgacacttaccagtaatgtgagaataggaaacatacttttctgagattttatctatatataaaatggaattaaagagattgcttttacaactcttatgaagataaaacaaaatatttaaagaggcaatgaatatattgatcaacagatgcttcttcctattctactacactgagttctttgctcttattcattttctgtcatacttctatcattgtcatatttctatcacatagaagtgtaaatattggtttaatcatcagtcacctcaaataagctaagcattcctgaaagggagaagcatttttcatcatctttttttgtttctataagccatcaggataagcaacattttatcctgtaacctacatgttacattgccaccaggataacctacatgtctatcttttgtattctcataaactagataacgtgcctgctacacacatattttatttaaaacttctgatttgagggctgtgtcttctgaaaatgtgtaagaccaatgagcacaggaatgcagaagataatcagcacctgtcccagataatcatggtctcatattaccactgtttcctatttcagggtgcatattgtgcccaaatctgagaatgctgtggtgaaagtgataggtgctgtggagctcacagttggagtttgtctctaaccccaggtgaacctcttcaaacacctaacaattgttgagtctaaataaaggctcacacagcactgtgtttgtagtttgggaagatatgcacatataaggaaaaaatctctttgctctgagagattacattgcatttgcagaaaaaaaatgcatacaatcacactaagcaagccatcattaataaccagtttagacttgtattttaagttatgtgacagaatagaagaatacaaagggggagagaggcagattagaggtcaggcttgaagacataataagaagcttaatcatttattttccagattagcattttacaaatgtaattctatgaattacctaaggtgattgttaaaagtataaaatcaaaatttccagagaagatgtcattgtcaacaagcactttgagcaattctccttttcagtcaagcttgtgaaaacttctctaggtgattgggagccatggaaagttattttttaacatcttaattgaaaaataatttacatatcacaaaattcctttgtgtttagtgtagaatgctatgattttaataaatgtatagaggtgtgtaatcatcacaacaatccacttttaagtctcccaaaaagatccctacccatttgctgtcacttcctatgcccacctccagccgtaggcaaactttaatctcctttccatcttatagctctgacttttctgggtatttcatgaataaggaatcatgtaatatgtaatcttttatgatgggcttccttcatttagcatgatgatttttaaagtttcattcttgttgtagtgctgatagtttgttacttattgctgaatagcatttcattgcatgaatacacaatattttctttaccacctgagggatatttgttattatgaataatgctgctatgaacatttgtgaacaggatatacatgaaaatatgttttcatttcccttggttagatttctaggagtaaatttttttaattaaataaactactagattatttttatggtagttgtaccatattacatgccaattagcaatgtatgaaagttcttaattcaccacaatgtctctaattctgggtattatcttttgattataaaaattctagatggtgtgaaatgtggttttaatttgaaattcctaatgactacagagattgagcatatcttcatctgcttattgacatctatttaccatcactgatgaaatgtctatgcaaattgtttacccattttttaattgggttttcctcttcttattgacttgtgagagttctttataaattcagaatatatgtcctttaacagagatatgttttgaaagcattttctcctagttatcttagtatttttcattttcttactattttgaagtataagttttttttattttgatgaagttctatttataattttttttgtggattgtacttttagtgccatgtttaagaaatatttgcctaatccaaggtttcaacaatgttttcctattattttcttctgcagagtgtatcgttttgctcttacatattggtctatgggccactttgagtcaatttttgtgtatgatgtttggtaaggttctaaattagtctttgtgcatttgaatagccaatcatcctagcctaatttgttgaaaagactatcttctccacattgaattggtataattgttgaaaatcaattgaccataaatctacggggttattcttgtactctctatcattatacttgctctatatgtctatccttaaactaacctgtttactgtccttttagagtaagttttgaaatcagtaaatgttaaattctccaattttgttaatgtttttcaagattgttttaattatccttggtcctttgtctttctatataaatattaaaatcacctcatcccttcctgtataaaaggctgctgacattttaatagaactgtgttgaatttatagacaaatttgggcatatatgacatcttaataatattgaatattttaaaacatgaatgtctctacatttgtttagatatttttacatttctcttaaagtcttcactatacaagccttgcatgtattttgtttaatttactcttaagtatttcattattttagatgctattatagatggagttgttttaacttcatttttgatcattcttcgatactgtaccaaagtacaatttatttatgtatgtttatcttttatcctgtgaccttgctgaattggtttattcattctgttgggtttatttgtggacatagacgcattttaataaaggcagtaacacagtcagattttaataaaggcagtagcacagtcagatttgtattttaaacagataactctgcagctgtgaaggggatgcatttgaaggaggaaacgccggaggaagtaagagtttttcaacaccgttgggacaattactgacatctagaatactcaaaggaatatataacaagactaggagtacaccagaaaaaaaattgaaaatggtaactgcttattttgtcatagaaatggacatgtttattttaagaaaatcattttaagctatcttttctttgttttttagacaaagtctctgtctgtcacccaggttggagtgcagtggtgtgatcagttcactgtaacctcaaactcctggactcaagggattctcttgcctctgcctccccagcagctgggactacagacatgtaccaccacacttggctcatttaaaaaataatttgtagagaagggggtctcactttgttgcccatgctggtatcaggctactacatttatcgtgcttattaaagttgcagacttcttccaggaatggcagactgtgtaattgggaccagctctattgataagaacaactagaaaaattgggtaattttttaaacaaattttaattcacttttgaagtgaattaataaaggcaaaaaaaaacagtgaagattttagagtttgggatctagggaaaactaagccctcaggcatttcgacctgctttttccctagttgtggaaaaaggagaggctggctcagcacatttggcaacttcacaaggctgaagagatgggaattgagatcaagtcctttcaagatgcagtagccttaatgaatcttcctcacttggaggtgagactcctaagaactgtaccctagaagaaataatccctggatgacagatcttcccagggattatctggattgaggtaattaagatcactgtttttccagacatctggccaaaaaaaataaatgttccctctagatgaagataatattctcctagaactaaaatgacttccactgatgattttacaaatgagatgactgtcacacagtcaaaaataacaatgtacatgatataacttgacaaaaatgaataataattcaccaaaagacaaatgaaacagataaaaggaattcctcatattcaagttagcagaaagacttaaaatggccatgtttcaactgttaaacaaaattaaaaacaaaacaaatggaaaagaatgtttaaagatagtaatcacaacaaaatattaaatatatagactcaacagcaaattagaaacagcagagaaaattagtgaactaaaatttcagtacaaaaataaaattccaaatgaatcacagagcaataaggggatggaaaatatagaagaaagagtaagaggaatagaaaataaagtgagaactagcatataggaagtggcattccaaaatgaggggggaaacagaatgtgatgaggcagtatttactgaacaaaagtaaatatttttccaaaccaataaatggcagtaagtcacaatgttaatctctatggacactaagaagaaaaaaaggaaaataaaaacaaatacgttttaagtacattatagtaaaacttcttgtaaagaaaactctctaaagcagccaaaaagattaaaaaaaaaaaggacagtttactctcaaagaagaaacaattaaattgacacctgccttctcaacagcaacaatgaaagtcagaataaaataatatgtcttagtgccaagtgaaaataaccactaacgtaaaattctatctccagtagaaatacctttcaggaataaaggtgaagtaaagatattttctgaaaaacttaaaccagaaaaattactcatctgcagacgtacagtaaaagaaatattcaagtttatttttcaagtagaagaaaaatgatcccagatgaaaagccagaaagaatgagatccagaaagaataattggtaacataaatggtatacatgtgaataaatctaaaggaatattgcctgataaaaatataataatatatttcacatcctacacatggaagtataaggcagggaaagtatacattaacattacactttgctaaggatgcacattgtaatttgtaggttagcaaaagaatagcaagagtgtaaaacttctagataacagaggaaaaaaatgcaattcaaatggtggcatgaaaggttgatttaaaaaaaaaacacaggataggaaaaatagaaatcccttggtaaaatagtagactaaatacaaatatacaagtatttacagtaattataaagataccaaataatttaaagagaaagattatcagtctgcatacaaataaaattcagaaattgtttattatttgtgggaaacatatataagaacacagacacattgaaattagaaatatagaaatggcacacaatgcaaacattaacagaaaagaaatctgctctaatactattactactagtaataaaatcagattaaatagaattcaagggaaaataccagtccagaaataaatgggtcacttcatgatgataaaaggctcaactggccacgaagttatacatatgatatagtcaaataaaactgatagcagcctcaaaatatatgctaaaaataaaagaattgcaagaagtagaaactctataattatagcatgagacaataaaacttgttattattctaacacagaactttagatgtggaaatgcaaaatgaagttacatttttaaaaaaacaaattaaatatatttgacagttactaaaacttatgatttcagaagtcacattttctataaaaggaatactagctgaagagattttctaactcaagcaacatcaactgccacagattatttgtccagatggaatatagttcatagtactgtattctgatagcatgatggatcagacaattggctaacataacttttaaataacctttttataagcattttaaaataaacttttctatatacaaaattaacaaagataatataattttgatatttagaactgattttatctcctttatcttagaaatagatcatgaaataatattcttatcagggaaaactttcaattcaattaccaattttttaaaaaaacttggtcaattaatctattatcgatcagcaacatatcaatgcatcttataaactcttataagaattaataaaaaattttgaactatatcacatatcttaattgaagcagattacactaaaagtggacataaaaagagaaaatcataggtaagaataatacatgaaaattaatttaccgtacatagaacaagatagtgtcaaattctaatcacataaattcctaaacaatttcttccaggtaacatcaatattaacatgggcttatagatttaaaaaagaaaaaaacaaaaacaaaaacctcttcaaaacagaaaccttcttctggcaaatatcttaggaataactattagtctttgtacttgcctggaagacaacctggggcttcttgacctaggagggaaagcagagctgggagccaagagcaatgagatttcattttcttcctgtagcacctattgcaagttccagggccaacaatctcactttttgaaaagcaaaaatgatttaaaatattcatttttggggaaatttgttctaattcaaggcccaaggaagaaattgccagtcattcagaatcttactcaataaatttaatcatatttgagagaaaatagtagagccttattatgagtattttttaaattatcagtgtcacaaataaaactctgattgcaatgcaaattgtaacttaaaattcaagccctatgtacgtttggcctatgaatcttttcttaaataacttaattgttatgactcttaagtaatcaaacagcaagtagtaagggtttactaagagccaggcagccttagctaattcagagatactattttgtaaactgatttaattgcagagatcaatgcaaaggtgtgtgatctacttagagtgtgatagtcatgttttaaaagaagatgtccacaaccacagttctaaactctccttttcacaaactgaggaatcgtgatggttgttgctaccttaccctcaagctgtaaagctctgaagtgaactattcaggaaaagtaaatagtgtgaatttcagtgtttctgttactgcatatagaatttctcatcaaagattcataaaaataaatgaatcataaacatgctaatattaagtacaacaaattagactataaattttagcaaaaaatctcaggttaaatagaaactcatcttgataatactaatgactatttttctgttggtatcattccttctgacagaataacaataagagcaggccaaaaaaaaatagaataattcaaatataaactattccaaagtgaaaaactaatcaaaatattctacttttcattttgtccttccacaaactgaaagtcggatatagataataaatagtggtagcagtattataaagtcatataaatattcatacacttttttttgtgtcaaaagtggcttagtttaagaaataaattccttagtgaaaaaacatgaagaatgtgaaaaaaatggaatttcaaatccacagaaattgtgtcaatatctcttaaaaattccttcaaagcaaatcatatacattctgacctcagtgctatgattgtaacatattcaaaatgtcaccaccacctcttgatataaaacccacttcattcttgaaggggatttgaggtgcagcattaatgctggtctcatacataatgacactcgtgttgtagacacttgagccataaggctcgatgaattatatttgttttcttgttttcattaagatttttaatatatgatagttttttttttatgattgcatgatttgctaaacaagcatagagtagatatggagaatgtacacaacaagaaaaagaataatctttgttttcatttatttagtattttttttaaactccagctaaatgctagatattggagacagaaaatacagctatgaaccaaatataaaagaatcccctgactcaagcttgtccaacctggggcccacaggccacaagtggctcaggatggctttgaaggcagcccaacataaattcataaactttcttaaaacattatgagatttttttggtgatttttttttttttttagctcatcagctatcattagtgttattgcattttatgtgtggcccaagacaatttatccttccaatgtggcccagggaagccaaaagattggacacccctgcctgacctcagagagcatagagcccaatggaggaagaaagagaaaagtaagataaagaaataaaatatacactatactaggtggttataagtgctttggaggaaaagtagagaagagaggttgggtgtatgaggaagagggatgtaataatttcataaatttaagcaggatgatcaggcatggccttactaaataaatatttgagtaaagacctgaaaaggtaaagaaagcaagccatatggttatttaggggacaacttttccaagcctagagagcagccgcagcagtccctaaggcagttgaatccctgacccgttggacagcaagaacaccaggatggtgggatagaatgagtgagctggaaaacagtaagatatgttatcagataggtaaaggggaattgcaaatgttaacattgtaggcctggttaaagacctaggcttttccattaagacattaagttatttcagagatttgagcagatatgaaacaaactctgacttactttttatccgaatcagaatctcttttatggctctgaattatatcgatgagctacaaggacacaagcaaggagaacagttaggaaaatttcatctgattcgggtaagagatggtgactctgactaggatggagttgcagaggtacttatagtggttcaattctgcacatactttgcaggaaacactgagagactgctgctagattgcacagagaatatggaagaaataaaacactgaagttttgggcctaagccaatggaagattgatgttgctattaattgagatgtcaaagactaagtgaagatcatgaactcagttttgtacacgttagacaataagtgtctgaaagttgaaagaatgtctggagaagaggtgaaaattctgaagtcatcaacatttagatgatatttaaagccagcagatggatgacattatcaatagtgtcaatagagatagaaaaagacaaggttcaggatcctggccctggagtaatcaagcattaagatgccaggaagatggcaagtgaacgataataaagactgaaaagtggccaaaaacaaaggaggaaaaccaggcaagtgggctatcctaatgccaaatgaggtaagtgtctcaagaaagaagggggatccactgtctaaagttgctgataaagtaagcatgaataaagactgagaagtgaccgttgcatttagcaatgtgggagatattgctaatcttcacagagcagtttagatgaagttgatctaaattcatgttctcttaaatccactccactcagggtgaattcaggctgaatgcctgaacccaggagttgattcaagagaaaatttggggagaaaaataagaacagacgtagccaattaaaaaaacaaacaaggctgggcatggtggctcacgcctgtaatcccagtattttgggaggccaaggtgggtcaatcacgaggtcaggagatggagatcatcctggctaacacagtgaaaccccatctctactaaaaatgcaaaaattagctgggcatggtggcacatgcctgttgccccagctactggggaggctgaggcaggagaatcatttgaacccgggaggtggaggttgcagtgagccgagattgtgccactgcactccgggccacagagtgagactccgtctcaaaaaaaaaaaaaaaaaaaaaaaaaaaaaaaaaacttttgctgtaaagggaaagataaatggtggggtggcatcttggtagagtggtgggggggtgttaatagctttttttaaaaaaaaaagagaaatgtaggtacatattttaatgctttcagttataatttattagagatggaccaattcataatgtaggaaaaataatgcaaacgttttgtccaggaatagcaaggagggatgagatctagaacaaaagggaaaaagttgaccttttctaggaacatgtacagttcatcacagtagaggataaaaggcaataagatcactaaaaataacagccagtttcactgaatttacaaatacatgtgacagccagcagaatttaggcagtgccttcttatttgccattatatattcctagaaaccataattgacaagataaaataaaatatagatagcaactctatgccataagcatagaacctgacacagaataggccctaaagtatttgttgaataaatagtaattatttatgaaatggttatgataaaattaatacatctaaaatgtttgcccttcataatcatttaaaattagcaaaataatacaacagattagagagactataattcttttgtatgtaagacaatagaaaatagtaaattcttttgtatgtatgtaaatagaaacctcagaagttcagtggttttccaatgtcacaggttttagcaaaagttgaagctgaaatccaagtgttctactttctagttaaataccctttcatgtaacctacagtttctggctgataaaatggatcttatagtctataaaatatgctcagtgcataaaaaggtaaatttatagtatcataaatattagactggggatccttaagtaattaaattcagtataattatatgaattctaacaatcatttcaaatttcattaataataatttgtttgccttactaaaacttagaggtagtcatgagaaatatgagaaatgctttcttttttttttttttttttttgagacagagtttcactattgttgcccaggctaagtgcaatggcacgatctcagctcactgcaacctctgactcccgggttcaagcgattctcctgcttcagtctctcaagtagctgtgattacaggtgcctgctactatgccccgctaattttttttgtattttcagtagagacgtggtttcaccatgttggccaggctggtctcaaactcctgacctcaggtgatctacccaccttggcctcccaaagtgctgggattacaggcatgggccactgcgcccagccacaagaaatgctttctattgtccatgtcttttaaacagggtttccagaggactttaatacttcttttaatctagatgaacataacaagatgaagaagagggctcagggtaaaaacaaaagtatgtcattaatgggatcctggtgaataccacttacaaattgtgtggtgctgaagaagttacctaacctctctgttccttagttttattatctgcaaaatgggaatagtaataacaacagcctcattggaatgttcggaatattaattgagatgatacctctacccagtttaatgaataagctgaatttagtaaccattttatctcctctgattccctcaggttaagaaattaatatgaaacaaaatttcagacagccgtcctagcttctctagcatgattagacaataaattaattatcttttgttttataatgaaaaagtctagtctagactaatgattttatagttttggtttgaaataggattataaaagagacacagccctaaggtcccatctaacctaaagtttctccccttacacttggttcaggcttacttcaagccctgaagtctgcactggagggtaggagtctggtggtctctctttattctcacttcacccactcacagcaactgtttctgaccacttcagactcagggcctgtgaaaagaaacttggaggggaaagaccacagtggcatgtggctgacccttgtgtcaccactgtctgggacttctggaatggcaaatgtggaagcaatgaccttttttttcttcttcttctggagtgcatctgtggcattctcaaagaacccctctgtctgttctcttctctggaatcaatcctccaaatttgttgctcataattcaccaccttggaacctgggcttctgcgagtatactcacctatgggcttaagataaccctaagcaagctcccctcatgaggaccgcagttgctcttcaaacattgccaacctttttcttgaccttggagaactatgaggacttgcctgccttgaaactccttcatctgctatatgggcatccacagccactgtggctgcttttagattttagactctatatcctttactctctaaaggaaacctgttaagctctctgaatgtttttcccgaagctcttctcacttggctaaggtgagcaggaactgctctcatttctcatacatggagtggtagactatgtacaacaaacaaacagctttccaaaacaaaagtatttctcttttagcttttccaactcaatctttgtagagtccaaatatggagtttgagttaagacaaaacttactggttggactatatcttagcatctcctgcaaataaagtcttgtgcctcacttaattagcttcatctccaacagagagagagggaaacactcccactttaatatctgggtgcttaaataaaatactgaatggcatagcgggagtgttcagaaatgttagctattacaattaatcttatctttgttattgaacacttaagaagtaactacataaggaattggccacaagaaaaaaattgagaggaataaaacaaaatatttaagaactaaaagagtatggtatcatgaaagttaaggggataagattcatttatccattttttttggagaagcgcagtgtcaaataaaacaaacctactacaattattaattggttattggtgatagcgaacattctgaacagggagttagaggaaaaatcagactgcagtatagaagtcgaaaaaattgagacagtgagagcaagtctggagaataaacttggagaataagtttatagaaaaagaaaaaataagttgaaaactaaagggaaacacagagtcaagggacttttttgttgttaattgtacttgtcatcattttaattttaagaaatatatttgaacatcttgcaaaatagccagcttagaggaaaagtaattgaagacactagagacagagggaaacaataatcaaaagaggaggtaaaagggagggttcagggatttagagataaatattcatataccagaagggcaatgcttaagactggagaatgtaagtaaatgaagacaagtatgggtatgggtaagtgtgtgggaggaaaataatgagcattgaaggacaacatacctactagcctagaaagggaatgtttatggagaattaagagcatgggaatttcaacatgaaataattaatagcattgcttaacacaaagaattcaagggacatggagaatatgaaagcatcactagatttgcaaaatattggtgacatatatgagtgtactttattttaggaaaacaatgatgatagaagcctgattgcaagggttaaaaaaagaaaaagaagcaatgagcaatacagaaagcaagcagatattttatttggccaaaagaaaaaataactagaagagagaaatacacattaagaaaataggatggctataacaggaggtaaaagatggagcatgcttctcttttacaggtaagggataaaacagtgtgctggtattaggtttcacaaaaaacaaaggagctaaattcagttataatcgcagcacaataggaagggatgttgtttgatgtaatcaagggacatgtgtgactggccatggtggaagtggaaaatttaggaaaatttagttaagaactttttaaaaagataaatcaaaatacctttaaaatttgataaagattgaagagagtaaggatttttaatgctctcaatttgtgctagtgttcattattacccagtaaaattgtgcagttaaggttggctaaagataatgatgacaatatctacaatgataatatcagcaacaatagctacatttaacatttattgagcatgtactacctgtaaggcatggaattatcatttgacatattccaactcatttgttcctcataacgatcttatgaggcagtttctattattatttgaagtaagcactttgaccaaggttattgagctagtaagtagcaagtccaattatacctaggtagtatgcattcagaataaaagggctgtcagggcataatctgttgctctctataagatttactcaaatagtttgaattttagaatgtcaaaagatatatatgtcctccataagtagcctcttttaatttctcatcaagatgtacaccagcacatcccaaattatacatataaaaacctggtattttaaaatgctcagggtttctgaaacacattctcatacctcctttcaatcactcttaagggtagatattatttactcttttcaattaaggaaacagagtttgagagaaatcaagtgactttccaatggtcctccagttaacaaaggaaggagccccaattcaaattcagatcttctgactcaagtccaaagccttggccattcaggacattacccatccctgaccattctttctcttcaatagtctttatatttcaattatcttttctagttttctggtcacatttctatttcaaatctccatacttcaccagaaggttatcacaataagctttctctaacatgaaaatgaccaaaatgactcttttagtaacatttgtgtaggtcagttgcagtaataatcccagtgtttcatttatcctgtagccataccctttgccatttaattctgttctgctttccactctctctaggtttggccaagggacattaccaaaaatgacttaagcagaagtttaagaagcatctgcttattcctatttggctcttactcctcttccatgatcatgagaacctgccagggctagcccattacaggattagacacatggcatagaggtgaatggccccagttggctcagccaaggctgtcctggatcagaatcagacaacagccaattgacataaagctgacacagccaaccttcagctagccagtgacataaagttagtccagccaagatcagccaattcaagatcagctgaatcccacaaactcatatttttgtatgttattgaggtttttgtgttgttatatagcattatttaagcaatggataactgatgaatattatgtaatccatccaaaatcaagattgtaaaataatttttcttcatgatctggtcatcagttcaccccaaattctccagattataccacatagaaattcctgtctttattttgcaccacacataataacagcctacgcttcacagccactatatagaacttcactttcatcctataacctttcatcaaacaaatctttttttcattattgattgctatttaatcttttaaaactaaacaaacaagattccccaaagagtcttctttgtacaaagtagggaccctaagcctagcctgggaagcacagcatatgctgaattttggtttcccatatgtccttcagcaaagttctatctgcacaactttcctgccccacatggaatatctcagaatctttaccaatcgtttctcaaaaatacctctttaatatcactttccacatgaaactttttgtagtgaatcacatatcaacttcatagttcaaatactttcagtacttctataatcttccagtactatatttatttgggcccatttatgtattttttccaagcaactctattccctaaactgtctgagagccaaacttttttccccatcccctttacaaacatatgtagctatttaataatgcacagtggaccctcagtgtatgctaaaaaaggtgatgaaaacaaattttaaacttctacatatgacattttgcaacaggaagcacattccctttacctcttctccaaacattcttaacaaatatattaataactgacaattattcccccattctcaaaaatgtgtaggattattttgtcaatattcctagtaaattactctaattatcctaatgattattcacatatatgtatagaaatgatcatcttttagcattctggataaaacaaatgcaagtaattccatatttaattttttatacattaattagtttttatttgcctcatattctttaatcatcacaagttaccctatgaggtgttagtattaaacactttttgtagcatggaaatctgaagttctgactcaaactggtgatgtgtagttgggtcacagtacaaatctgatcttcctatttcaagtttattgttctttctacatcaaaatgcacatatatttacttctccatttactttaaaagccttttttatgggcctagtactttggcagttcagagggttttgcattattgagatctgctccttttctcaaggagcttatagattaggttggggaacaggcacataaacagacaatttaattacaatatgataaatgataagagtaaggcacacagaacaaatgtacttagggttcagaaaagagttcctgaaagagataaacttttggctgggatgggaaattaaccagacaaagacattgaggaaaaacattataggtagagagatgaacattaatgaaggaaaaagaatggagtttgctgggacacaccaaacagtgtcgtattattcaagcatataatgtgacatatttacaacaccagaaatgttaggagatgcagcaaagaatttcagggtcaggtgccaagaaaaacagaagagtagagagatttgagaattatttaagaggtacaaaaagtgtggcccactgaggactgaatttagagaaggaagaaagcaccaactataaggacccttaaggtgcctaagtaaggagttagagcacacttaggttgtgaattggaggtagatgatgactgggtttggagcatgttgaatctgaggttctgtggaacataaaaatggatctgtgcattaataagttagataattgagggcatagctaagaaacttcaggcctggaggtgtggaatgatgtgaaattatcagcactttttaaacgcagatatacccaaagacataatgaaaaactaaacaatacagctataaaataatttacatggttaaaattgttaaaaattattgttgcatacttttataaagaaataataggagagaaagtgactaaagtaaagctccaatcaccaagacctaatagcactgaataggcaatttaagacatctatgtcataaagtttatctctgctttcaattctaccctgtgtttgctgaaataattttcatttttctgttaccctagtggttttcaattttacatgctttatttctgccccaaaagtcacatttatggtagttattttcaccttccagctaaatgtcaagtgcaatgccaccaaacagtggcacattatttacaaaatattcataaagtttcaacaatagcaattgatgaagaatattcctctattacttatagaaaacttatagccctaaagatacagagtaggttattaaacactttctttaaaaaaaaaagatgattatcactgtctaaggacctgtggatttctaggggtactcagatatttataatagcaacatacaaattgatattgaaaaagatatcctcaaagtatttttaatttagaatggaactatagccatctaaatgtataggctcataatccctaatctacaattccaaaatccatacactctgaaattgatatttgatttgtgaatatgtaatgaatttgacgggtgggaaaatcagacctatacttatcatgagactatttacagtctttttttttttttaccatgcagtaggaatattcatagaattatcttcagaaaaatttcagaaatattcagaaatatgggtgctgcccatagtccttcaggaggattgttctataatatgctacacacacacacacacacacacacacacacatatacagagagagagagagagacaagaaacagagagtaagagagaaagagagagagagagaaccagaaaacttctgagctccaaaacataactggtcccaagggatttagataaaaggctgggcagtatatttaaaaattaaaacttaacattttaaaggcaatcataatttagatactccatacaattgaatagctagaaataaaacattttcattcttgtacctttacaaagagatttacctccacaatcagttacgtataaaaatatttttcagttttctcctttttttcctgaagtatcttgttctagtgctttatttttacaacatttttaagtaaaatagtcaccttttttttacagaagaggaaacatttaaaaatccaaattactttcagatgtattttggtaagattgggatttaaactgaaaacttcaagcttgaataaaatctagaaagacaaatgtaagagggattcatgcagtcttacatgtaggatcagaatcaacttccaagaagagtggaagggaaatgggaacacactgcagcatctatgcaagtcaattagaaacttcagttgactgctgtcccagtacacattgaaggtatgttgaacttgtctccaaatataataaaatcctagtgtaaactaatgaaacactgtatccagaagaagaaatgattgccccattttccacttgttacagtagataaggaagagtgtgactggttctgggaccactttaacaagagaattaactaactcaaataatcctccaagagagtaagcaggatggtgatagttctagaaatcaccttatgaagagcaattgcaaagactaaaatattttccttaaaaaatataatatttggtgtagctatctagctgccttttgaaatgagtcaaaacattttgtgtgatgacacaaaccagggtaccaagaagtgagagttattaaaaacattatttcatctcaatacaagataaactgcctgaaaacgaaaaggactagaatggcagttattcacacagggttatgggtttacctatcaggatgtgacaggggattcttagtgatcctttccattttgagagtcataaatatctctatgagttaatagtacagatagctttagaattttatcaactttgaatatatagttttcaatatttataaagatatctttgctacaagccataactttgtggagagaattcaactctttaacatttagtatactgtcttttaaggagcgggccaatcaaccttgtatttaaaagaaagttttagtttaatgggggtgagtatcaaaaatcccattcatttttatgtttcttctcatacctaaaagaggcacaattatgcttttcattttttttttttttggaggtggagtctctttctgtcccaggctggagtgcagtggcgtgatcttggctcactgtaacctctgcctcccgggttcaagcaattctcctgtctcagcctccccagtagctgggactacaggcgcatggcaccacacccagctaattttttgtattttagtagagatggggtttcaccatgttgcccaggctggtctcgaactcctgagctcaggcaatccacccacctcggcctcccaaagtgctaggattacaggcctgagccactgcggccagcctatgagtttcttaaacaagtaaattgactttcatcattaactttgtatataaataggctggcagttcttaaaatatcttaggattttttttttctgtaaaatacaaagattgacagaaatatatttaaatatagctaacaacgttaagttagtgaggcttaactttttccctttcaccaatcttcaaaatgttttaaaaataaaaagaaaccagttaaagtgtttttttttcccaagggagaggataatatattagtaattccaagaattttaaagcagatattaggcatttaaaaaaaaaaaaacaatagttggacacgagacttccaaagtacggtcattttcaaagaccacacaactgaaaatgaaaaatacatatttccaaatgtcaatattgtgtttaaaaggtaagaaagataaaactatctccacattctggtcattaaaagctgatccacaagtggttttctacctccctaaaacacataaatacaatttttaacaaagactggataagaactcttgcttctcacacaaacccccaaccaccatcagtagtccatgattttgtttgaggcaaggtttcaagtgaactaatcatctattcctaagttgttctcaccaaaacgtgtgtatcacatatgttaagtggaaaagtaacattaagaatgggagtaaagtgaatcttaacaaatgttcaattacaataggagaaacaaaggctaccaggaagcatacctgtggcagggctgaattgagctgtctctggagtgagtctcggtcatagatgacatcctgaagtctttgctgggcaagtgagaggctttcctgggtctcccgaagggtgtctagaagacgatccctttcatctagcatattcaccatcagctgctcaaaatgggagtctgagtccgagccactgctttgggaccccctttggctcattggggtgtcctcattaatcgtgggcatcacttcacacatcattgcttaaagaaagtaagtgggaaggagtcttagtaaagaaatgatttccaataatttcatttggagagcaattcactaaatatttttcagcttattagcctatttgtctctatttcccctacctgttgccccaaatccagccaagcaaaatgttttgacctcaatgaaatatgatccatttacttccttcagcctaagtgctttctctttccatgacatcacatttatcccacctcccatatgcaacttggtttcacctgtttctcaaaattgttgttcatgatttatcccacctaattcaatttacataaacatgtgatttctattattatttcatcacctttcttatctgcaagtttacaaatctcttacagcgaatacttttatgttacccttatttgttattactgtatattattaatggcaagcacagtgtctggcatttaacgggtaggaagtaaatgacttgaatgacttaggtaattcaatgatttaaagtttactctttcttgtagaaaatatacaaatcattgagtatttattttatataataatcagcttttactttgttttttagtcaaccgatttttttcaaactgactagttttaagctttctgacattacattttccattttattacttttatatgctctctccctgaattcctacgtggtctacccagagcagataagtgatactgactgaattagaccaaaaccttatgaaataaactgaggtatataaatttgtttagagcattatactcatcattacacttaatattccctttttcctgttaactgcatggtctggttttcatccaaacaatacaaactagcactctttcaaatattccgcaaaacagatgtcataaattatattagctaatgtagtaacttcacatctcaaccgccaatcacaagttctcagtcatgaaataaacgaactgttttcagaatatttttaaatttgatttaaaatagacaaaacacacttaggtgcatgattgaacaattatgtggcaacttaaaaatcagaaattatctcattttctctttcatcctctagctaatgtttcaaagaaaagtcaaactcatctcaattttggttgttgtactatggccagcagctattaattagatggcttggttttgcaaaaggctgatgtaaagaaaggcaggtttggctgttgatcctgaagcactgtttggttttataatgcaaggttaattaatttttctgcctatacattcctgtccttggggaaaatatttctggtgatattttcaaatagaatgtcaagatttaacagctcaatatttaattactttttatgtgagtcttcatataaattgggttattgaggagcgaaattcaattatctgtgaatgatctggtcagggactcctgaaaactaagaaaaacttttaaaaagtatgtaagtaaagtattttgtgattgataacctatattaaaaaattaagggggtcattgaacattaggaaagttttaaacgctttgaagttttgctcattgctcataacactgagctacctgaaggcaggaatttaatttgttcaattttgtatgcacactaaaatatataacagagaacacacataaaatgaatataagcacatacaccctgatacccacacttgatactactgttacacacttaatggataaaactgtttcttgcatttatctcaatttgattttcattcaaagactatcacaaagatggaaaatacagactctttttagatgcttcaaattttctttatattaattgaaaaggaattggaaaacaacaaaaagtgttccaacacatttgattatttaaaacgattagttagcaggccatgcatgaaacctacacattgagccgctatgtcattctgagaaatgattaccaggagccaatatgtttacttttgacatttaaggttaaaacaaagtactgggagagcaaatcatagcatcatgacaatttgtgcccaaacactcacaacgttagggttacctatagatttaaattcttaaatctatattttaaattacgtccttcttgaatgaaagttattaatccctttccaccctgaatcactcagaacaactttaaattccaaggcaaagcataacagcagtgaataccccaatataattttcacctgaaaataatatcctaacaatccctcattgttaccatgggatataaacattcacaaactttagggtcttaaatcaacattaaaggtagtcttcgatttagtcaaaagatgctatgatgaaaagtggcttagggacttagaaagtctattaaatctacactcaaaagaacttgatttgattccactcctaaggcaggtgaaccaggacaagttactttacatgttaaaactttagttctctctttcatgaaagagggccaataatctatgcttagaggaaaaaaaagaaaatatataataggttacctgactgagaacacacagcaaaacatataaagggcaattacaaatgtaagtattaatttctattataaagtgatcaacattaatctttgtagaaacaatattttacctttacgactcattctgctgctgtaaaggtttaattctagtagatacttttgaactcttcaaatccaatttataaaaatcaaattatgcaaaatttacttaggaaataagatgaatatatgctgcttataccttgcagtcaacccaaatgagtaaatccaaagtcttcttatcaaaattagaaaaaaatagtctacaaaaaaataaggccactttcatgaactagcttagtttctttcattagaattcagattctaacataaattacaaaatatttgattaatccttaaaatgcagtataacatttcttaaatgcacattttgcacattttaagtattaaaagcaattaaagatatatattcaatataagagttaaacacccttttaaaaaatggatgacatctgaagcagcttgcacagtccggaaggctatggtcattcaatgtctagtgcgtttcacccagatacatcacttttaacttttataatcagtatcaatactaaaaactgcattcatcacataatttctgaaaagccagaaagggcattttaacaatttgccttgatatttgctttttcatcattcccccctcaaagtcaatttgatatataaattatgttatcttcatctagatattgatgctttcctcattaaattactgaaggttttgaaacctagtcagagacattgttaattttgttgagaaagaaaaaaagtaataataaatctgattggcttaattatcccagtgcttaaatttagccggaagaattttatatcaggaaaataactcctttattcttagcacatagccttgactgtcttttaaatttctcagatttcaaaataaaagtttgaatgcccactggagtcctcactcaagggctttcaagatccaatgtgttccttaacaatatatgccatccaagcagtacctcttcagatatgagagtgctacaaaaagctttttttcttttttctgtcaacaaatgactttatttaatcatatcactaggaattcggccctactagaggtaagaatgtaattattatccatagtgagtttcttctgaaaacatttagtcttaagaaccatcccagctccacctcagttaacctacaaggagtaattcagtgagagaaatcctagccattgtctgattacattacatgaatattctccctcctatttaactctttgaaagcctctgtcctcgggaaatatgattatcacctttaatggacacattttacactttctttaccctagtgcatttacggacagccagagccagctcaacccacactactggacagttatctctcagccacaccccccaccaccttgaagaagttgacttcatcatttccacactaaaattgttcatcctgcccaacaggacacagccaagtaggcaggaggtagagagataggagatggagaggatgaggtgaaagcaaaaggcacctaacggtaatcaacaaggaggaatttgcatctcatcttccctgggggcggggtggggccggggaggtggtcaaaaaatacagcgaaaggagacagtaaaactcaaagacagcttctgtacctaatgtctgtgatttcgggtccttgcttcttcaattgatcaatgacaaccgcagtctccggcttgaggagaagggaggctcacacccagcactcctggaccatttccctagcaacgggaggagaaaggcagctcagacacacgcgtgccccggcgccctcccggaacgtgccccggcccggtggcgtggcaggagctcggcatcttcccgtggctccgtcagcagccaaaaggagaagcgtccatcggaaaaatggcatattacaaattttgctttgggaagcaaagctcggttc

SEQ ID NO: 1485 - DNA, 500431 bp, Homo sapiens; identical to SEQ ID NO: 1484

SEQ ID NO: 1486 - DNA, 500243 bp, Homo sapiens
ctggaattattattttttttattgacaatggaaagggtttctgttatcattaccttttgactgaatctgttaaataaaaatagacatcaaaacaaatgtaatgtacgtgcaaacatagcaaattaaaatacagaaaagaaattactaatgacaggtcttgcgcttaataagatcaagcagcagaaaatcagcagttagataaatggtattattaaataggctttactttgaatctcccatataaacaaagaataaacaacagtaacaccaccaaataaagccacagggaagagattactcttctatacttttatacactatatatgttaatcattctgtctttcatttatttcctctgataaaactgacttcagggaagtcgcaacaaggccatctcggctaaaagcttataacattagacatgagtctggctaatgccctgttacattgacaaaagggaaaggtatcttgggtttcgttttctctagtggaaatgagcctcagactctgcggtggttgacattcactgtccagtactggctggcatttcaagatatttgaatgaacatgtggttcttagtaaagaagtttttttatctttttttttttcttggtccacaggtaacaagagaagattatggttttttaatataaatttttaaataattgcttttgacccttgtaaacagcttggctttgttttgtattgaaaaggagatcaagccatcacagtgctatttctaaagatataggacatccctgattgcctttaaagctctatttttggctccggttccaggttaaatcattcttttttacatgatcagaggcaggttgttcagctttaagtattgacagacttgaaggagaaacacgttgaagcatgaaacatgcttcaaggaaacatattgatttgactattaacaatccaaaaactgtaaaaatggtggaatggtaaaatacaaacagtacttggaattgtcaaatgtttgcactcgagactccatgaaccatatattttattttttaaaaaatcatatttatatccatttacataagacttacacatttaaaaagaaatgcacggtaatacataaatgcctagtatattacaataaaacatgaaaaacaactggcttcatttcataaaagcatctgttgtacagagtttatgatgtagatgatgtttattattcaaatgacttaagcattttattacaatttgtagtaaactaatcaaatgtaatatctgactccccccaaaaatcacatttttcagcttttaataagtcatgacgtcattatttccttagaattcagttttcacaaaggttttcactgctcgtcttcttagatggtagtgcactttaggtagagtagactgaaaagacgccatctaaaatatacaatggatagcattagttcactgaaaagtcccagactgggaaatctcattctactcctctgtggtgtacctccacgcagcctgcttactcctgtcctagaagatcatgagaaggaaatcatctaggatgtagccaacagccgtatgtaattaacatttgcttttctccaatttggtgcaggggagcttaacaaataatagaatttgctcaactttgtggaaagtatggcagtaatgtaaacaaaggtagttatgcaaaatgttagcatgccttctgaaaaatttacaacttgctaattaataaattgggttgaattgacctatttcataatgtagatttatattctagttcatatattttagagttcttaaaaaatacctttatttgttacaaaaacataacgataataagtcacctattgtaaacgtttgtgtcagtagtatggcattgctgattgttttcagccataatgtacttagaaaaagctcacaattgctattactgacacaaaagaaacagcaagtagtatgctctggattattttaatatcaaaagtgttgttgtttcacccaaacaaaaaatggttgtcctagattgaattattgtaaatgaatactgttatcccaattaatggtaaaaactaggaaatatgaactagaatgtcatgcacaaaaaacagattgcaaatagagtaactctacccatcacttaagagctaagaagcaagcactattgaacatattaaatagtcatttgtaaattagtgaagtgttcatttcctgaagaaattataatgctatgtgtagaatctaatataaacagtattttgggagacctcttatttagccaaattattatatactttaaatcatgtctaattaggtgccaaattatataccataattaaaattttaatgtaagggttgtacattctgaaattaaatctcttatcgggatgcttttcattttatcagcttcaaatagtgatccaaataaggcagcatatctgctcccatcctaagcccaaaagaccaacaataaattgtgtggcacttttagttcaaggcaatgaaaacagcacaaggtgagttgttcctctgtctataactgttttctcttaaccctgtgcacacattttgttctaaatatcgctcttaaaaagtatttttctaaaatattgattcatcgaaagtggttaaatattttggtaaagcatagttttaggttgaaaaaaaattatgaacatttgacatttataaatctaagaaaccacagttttactattaagactgtttttcaataaaacctcatttttatatggattttaaagtagctttcattaattggtatttccttaaaatcaaatgcttggtatttatggttacataggaaggttttgtgctggtcctattctccattcttaaagtaattttattttgttcctatatgtcttaaatacttaaaatttatatttgtttttagcaagtgtaaatcagattgataagaaacaatgtaataaaggtttgaatttttcacagtttctactatttatttattgatttattttaagacggagtcatgctctgtcacccaagcttgagtgcagtggcaccatcgctcactgcaacttctgcctcccaggttcaagtgactctcttgcctcagcctcccaagtagatgggattatgggagtgcaacaccatgcctggctactttttgtgtttttagtagagatgaggtttcaccatgttggccaggctggtctctaactcctgacctgaagtgatccacctgcctcggcaagtttctattttttaatatgaaaccatctctaaatcattttcctgtctgttgctatttgactcggtgaacttgcttaaatccctatccgctaccttggcttccttatataaaatatacacttaaaaagataggattttttaaagtgctgaattattatcaataaaatgctaagttactcaacaggaaatggtactaaaaagtagaaaacagtgtagtggcaacccattgatgtgtaataatacagtgataggcctccaacaggcagaccttaaaccacaggagacagatggtgataggaaatgctagactaagtgttacaatatgaagatttctttttcccctgaagcaattcaaaagggttatctcatttctgtactgctagggcataccaaagagtatagtgtatatttattagtctatgtaggttccatttttttgtctttttttttttgtcagccaaagggaaactactcacagcaggtcagtgctgcctcctttgagtggctggtcaacatgagtatgtgcgaacagtggagttgtctaacctctgcagtcttgatgaagcaactgcaaatggagaaaagggctttagagggacttggatgattgagtacaagatttcagatgagaaagatttattttccctgcatacagggattccgaacatattagtagaccttctttctctcagatataagccactcacattcctcttctctagatcaagttcctaatgaaaatttatcccaatgtaaatgacctgagcttttgagttgttatgtattcttccttagataaaatcggtaacaagagcagctcccgagggtgcttctgattttgatatggagattgctcttagagaactcattatagtggattttttttcctttccaagtattgaagaacttctacactaattgtaatgatgttaaattcctcatgaatttcgctgacatgttccaccgtattaacaagttgtaagaaatgtagatcaagatcacagtttatgttggaactaaatttgagttataataactgtgaccttgacaagaaataatgatgctaggtgattatcttaacaaatagcatgggactatttttctttaatgcctcccaaacagaaataattttgtgactactatttcaaagttgtctctcctctggaatgacttttcttttgtaaattagatagcttaagtctaatgtccacagaaggaaatagtaattgggaaattactgtgttttgtgtttctttaattctcttctcatgttcatggcttgtttatttaagggcttctgctttggctagagggaaaaatatttgatgagtgaatttctaagatgacatataaaactcgcagtatttaaacatgtagggagacagtggagttaatttccatttactatggatctttagtccaagtccaacctctaacttaaacaaattgttaattttgggaatagaagactaaagaaacacaaatcctgccgatgtttattgttcctcctagaggtggacattaaccaaattgttctttttgggatgttataaattattttgaaaatgtgaataaagtgccatgagttcatgcaatagcagtgtaaaaaggagtctggtttgtgatgagagcaaagtaaatttcaagcagagcaaaccaactcaagaaaataattccaaaaagcaaggtcagagaattatactagctttggctaaacaagctttttgcttgataagcagcaatgcaaaactactgtaccatctgttgtcatttttcttgactgcccagaggttgtggttaacctaaatccagctggtaatgtttctgaggacccaggcatcatgctgattccatgtacttcacgaggaggaaactgccttctccaggttgatccacgtctgaagttcttgtcatcactctgccagtacagttataaggtgatgttatgaaaacaagtaaactagtccatgtgcttaaagctctgtgcttagaaacatgtaacatagattatttacatttagtctgtcaagtatacgtatggaatcacgctttatcaagatagttagttctatgattccaaaacaagactataggagatttgatatataaatttttaaataaaacttttcatacaatttcaaatttaaggtctgacatctatacagtaaatatccttgaaagcctaaaataagcaaccaatgttttccaaaataaatattgtatatacattgttccactttatgccgacgggttttatggaaagagatgatatacttaattgaatcagttgttgagtagactacatttaactcacacacttgaatgaaatgacttctatgtacacaaatacaatgtaggtatttattttggggaaatctatatttgagatggcatggctaatatgagacactgtagcctattataatatctgtacaagaaactctaaatatgtgatttgtgaagttttaggtgacacagaattaacttgcaatttgttgaaaaatctgtgtagcctggacaccatcctttcaataagtacatgtggtctttgggtaccaccgaaagcataatattaccctggttacattttaataatgtgtattttaatatacacagaggcagagagtcacatcccatttaattggcccagtagactttttctctagttcattactatcaggaagcaacatcataccccacataggctagtgtctctacttggacagatcctagggtgaatccacattttagaatgtagcatagcaattacattttaattctggttgctgattttgttatgccttaataaaataatctcttccttctctttgtgtacataaagtacttttacagacataattattttcctccaaattggcaagtagcaatatataattcagcagtcaatgaatattctgtgtctaattccaaggaaaatatgaatcattccacataggtcttgtcttctcatctcactgtttcttatctagggaaggactatctatgccatagataggtatagccaagtatatgttgtgtatcctaatatctcatttgatttcattctggcatttggaataataagtctatattcactcaacatagtaatttgtgctatgttatagtgaataattctataaggtaggctttgtagactgctatattaattaagggacatttaaagtcaatcagggaaaaataaaatcatttttatataataacatatatccactgtttcaatccttatcatcattaaaatctacattttgtttcagtgtggtagccattttgcacattaagagatgtccgctactcttcccaactgctgtgtttttcattgccctagatctccaaatgtgtgtaaatgtagaaaagaaacagaatttcacagttgcagcctctacgacttcttgattcttggagaagtttttgcattaagcataaatagtcttcagttttataaaacactatgttacactgtagagctacacaactccttacagtgtcgtagctaggggcttaaaaataagccagttttggctgggcgtggtggctcacgcctgtaatcccagcattttgggaggctgaggtgggcggatcacctgaggtcaggagttccagaccagcctgaccaacatggagaaaccctgtctctactaaaaaatacaaaattagatgggtgtggtggcacatgcctgtaatcccagctacttgggaggctcaggtgggagaatcgctggaacccaggagacggaggttgtggtgagccgagatcacaccattgcactccagcctgggcaacaagagcgaaactctgtcaaaaaaaaaaaaaaaaaaaaaaaaaattgccagtttttagagttaagcgtttgaattatgattcctgacttctgttctttcaacatattgttactgcagaaagttgatagaactataaacaacaacatcatggggaaaacttttcatgagatagggttaattcttttaattggggtcaaagtctgtataagcttgttgacacctctcagattatttcagtggaatctgaatgtgatcagcaaaaccgcagaaataagtccactactgttctaagtaagttggctatttttgctcacactaaaaaataaaataaaattgaacaaaagagactagagggtttaaatgacaaaattctattttgtgcttttaaaaataagaaaaagcagcagcatagtttaaagacaacgagtcgcatctcgtttaattggctcaatagacttttcttctagttcattactattaagaagctaccccacacctggacagctcctaagagaatgtagcaatatgacaactcttcaataattttttattagaaatttttgcaacttataagtaagaataattgtattttaagatgtatgagtttataagactacctttttgaatcaataatttctagtaaggatttaaaagactgtcatgcaacttataagacgaggcttttaaaaatattaatcattatgctgattgaataagagcatgaatttatcagaagttagctgagttcaagactgtagaacttatctctctataatccccaccataaaggacagagtggattttataataccaagattatctgtcctgcctatttgaatatagaatgattggtccatatttgaatttgctgaggtcttcacaaaataattttaatcagcttgtctttgtagtaaggaacacctgtactttgcaacacagaattatgcatctctttattttctatttcatgctcaggtttccttcccacttcttccagaaagaccctgtagaaaaactcagaaagactattaaaatgtctacagtccacagcatttgctgatatcccttgtattcattcatctcgggaggctacttacatgtttattattttccaaataacttaatatgcacatattatatagcgattcttatattcaatatagctttcaaattctatgactgttaaaatgttattaatctgttttgaaggaaaactcagtatcaatatataaaataataaaaagctttccatttattgaagcaagttttatcctcattttaattttctaaaatttcctggcaagatatactgatatttaagaaatacacgcactctttattaaaaagctgaatttatcaacattagtgttttaacttttttctaattttttaaaataatgttgcccaacgttttgcagtcacgactcataaaaatgttttgtaaattactgtttagtatctctacctgctgaaatgataatatttatgaattaatatagctctttccaaaattaagtaataagattgaatatttaacaacaaacctggagaaaattattgattctaaccatagaacagtcatttgattaatttccaagcactattccttaaaaacaaagatgttctatcatttttcttttactctctcagatctcttttgaataacaggtggacttacttcatccagtcgcctttcagttcccagggccaagaggttattgtattctctttcaagaatctgccttgcctgttgacgtcaaattacagttaccatcaccgaaatcacattttattttaaaaatcaagtagcttatatttatctgataatgtattataaaccatactttatttatgggttttgaagtttttagccctccatgtctgttattagccattgtaaattttaactacaaaaaaaacagggcttttttttttttttctgtgaacagtagagagacagtcttgcataaacatctgaggtcaagaggctttggcctcacttcgttactatatttcaattgagtattttgtttaatctctgaaatatgtaaaaacaaaataaaaagtgaaacgagactgccaaatttttattgaatctatgtaggtagttctcaaacctggccaatgattatcatttgaggaaagttttgataataaagattcctatgccctatctcttgacaactgatgtcttaggactatgatgtgggttggaggttttattttttattcataaggaactatactgattcaaattattatccagttttgggaatcactgacatatccaatgctaagagtctgtataattcatacatgtaaatagaaatgactgcctctcagagaggcagagactgatggccatctgtcagggatttcatttagtggaatctggcattcaggtgggagactgggccacataacttcgaaatccctttcttgtttaattgtatgatttttttttttttttttttggctagaaatccactagcctgaaattaaaaccccagtgacatatttcaaacattgagttaactttcattaacaatcatgaatacacagccaatttttttctaaaagtttagtttatcattatataaaccagaacacattgagactacagcagaaagtgacttgcctgggtgttctgtgttggaatctgtaataataaagctaagctgctgtagtcaaagttttcatccagggctataagtgagccatgcacaccgctctcaagtatattatttgcatattctcgaagtccaattgcttgtatccagcgaataactcggtcattgctccacaccaacacgtctaggaaaagagatgcatcattttaggatgcattatttttctttcttttttttttttttttttttttttgagacggagactcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcgcattatttttcatagtagaaccactggctgaaatgagccatgggtatctggccaggtcacatttatgctgattcatccacactctaatccatctggctcccttcatttgtgtgtagttactgttttaataattaatcttttcgagtctctatttaaaaaagttgttatttttcagagtgtttgttatagctaaaatgacagcacttcagtcgcgtagaacacgatgtctgtgtttcttgttttcatactagagaactaggtgtctgtctgaagttcaatatttttaccatcagagggagacatttcttatttgtgtcttgatacacacctcttcagtaaacagcagacgagattgtaatactgtctttcatcagaagtgtttgttaaccactacctaaacattggcatatagactagaagattttttttcacctgaagtaatatataagaacagaacggtaaaataatataaggcatcaacagatggatacttaccttagtattatatttcaatgcatttttcccaatcacatgctaatgcaaaattcaagcactcagtcaaatgtcaaaaattgtttccactctattgaaagtagtattctattgaggaaaaaatttctttgatttttattttctaaaaataaaactttcagagaaaaatgccgtttctttttttttagataaaaacatcaaattatgttttatcatttattttcttcaatatcttcccattaaaagttgacagaatgctatataaaatgagtaaaatagtccgaaggactaaaattgtccatagaaaagaaagaattttaagaaacttaaggggatatgagaaaaaaattaaaacatttttactacccatagaaagggaaaggaaactataattactattaaagtaaaagtaagttttcctgtccattttttttctttctaatgaagtgcctagctctttcagacaaagtataaaaatctttcaggaaatattcttcaactttaactgttttaaatacctgtttcaataagcctttgaaaagcatgttctaaataattattttgatgagtctttgaaaatccttatttatcttattttatccatttataaccaacttagatgttcttgtgtataactttgaagcaatacagtgatagcacagacccacagaggtcccctcatgcaacttctcaggcaccattctcacctaacagtaaccaatattctgacttctttcattacagaatcgccttgcccgatttattttttttagcttttcatacataaaatcacccaatatgtacttttttgtctgcctttcattcaatatggaatttatctacgctttagcaaatagcagtggcgtgttcatgatcattgctatctagcatcccattgcatgattatgctgcaatgtgtccattctactgtagatggacatgtgagtagattccactttgggttattaagaatagtgttcctttgagggggaaagggtgggggatggcaagggataaaaaacaacacatcgggtacagggtacactgcttggttgatgagtggaccaaaatgtcagaaaaatcaccactaaagaacttgttcatgtaacctaacaccacctgttccccaaaaacctattgaaataaaaaaacaataaatagtgctgctttgaatattgttatacatggattttgttttgtatatttacatgttgcagtagaataaataacaaggaatagaattgttatgtgtttacttgttagcagatattgctaagcaaattccactctcacaatttaaccttgcattattaatgtctgaacatcttcatctttaccaatgctttgtatttctcatttttgttcttgttttgtcttgctttttttagtcattatggtaggtgtggtattatgggttgaattgtgttccccaaaattcttgtagaagccctaacttccagtacctaagaatgtaaccttacttggatatcaggtctttatagaaatgatcaattaaaatgagtcaatagagtgggcccaaattcaatgagactgttatcattcttgaatggcaaaatttggaaatagacatgcacacatggagagcattatgtgactatgaaggcagggatcgtggcgatgttcctacccgccaaagaacatcaaaaattgccagcaaatcaccagaagtcagggggcgaagcgaatagcagattcttttcagtagcaactgactctgctaacaccttggtctggaacttctagtgtgtaaaagtgtgagacaacacatttctgttgtttaagacacacaatctgtggtactttgatacagcagccctgacaaactaatacatggggtgtctcattgtagttttaatcagtaacacccattatgaactgaaaacgtctgctacttttaaggtttgtcagtttttactttccatattttaaatctacatattagatgtatactaatttgctatatctttccttctattatttgaaaatagccaacttatttctagtatgtttcctgccttaaagtttatattctgatattagaagaatcacagtagctttggttaatatttgcatgtatacctcatttactaataagttttctatgttcttatattgaaagtgtgtccattgtatacagcatatcattgttttttaatctgtccttaaattgaagtagttagttcttgcccatttaatattattactttgatatttgtgctgaattctaccatctatttgtcctatctgttctttgttctttttctctctttcttgccatttattgttttcttattttattctaccactccattagctttcttttttcttttattttttgagactcagtctcactcttgttgcccaggctggagtgcaatggcatgatctctgcttactgcaacctctgcctccaaggttcaagcgattctcctgcctcaccctcccaagtagctgggactacaggcatgcgccaccacacctggctaattttgtatttttgctagagatggggttttaccatgttagtcaggctggtctcatctcctgacctcaggtgatccacctgccttggtctgccaaagtgctgagattataggcatgagccaccatgcccggccctctattagctttttatatttacactttatattattattttagtagtgacacttaaagcttataatatgtgttcttattagagtctactataaattattccttttattattttctagataatgcaaagactttcaaataatttaatttcacttattcccttccttttgcattatagttatgtattttaattctatgtaaaatttaagtcctgcagatattatttttactattattatgacatttacccatacatttttcagttctcctccatcatgtgtgcatttttttattatctttatgatcatttccatctgcctgaatcacttattctaatatttcttttctatttgttttttttctggtgaaatagtctctcagattttgtttgtctgaaagtttattaattctctctttactattgatggacatacttcaaagtaagttagtttgattcagcattttaaggtaataattccattttcctctagcattatttagttgagcaatatcagttatattatgttgcgccattgaaattattgtggagtttactctggcagattctaagattttggggtgtgggaaatcatggttttcagtagctctattgtaatgtgtttagacgtgtttttatttccgcttttatttttaatctcacttggggtccatcgagaaccttgagtctgtggtttatcatttcaattattttctttttatgtctccaccagtatcttttcaaatattgcttctttcttattgtctcttacctcaccatgtccaatatgtctctagtgatgttttatatcattcgtcctttttgtttcttgtcatatgtgggctagatgttttcaagtgatcttttatttcactaaactctcttctactgttaaaccacctattgtgttctcaatttaagtctttatacttttcacttcttcaaatttccatttgattatttgttaaacatattgattccaactatattaaattctccattttctcacttatattccttacatattttttaataaacactgtcagggtcaactatggatatgtttcttttttctgattttatcatcgtggttttcctcattttggccattatctgacatgtctgaatttttcttttattggctctcacataatatgattgaaaaattgcagaggctctgaatgtcaacttcttcttaaaaggacttttatgtttttctgaagttataataagggcagatcaacttaattccaattaaagattgagataaatcaatgctagatttcaattttaacatttcaaaataaagcttaggaatctccttcactatagtaaccattttactacctatatgtgttctgtaatatgttctaaacctcaaatatacataataaaatttatttttaacattaatagacataataaatagcctgatctgtttaagtttaccctagtcctacggtgtgttttatcagagacctcaaattaaagcatatttggtggttatgacctttgattttttttactgtattatcatgagattacaacagttctctttctagatttattaccctttggcttcagctttctgttcaatttttagattataattccatccttcttggaagtccacaaatgtctctagaggagtattgtataaatggtcagtcttacttattttattattactatgttttacacattctttgctcctgaaggcccggcagttttggcacctctaaattccaatccccaccaccaccccactccgttccctgcttctctgttagatagaggaaaaacagaagagaatgacagttttactatttccttacatttttcttttttccaagatcataacctctcaagtcttgtccctcttaattggtttctactgttttcaaatagctctttattaccatttattgatttatctatcctttctatttcttcttagtggaagattggtctgacttaatatgctccaatctatcagaagtagaagttcttcaaattagttggtgtcctttctgtctgtgccaatccacagtactagcaaaacatttgtatatgaatctggaagctgaacatgtatcagcctcacatctctctacttaactccttttgtggatagaatgatctcatttcaaaagaaaggtcctagatctttctttggatttagataataaggaatatgagaggaatgcccacatcccacagtcttattattattagctgctccattcaaagcagaatgaatttctgcccgaagaaggacatttattgtcctcccctcagagttttgcctctttctccccgcccccccccaaaccggtctgcagcaaagcaaaggatttccttaatattctttactatataaggaaattttatattatacatgttaattgtctctctgagtcagttctgaagtgtagcttttcctccgagttttccttagcctattccattgaggttttcagacctcagaaaatgggatgtgagttggttagcatcacattttggctatataatcagctgctgctgatagttactgattcattctaacaactggttaccctacacttgaatcccaaaagctaggcaagtgcttgtgggtggcagcaacagttctccacttaattttattaaacacaccgttttttaaaaatgaacgtgacaatgctctcaataataaaaaataaatccagttttctttgcactagttggatttgtaaatagggagtatttggtttttttctagacttaggtttatattttgatagtctaagacatattatgtggtcgtgatatttctgcaaatatgtgcccatcaaaaattccatcgtcacacctgtagttaagagtgatcaaatatttaaactgatctgtttatgaggtaaagacaaataaagcattaattcaaacgtttcctcctcagaacaaaatacttcttttttttttcatttttaaagttagatctctttccataaatctgtttccaagcaatgtatgcactgactttaaaactgtgtagaaatcttcttgacctaaacaataaatggctagaaatcagtgttgactgcttcttagcaacaaattaaatgttagtaggttcttgatattcacatggtctcttcacttcagaaaactattcattaaggtcagggttaattcacacttcagataataagagacccctagtcactgttgagaattattcctgtaaatgtcaccagatcagtcataggaaacaagctatttatgatctcattcacagctatttatcagatagagttgtgtgtgatcataatgaatcatggcagtttttttttcctcagagctacactctaatcagcaattgccagatactaatataacatttggtatagggccaactgggtaattcctctcctttagatctatctatatgtgaaacatttcacgtggtgagctgaggcataataaaatctaattggataaaaatacttcagaaaggaaactacaaagtggtatcccatgggtaaaatctacctgtgtgctaagacattcattgtgtggtcacatgcaaacttccttctggggtccatctttggtccattaattcccaaatttcaattcaactgaacagcaatgcactgaaaacaacctgcagtttcctggggcccccaaataaagtgaagtcaaacaactcaattttgataatggaaaagcactttcgtgcttcgaagtaatgcatcaaatgaagtgttacaagaaatccattgtgagtctgtctactctccgatgagacgtacgtagaaaactatttttaaccaatcactttcacatgcattcaagcccgttccattagaactaatgtactttccaagacctgacaaagataaaagtaatttctgacattgtttatcaaaaatgtaaattatagaaacctaaaaaaaatcttaagaataaaacagcactaaacgttaatattggagaatgtaatatatactactttcttatctaaattaagccttaaaagaagtgaagatgaaaacagagattcatgcctacccttgaaccattaatgtaatgtagaaacacccattacatttgatgtaatgcttgcacatatcaactcttggataataggaaatgtaaatacaactaataagtattttaatatccaaaattttccttaaaagctttggttatattttccttaatattttcttctttttttttttttttcttgagacggagtcttgctctgtcacccaggctggagtgcagtgcagtggggcaatctcggctcactgcaagctctgcctccagggttcacgccattctcctgcctcagcctcccgagtagctgggactacaggcgcctgccaccacgcccggctaattttttgtatttttagtagaaacagggtttcaccatgttagccaggatggtcttgatctcctgacctcgtgatccgcccgcctcggcctcccaaagtgctgcgattacaggcgtgagccacagcacctggcctttttcttctttaaacaacaaaagtggattgattatttttagcaaaaaaaagcccacgtattatcttaagtgaaacaattcagaaacaaagtcaaatacctcatgctttcacttacaagtgggcaataaataatgtgtccaggtgaacacagagtatgcagtgatagtcattggagtctcagaagggtgggaggctgggagggtggcgaaagatgagaaattacttaatgggtacaatgtacatcattcaggggatgggtacactaaaacccagacttcaccaccacaaatatatccatgtaagaaaaccgcacttgaaccctttaaatttaaaacaaaaaaatacctttacctatatctttttccaatcatgtatttttttccttcaacaacaacaataataaaaatagaacggtctctaagaatagaatctaacatattcctctttgaaattattctttctcgggtatattaaggtacttctcttttgaaattattctttcttgggcatattaaggtacttctcttttgaaattatcctttgtcgggtatattaaggtacttctcaacatttagatgatttatttttaaatatagtattttttctaacaaacctgcaatatggagtgtcttttcttgttattcaaataaaacatttttctgcacataacagctgcagcaatttacactgttcctgataatattaccagctaaaattattaatgaactagtttggtttataggggaaaatccttatatcattcctgcataaaatcaccatataatttctttaactatacagtgttacaaaaataaaattgctggggcactggaataaaattaaaatgatataaaccaaagatgaactgccataaaaatgatataccatgtttctctgaatcatactgagaatgttccattaaaagtctgacaaaaatatctacatggagacatctttagtataagcagaatgtataattaataggttcacataaataagtctcaattcaaaaactcaagattactccccaaatgggatattcaccctataatatggagatacctgtttctgtattttaattagaaaagaatggaaaaaaaacagtaacaattctagccaaatacttatgctacttactgaccattgtaacacatataacattttaggttagtaaaagtgaaagctaaaaaccccagaataaaggcatttcatatgaaagaaagatatattaccttttatttcatgttggcttgcttcccgtcttctttctagttcttttctgtcataattcaacctctttaagcacataattccatattgtaaacttgttcttttttttttattaaaaaaaaaaaaacacagtgagtctaccttagcaggtggagaaagttttgtgattagccatagtcaacactatgcactgcttcttagggcaacaagttaataaattacatttgcagccaaatccttcagtattggagggaaatacatttataattattctaagcacaaaatgtttcgaagtaatagaaaaaaagttttcaaaataagaaaaaacagttttaaaatcatcatggattatattgttcatctatgtgtctttgtctttcatttagctattcctacattaggtgcaggcaaattaatattttattcacttgaaaagaatttaaagtccccattatggagacagtaaggaatttataagaaatggatactctcttcttaagctgatgagaaaaataacacaaaacataagtaagtgaggtaatagaagaccaaatactaaaatgagtagctcataactctaaatgatacagaagtatgtaagaagaaccagtcagcagatattgaaactgaatgaaaaggatatgtggaatgagcagaaaattgattgatccttaaagtatcaagtagcagagacaggttgactcaggaaaatggagcatcatgaacaaaagattgcagatggaaatttaaaggtgtggttagcgagacacacattccagggctgaaaacccatgctaggaagtaaggaggaatacaattatacatggagaaaagggcatattaaggaaagccttaaattgtgtttaagtatgaaatacatataattgatacagaattattggacaattttcggaggaggaagaggtgacaataaagttttctgtttggccaggcatggtggctcacgcctgtaatcacagcactttgggaggctgaggtgggtggatcacgtggtcaggagttcgagaccagcttggtcaatatggtgaaaccccgtctctactaaaagtacaaaaattagctggctgtggtggcacatgcctgtagtcccagctactcgggaggctgaggcagaagaatcgcttgagcccgggaggcggaggttgaagtagcccagatcgtgccaccgcactccaccctgggcaacagagtgagactccatctccaaaaaaaaaaaaaaagttttctgtttaaggaaaagtaatctcatagcaaaataggagatggagaaataagtaatcagagaagatagagaaatcaattcagggttcagttctgccaaaatagggacaacagccatgagcttgaaaggaaaatcgataaaccaggcatgttctgagagagaaaatgagaaggtttagtgacattatgtataaagatgcagaagatgtgataggaaaaaataatctgtagacttcaagagtaaagatcattgattatcagtgatactttacatgtttaggaatataagcaaatttagacatacacattggccagattacacttacttgctagatgcatttctaagccccgcattttaataaaaacaatgttgagtcaaatatttcagaatcagagaaaaatggaaagaaaattgcattaggcaggtgttgtgggttgaattgtgttccctaaaatttacgtgtggaagcgctaattctcagtacttcagaatgtgattgcatttggagatagtgcccttaaagaggtaattgagttaaatgaggccattaaggtgggccctaatccaaactgactggtgaccttattaaaaagagatttggacacttggtgacaacaggtatatatattcacagagaaaggattatttgaggacaccaagaggtgaccatcagcaagcccaggagagaggcctcagaagaaaccagacctgctgattccttgatcttgaacttctagcctccggaactgtgagaaaatgaattctgttgtttatgacacccatctgtggtcttttgctgtggcatccctagcaaactaattcagtgatatactagataatactgatataatcactatcacagatattgggcagcttgagattaaaccaatgcttcttggtcagtttctgccaagttttgatatagaatacaaaattatactatacagaggacatataatattatgaaaatgtctgtcagatggaaaactgtgccgaaaagaccataggatgcaatatacagtcaggtactacttgctttaagttggagattagcataacttaaaaatgaagcttgggcatttcccagaacaaacaaaaaccaagtcatttgagtattttttttaatttgatcattatagaaaacattttactaaagtaataaaacagtattaaaagtcaatctagtgaagaacggaaaaaccggaccccaaaaatctaatgcaaacgtgaaatatgaagccctaaacttcccgtgacagggagctcactcactacctcacaatgtatacactacaaggcagctgagagtggtacaaagttgtttcttctattaactagaagtcactcacctaggatctacatctgtgttaactaaaaaatgaggtgctcaacagagaaaaaataattcttctatcacataataatgatcttaaaacctaagaaaacttacttatttaaagtcttccttcatccaatttaaatgtatttaattacttcaactttaccactggacttctaccaccttataacaatttgatacccacaaataaatgcaatttctttttgttatgtcactgtatggtagcacttttgttgtctcagccaataaacacagtctaaacatgccttgtcaagccattaaccaaaatggagagtttcgtgctaaggataaattccttatctttttcacacaactttctgttaaattatggattctccatccagcactttaatgggttttttaaaaaacactgttatatttatctttaccacatttaattcaacagtgtcaacaactgcattaaaattcaaaatatcaccataagttggaagcaaaagccccaattatcctctatttatcctaattttatgtcatcaacatatctaatttttataccatcttcactccagccactgattaaatgttggacaggagagaagcaaatacagtctcccaagccaaaatcatctatggttatatttattaacttatcaccacaatcaactttatgtgaaaaaaacaaccaaaatccagctgacattgcttcacctaacataaacatagcatttatgatatggtattataacagacccctttttatctgctggatggtaaacaacttgaaaaaaagacattgccttttgttcaactgcatcctcacagttatctaacacagtattgtttttgttctgaaattaatatacaaataagcaaactcataaaaagacatagaaaaataaaaaaacacaaatatgtcttagaagaacaatttcttctcaaaattttccctagaatgttcctaaattataaaatttataaccacatatttgtgtagagttgaaactatgaatttgtttattcttcctaattttctaatataaacacatataactataaaattaccaacatggaattttcaaagaatctcacaaaaaaatagatgtatgctctatgaggagaattttgtacacatatatttccataaactttgggcacataatatgcacatagctctaaattagaaagtccctgcaatttgctggatgaaaacatttttccaagtagatgtatacaaacgatgtttcaaatgacatatattttctgtcttctagacgtccatttttgttttactaaagtataggtaatatattgtttcattttaattattctttggggaaaaaaaagaaaaaacacctaccgatggaaactatccaccatttttaaatggacacggagatctttttttgttaggtgatctaacattcttgcatctaccaagcattccataaagtaacttctgtactgaggtaaccccaagctgggaagccattcatttccaatccactcatgattcatatctccataagccagggtctgtagaaaaaccggacactagaattgttttatagcagtcaagtttcttaaccaatcagataagatggtaattggataatattacctattattataactgatatttaattactatgatatgtggaaacaaagcaaaaataatattcagatagcatttgattcgatttggtataaaatggaactctgcatacatttattaaagcatctgcctattgaaaatgattggctatttactttgtattctcaaaaggaattacattttgtccaagtatgtattttattaataaagaaattattatacaaactctgagctttaagattctgtctttaaattgataggtttgttttatttgtatctgtcatttccctcttgtcaatgcacttattgccatttcccacttatcaatgccactactaccattgctatattgtaatggcaaatgttgatgtgaaatgggaacctcagtaaacagagaaaggaataaatgttttggagagacagaattttgaagctttttatggacattgttgttacttagcaaagcaggtcgtcagctttccaaaaaatcattggaaagaatcagtcttttctagaaattaatcaagatagactctaaaagaagcaggacaggatcaaaaactaagacagataacctaattctttaatataacaaacaaactattcttaccaatactgttcaaaacagctaaaatgaaaacccaaatcaaccattaccactaaaccaatattttaaaagaactattactctctattatttttacagaattcccatttagttccttatcatgccctaatttctcaattctaatatgcatttctagggaaaatctaactgttcctcttcttttgtgtgttctcaagaacaatgaaatttttatcaaaatcaaaatcaaatacaatcctactgtgtgtttaaatacaggtcctaatgtaactaccaaattttttcttatattgaaaggtttcaatcagattgaatataacacaaattttctcttttggtcatccaaaatgtggaaatgtagaaaaaatgcacagcttccttgcaaaagtatatgtctgttccaagtatagacacctgtctcatacaaacatctcaataaatgctagtgactctgtggtctgcaacgccaacacttgctcctccaacctctcttcatacactttgcattatatctgaaggcatgtgcaactccaaataagtcttttctttctttttgttccccctttagatccaacttgaatgcttcctgattaaatatatacaggagtgatttcagaggaatttaagttttggatcattcttttgagaaagaaagaaaagtacccttttaaaagaggtaaggtatgaaacgtcaatcatcttattttaaaaatatggtaacttaaaaagacatataaagtattaaacataatctacatttacctatacacatcagcctaatattgagctaagtgaaggtttacaatattatgacttatgacagtttcttgatttatattctcattgcctactaaatgatattaagggtcttaaagcatatgaatctcctacctgggcccagcttccttcctcagattctttctgtgttagcagcaggaaatgattaataaagcaggtaaatataaattaatttcaaatcaatacagtaaaatttttctagcagaagcaaaattgttatacaaaatattttgtataacaggtagaataaacacacagattcatagacccacagtgatcaattttgcagttcaaaggcaattaggcagcaactacatcattttcaattaattctaatttaaatgttaaattcataattttgtgaacatttgatttggtcattacaaacctttttttaattcttaaatgagtgtaatttttaaaatgtaatgtgctataataaaaacttctgatgacaaatatatatatgtatatatgatagagaaatcttatacaaagtaaattagtgaagtgaaaaaactgtatccctccaacaaagctttgtgataatcaaatcgatttcaacaacagccaacaaaacaaaacaagacaaaaaccaagtacaacaaaactaaactaaaaatgaaattagtacatgacattggtgtttttatccttaacaaacttgtagataatcaattttcaaataaggataacactgaaaagacattaaattaaaaagaagttgataaagataaaatatatgatatgcccaactttgttactttacatgaaaaaatgatttttatagcattttatttttaaaagtgacaaagagtccccaagaaattctttaaaattgtgcttttcagtaccaaattaacataacacttttttggttttttgggggtttttttggtcaagcttgtatctaagatggtaaagcacaagaaaccacatgatcatattaaaaatgaatattcaatctaatcttttctattaccaatttaatttggtttagaaacatgttacctgtgaatatgtccaatactaaatatttgttacaaaaacttccaatgttgcaacatgaatactatttattactttcttccttattgtttgtgtactataagctcttatgatattagccacaatctaacactatttcattaaaaaatttcaagagagtgcagtaaaagaaaactgtaaaaaatgttagttatcattgcatgtaactataaaaacacaccctattactctggtctattgtaaacagattagtttcctcatccaaagagcagcaaagtcactttccttcaggttcaacaaagccattaagactaaccgtttttgctggagctgcaagattttccatttcttcatgagtcacccaaacgttgcctgaaggctagtgaggaggcccagagggaagcagaggaatccatgggaggcaagcagtggtaaagaagaaaggcagcacctctgtgagttaacagcaacacagcaataccacagtgcccttgcccctaccgtgtgcatgaaagagacagcatggctggtttgctcagagctccctgtttcttctactcaaaaagattaactagaaagaggcattctgtgaagctcttggggatgtagatttaaaatgacatttctgcaattattaatcagaaaaagagcatcatcaaaatttgcatttcaatggtatgtggctatcagatcaatttttgtaataacggtgaactgattaaatttgaactgtagaataatgtaattttaattttttactcagaaaacaatggcacatgcactttgttgtgttattatcaaaatttccttcacataattttgattctcgatatcctttgaaggaaaaaaaatggttgtcaatataaagcgggaagcattatcgtaacttatctggaaaccagcatcagcttttcccaaaagattccttttactgtgtgtgattcagtaaatagtaagtgtccctgaattcttgcagctgagaaagaagtgaaatgctatttttaatttaataaaatgtattttttagccacactaataactgtcaaattataaaatccatatatttcctaattctccaccagtatctgataccattatagagaagaacatagtgtaaaataattttttttctctagcaggcaatattctattataaagtcccatttgctttctaaataaaacaccccttggtattagttctatacacttaataacgtacagtttcgaaaccaaagtccacttagtaacatacagatcaggcatatcattgaaggtattggcccctggaaaccacttgccatcaaattccatcatttctttatgaacattgcaaggttttccaagcacatcaatgaaatttacatcctatatattatctgctacttgttttggggagggtccaatctttaaagaattggtgtagcaaagttgttacccaaacattacaagtcatcaccataattcactttgggtttttctgccattcacctagtaccataacttttcctgtattaaaaacaaatgtaactacatataaattgatgagtataatttgatgtaagtgaaatcttatatatgtatatacatacatatatacagtcatgcactacataccgacattgtagtcaagaatggggtgcatgcacaacaaatggtctcatatgattataatggagctgaaaagttcctgtcacctagtgatatcagagccattataccatcgtagtgcaatgcattattcacatgtttgtggtaatgctagtgtaaacaaacctattgcactgccagtcgtctaaaagtatagcacgtgcaactatgtgcagcccataacccttgataatcatcattaatgactgggttattggtttatgtatttaccacaccatgatttttaaatcattattttacagtgtactccctctacttttgttttttaaagagttaactgtaaaatagccccaagtaggttccttgggaggcatctcaaaagaaggcattgatatcctaggagatgacagctccatgtgtgttactgccccaatgacttttcagtggaacagaatatggagatgaaagacagtgatactgatggtcccgatcctgtgtaggcctatagtgatttttgtgtttgtgtcttagtttgtaacgaaaaagcttaaagaggggaaaaaataatgaaatagcagaaagcttataggacaaggatataaagaaagatattaattttgttcagctgtacaatgtatttgtgttttaagctaagtattattttaaaaagagtcaaaagttaacaaaaaaaaagatttataaattacaaatgttaccataagctaaggctaatttattactgaggaaataaaaaggtttttttatgaattgtgtgtagtataaagtatagtgtttataaagtctacagtagtatatagtaatgtcctaggccttcgtattcactaagtgccctattcacgtgtaccattttttatcttttatactatatttttactgtaccttttctatgtttagacatatttggatacacaaatacttaccacagtgttacatttgcctacagtattcagcttagtatcatgctgtgcaggtttgtaccctggagcaataagttataccacatagcctaggtgtgcagtagtctataccatttaggtttatgtaagtatgctctatggtactctcaaaacgaagaaattgtttcatgactcatttctcagaacatatatctgcattaagtgatatttgattgtatatatacttaagtaacaaatggaaatgggtggtaaagattcataattataagcaaattcgaggcacataaaaattccacaggctagacatcaaatatatgtatagaatttattttcttctactgttttggaatttagagtacagatgatgttttttctataagataaatctgtgtacacctattaaataaatttagaatataaaagtcatttatgtccttaaaagtcccttccttgtattccctgcttctaacaatgatgctcattataaacagaaagttgcatatgagtatataaatcattacattacttggaataaattgtttttattgactttaggaggagagtgctgtgctgaaaagtactttacatgcatctgtcacattccctttacactgagttatcgtggtgctttcttgagtgggtatactgttggttcaaagtgagtttcagcaatgattacctgagaagaaattcatttaagccaatcttaaatggcttaagcttgcagaacagtgtaaaatcaattttacactgatttgtgtagcttctgctttgaatcgtaatccaaataatgaagatctcattacttctttaagaaactacctgtattaattatctcatactagaatagatacatgcatagtatctttcacagattatctttaagtctgtgtctgccagtctgtcaccatattctgggatgtggaacatgctggaagctatggttttatctgtttcattcctcacaaaataagcatatacccaggacaattttctgaagtatgactggcaaactttcagaagttgtatgttagttgtttctgtttgatatgcagttttacttgtgaagaccactgccagccctatagtcttgtaaaaagccgacagaaatagtttctacacaacctagtcaagtagacattaactgaagttttaacaagtttattttataggcaagctcatatgtagtaagtcaattattcaatcagattgctctctctccaccaccactttaggggatggaacttgcatctaagtacattgtgacggagtaatttacagcatgagagtttcagagcaaagcatccctacaagatagctagattgggaaactgagcaatcaaagggcataaagatatgagtaccttgggattgaggatacagtacaaaaagtaggttggaaaagcataagaaacaaatattgtataacttggttgtggttctctgagatccccttaaaattatctactcactgcccttggtagtctgtgctgcaatctcccccaaaaatgtgcgagctagaaaatgcaaaccaatagtcatttttttgtggctaatatcatctgagtctaacatgaaatttataaaatttcaattatattatcaaattagaatcaaggggcttgagttatacagtagcacttactaatgactactctaggacatttcctaagcctgtctaaatttcaggttctgcacttcttaagtgggactaaaagtgcatgctccagaatagaaagaaacactaaaaagtttacattatgatacaacatgttcttatacagggctgggactaggatgaggcacatgaggtcctgggaggctataatttaaggaaacattcactttcagggttgatatctgacaatgagagcctctttaaattttatgcttgagattatcttgcttgtctccccttagtacccatggaatagaactttgagaaagtatcaagggagaaggagaaggaaatttctaaaaaatgatcagaattaaagaacttacctaatgaaatcattctggaaagagttaagacagaaaaataaatattacaatgaacttaagaaataacttgtgaaaattaatcaggtgaaaataatgagtagtcttgctgtcagagatacagtataagtaaagcagccagacctcagaataatcctaaatcttacctagttaaagtaacttttgttactacctaggtcatttaaagtgttttttactttgtaatggaattacaaagtagtaacttgaaattacttttcacattcaaatggcctggatccacatttctcccttatctgaatttttgtctctcattataagataaatccttctcattataataagaatgatatttacacctcactctcttttcaataaaggttaaggtttataaaggcaattataccacaccctcttttcaataaaggttggggcttatgaggtaagtaataatgaaaagaggaatcaaacagactaaaagaatgctataaaaagaaggaaaactgatagagtgcaggaagcagaagcaggagaatgtgcttgttaggagaaaacccacataggagtatgaccttaggtgagtcagtttacttctttacattagttttgcccatttgtgaaacagctataataaaagtacctttctcatagctgtagttgtgagagtcaaatgggctattacatgtaaagcgcttagaacagtccctgacagtgagcattctgctgatgttggctactactgtaattatattagatattctgttaggtagtctccattcaagcaaatctttaattcaagaaatactctgtaggtctctgtattacactgagctgactaatgcctatcttacaccttacatttatgtttaatcttgttgaattatatggttatcaaaaatcactttgtttaaaacttatttatttccactgcacttgcttttaaaatgtttaattcatcaacttaaataaatgttacataaagcaaaatataaaacaaatttggctcctatataaacactaagttgaattagttggaaaaaccagagataggcaaatcttgaatgaaacacactatcaataaaatacaattttgtcaaagtctggggaaggcattgtaaatgtccagaaggattcctcattcaaatggctttttgagttatcttgaagtcgtcactttaaaaagaaacaccaactagagaaattaaacatgtttccagataagattatctaaaaggataatgtggaactccagacattggaaacatacacaaaaatagttttaggtgctccatctaaatttgcaattctttaacatttctgtaatttttacctgagataaagtattcaaagaatgcacttatttttgttacatccttcttcaaccaaatttcaattaactggtatctccatctctatcctactaggtaagagactttctgtagtaatagtagcttggagaaaagaaacagaaagctggaaatttagggctggctcaaggtaatcatatatgtgacatttaaattttcctttttgatggtccagcccattatatctaggcaggaaaggaggctgaatcaaataaagtagtagaataaataaataaataaaagttaaaaataaaaaagccccgaagcccaagtaccttgtctttttctcctcagaacttcagttaataaacacgaaatacctggctgaggaacccaagcccaaacctcagtgtgcaaaataacttgtataatctaaacaaactgtagtgttcttgaagacatgatagaataactttgttaaaaaaaaaaaatctgcctttgtgttttgtaagtgtgaattctaatacataatgttaggttatgactttatgtagtggattcattaatagtgatttatgtggaattttcatttgcaatgcaaattgtattggaaatatattagaaatgagtaaatgctaccatgtagagtgagtagaaggaagaggaaacatttagtagatacttttaaagcctagagacacaacttaacttgtctcatagaatttgcatcagtatctggcaagaggtacatatattccgtgaatacagagctattacacattagtaaaaagatatatattcctataataataaagataagttgggaaggttatgaatagaaaattaatataaataccagattaataagaatataaaaatttgcacatttagtagtgatttttaaaatgtaaattaagcaaggagataaccaatgttgacaaagggagaaaaaatagcaacacaacacaatttaacaattaaagtttaaaagtattaagaatatgcattccgtatacacaaatatagcaatggaaataaccacagtttatgcaacaacataattacaagcacatattttacacacaacaacaaattgtgttacacaaaacaaagaaaatgtccaatactaggaatttgattaaataacttatcacatttctacaaaggacatattcaataactaaaagtgatgttgcagttgcatatttaataaaatgaagaaaatgcttacactacattactaaatttacaaaaaagtacaaattaatatattatgtgaaataatccatttatataaaaagataatgaaaaaagaatgacaagatcttcatcaaatgttttcaatagtgaaaaaattaacattgattatctctaaaatcagtattttttaatgtttttaaattattttgttgtcatctttgtatttttctgtattttacaaatgttatacaggatcatgtattagttcaataaacatataaaacttaaatgctataaacaatatattttttatgtttcaaatgttcatttttgtctgaagccttatccagcttgtagtgatttctcctttcttgaagctccatcacacttcacttctattgcacattttggagttaatctatataatcctgtactaaatctaccagtcaacatgcttattttccttagtagagtttccctttctgatctcaaggccacacgtttcttatacttcagcagagtatatgaaatatgtgggtagagtgatctatacaatgattattttaaggtgaatatttacataatatctaaaatttgccaggcactattgctaaggcttggggttgatggaaacctgatgctatctttatttcgtctagtgtgagataaatgaagaaaagaagaactgtaaaatgttgtttataagtacatggagtggtaactcaggaaggaaaccaaacccaggctttgggggctcagcaaaagcttttcagaggaaatatgtaaaggaatcgataaatgaataatgaattggagaaaatatgatgactttgaagtaggatgaaagttttgggcaaagggaagaccaactacaaaagctcataactgaccaaaaggaaagatgtttgaaaaactgaaagtagttcctgacctgggaaataaagccttcgaggtgaactgaggctagatcataaagctttctttacttctccccattctttaaacaattgaatgttaattaatatggtataatttaaattccttcaggttggttaaatagttttagaaaaatggttttaaaattccctattgttcattaagaaatgaattacactggtaaataaaaataataaaatgtatcatatttttcatctggaagttgggacttcaaatttatttttgcaagattcataatgtttaataattttgtttgcatttgctcttgggaggaaaatgtggatataaactatttatgatgcttctctctcagctggaaattactcagcaaactcttcatcagacttaaattaaatttacaataactattttaatggtcttctcagtttcttattttaaatatacaggtggctcttgaacaacacaggtttgaactgcatcattccacttatacacagactttcttctgccactgccactcctgagacaacatgaccaatctctccccttcctcctcctcagcgtactttcaacataaagacgacgaggataaaggcatttatgatgaactacttccacataatgaatagtaaatataatttctcttccctatgattttcttaataatattttcttttctctagcttactttattgtacgaatggagcatatatgtgtacatataaaacacataatacatgcttatcaactatttgtgttatcagtaaggcttccagtcaacagtaggctcttagtagttaagtcttgggagagccaaaaattctagctgattttttgactgtgtgtggggggtcagcacccttaactcctatcttattcaaggggctattgtattctaaattgtcttttagcttgagtcataatccaggtatagtgaaaaacatttgtgtctatttaaaaataatataggtaagaattttaaaaattatatatttttcctacatgtcatttaggaagaacttaaaatggagttatgtaagaattatataagccttttaaatttgaccttttatttctggcattagaatctagtatactgggaaggaaaatgtgtaaatagaaatgaaacaaactattcacaactgtttaagatcatgtataaaaaagttatacttgttacttttctgcctgaaaactgcaataaagtaataagactttttaatattttacctattgctaaaatttatctcattctcccatattttattatgctatataagatatgagatttgggaaatctagtaattatcagaaataatatactttataaacaaaatatataatttaggaatggaataaacaaataattaaatactatttgggagtttttgggaatttgtcgtcatgcatgccttttttgtcacattttgttcttttctaggattaggataggtaaaaaattatgagatgactaggaatttataactgaaaaacaaacagactttgaaagaaaaagatattccagatattccatttggtatctgtaaaacgtcaaactcacataatttcataattacagaaacttcttaagaaatagtgagttacaaaagaacacatacaagtgtccaacaaacatataaaaaagctcaatatcactaatcatcagatatatgcaattaaaaccaagtgagataccatcccacctcagtcagaatggctattactaaaaagttaagaaaaaaaaaagatgtcggcaagggcacagagaaaagggaacacttatacactgttggtgggaatgtaaattaatacaacctctatggaagacagtatggagatttctcaaagaactaaaaatagaatgagcattcaactaagtaatctcgctacttagtacctacccaaaggaaaagcaattgttatatcaaaataattcctgcactcatgtctttatcacaacattaatcataatagcaaaatcatggaatgaatctaagtgtccatcagtggatgattggataaataaaatgtatatacacaccatggaatactatgcagtcataaaaaagaataaactaatgtcttttgtagcaacataaatggaactggagaccattatcccaagtgaaataacttggaaacaaaaaaaaatcaaatacaacatgtcctcacttgtaagtgagagctaaacaatgggtacatgtggacaggtagaaggaaataacagacattggagactccaaaagggaagaggttggtagggatgaggtttgaaaaattacccattgggtacaacgttcactatttgggtgatgggcacactggaagccccaaaatctccattacataatatacccatgtaacgaactttcacatgtaccccctgaatctataaaaataaaaaatattaaaactaaaaaatgtagtcacttaagccttgcatctttagtaatcactaatgcttatatcttatcttctgagaaattacctgagggaaagagaaaggaaggaaggaagaagggaaggaaggaaggaaggtaggtaggaaggaaggaaggaaggaaggaaggaaggaaggaaggaaggaaggaaagaaggaaggaagggagggaggaagggagggaggaacaaaggaacgaaggaaggaaggaattgaaaaaagagtaagctcagggtcttgtcgcttgggagaaaaatctaaacttcagatgctagctcaaaagtctgctatgctagctttcacgtctgatatgaatcatagttcctcatttgaaaacctattaaaagtagcagcaaggttaataaagagcaagcttaatctcttgagaataattcaagctgacattgaaatgtgtgctgtcacaattttgctctgtagacttagacacacggctatttgcctagcactgaggaaggggaggagcagaaactgactcacagttcgagatgttggaggagctgaaggacttgttagggaaaccatctcctggattgctaatcgaagttttaagcgatgcagtggattgctgattccaatttctctctggatctcagtgtcagataaagcagacatgatggcaccactcttcacgttggctcggcaggctgccacgtaccacgcaggcattcccaaccaaagctgttagataggaaaaaatacactaacaaattataataatagttatcattttagtgtctcatatgctaggaattattttatgtatcttacatacatgacctcaccccacgagataaaatgttatcattattttccctagaggacatagatgcacaaagaaattaaatgatgtatttaaaaacaccagggaggcagggatagaaacaagatttgaaattgagacatgctagctccagagactctattttaactaattcatattactagtggtaaaagtaatggctgcatggcaccaagttcccctttgtatgtagggaccagaacggctacaagccacatttgataagggactcaattaatgtttgcttaatgagtggcttcaatttataatgcttctttggaattctgagtgaagagaaattctgtcacagaacgagacagctgtgccacatccagccatgtgatttcgatcaaagcatgcagtgtagctaagccacatttccacctaccttcctacaccatgtgaaagatgtgtgaacttaattagatgctatatatgaaaatgccttttagagagtgaaatgatgtgctaagaaagaagttaaaactcaaatcattgaaaaactaaagaaagcaacaaaattaataatgcatcagaaattagagattttaagactgggcacagtggctcatgcctgtaatctcagcactttgggaggccgaggtggaaggatcacatgaggtcaggagttcgagaccagcctggccaacttggtgaaacatcataatactaaaaatacaaaaattagctgagcatgatggcgagtgcctataactccagctactcgggaggctgaggcaggagaatcacttgaaactgagcagcagaggttgcagtgagctgagatcaggcctttagactccaggctggggacagaatgagactctgcctcaaaacgaaacaaaagaaaacaacaacaaaaaatgaggccaggcgcggtggctcacgcctgtaatcctagcactttgggaggctgagatgactggattgcctgagcttaggagttcaagaccagcctgggcaacatggtgaaactctgtctctactaaaactaaaacaaacaaacaaaaaaatcagccaggcgtggtggcagatgcctgtaattccagctacgggggaggctgaggcacgagaattgcttaaacccgggaggcagaggttgcagtgagctgagactgtgccactgcaatccagcctaggcaacaaagtgaaactctgtctcaaaaaagaaaagaaattagatattttgatttttcaactttgctgtgagactcttgaaagacaattaaaccagcagtgctatttacacagcacaggtctcgtgcacatctcaagcactgggtgaatgccaatcacgggcattatatttcagcacctgaataacatcacttaaaacaggaatattctcccattttccctccatcattagttatgagtaagaagtagaaaacacaacaaaaaattagcagcttacatatttgtttttgaatgtccaaaagattgactgatttttttttctatttgttgaaataaacagattgaacaaaggagagaattgtgagagtgagaaaaagtgagacaaagaagaaaaactataaatcagcaaaatacagtgccaagagctctggaccacaaatcagaagacctgagccctaattcctttccagtcattggtgagtcatgtaacccatctaaacctcagccatattttcctcatttgtaaaatgaaggaatcaagcttgattatttctctctacctcctgatatccgttcccttctataatctccttcttttgggggtaggattggcccagtgatttatttctaataaatagctgatgataaaagtgatgggatgtcactttccagtttaggcaataaaatgactgtggtttcattcctgctagtcccctcccgctgtctctttccctctgagctctcactctggagtaagtcagatctcaggagccctgtggagagtcccatatgacaaggaactaatgtttctggccaacagccagcaggaaactgaatcatgaccctgaccatatgaatgagcatggaagtggattctccccaagtctagccttgagatgactgctgccctggctgataccttgattgcagccctgtgagagactctgagcagaggccatcacaaagctattcccagactcctgacccatagaagtcatgagatcataaatgccaaatttgggggtaatttgtaaacagcaatagctaaccagtataaacatccttttagttgaaaaattctacaatattaaaagactatttgtctcttttgaaaaaaaaaatgccaacaacgaaactctttgagtcagtgtggactgggttgtgatagagataagagaaaagaaggggaagatctaagtacaatgtgtgactgtacagattatgctttcttccagcaggttaggcacaaataattgaccttgacaggtacattatatatgacagaagatagtacttgactatttagtttataaactcaaactgttcaaaataactaaacatctaaatatgtcttctttggaccctaatgatttttttacctttgtcttctaagatatttggatttccacactagttaacatcacccaaatgcctgccaatacattgttaccaatgtcatccataattagaccttaaagagtctttgatgcggataaatggcatgtgaagcatggaattctcgcctacacaaaattcttaacaggctgtgcactcaaggaggaacgaaaggagatgaagttaaagtttcattcattggatcactcagctcattcatcttgtttattccattttataatttaagttgcattaggaatcataggcaatttctgtgtactcagaataggtttaattagcacaaacttcactgtctgtcatctcctatcaccttaatgtcagtaaatctgtttcttttttctttttatctgaaggatttgttcgtcgcttgccaaaatagcagcgaactctctgtcaaactgcaactcattttatcggagcaaaaactgaacaaagaactgctatcatttctgaggtgtgatttcttaagcattttgtcttgtgattgattttttaaatatagtaattttaaagacacggttgaaagaagcagctgatcgctaatatctgatggctaatatgctaaatttccctgtctgatgtgaaagaataaagtaaaagcaaaatacaggcatttttcattcagtgcaagaaaaaatacaaagcgtgtttctagatctatctaagtctatttttaaaactaaaatgggctttaatgtttctttattatttatttacttagctctggctataataaaatgaagacggataattttataatccaagaccatttaaaacaacatgtataattacctctggcaggcaaggaaagcctggattcttctttgccctgacacaggcatatcctagcagctactagcagctcacatagagaactgaatagaaggggcagtgaacagtactgttaagtgacatgaaacagcccttcgtagtcaaatatgtagttccgtcaatgtcaaggtcagtttctgctgcctcctacactgttcagatattcccttatttttccagaacactatgttgtacaggaaatgctgaaaatagttcttcttttattgtagcattcagtttggacacagaagggaataaggtgtaagtcttctgtttaatcccaagtgtctaaacctagctggtccataggctttagagaactaggttcaggaactaaattacaggcaaaggaatgtctctctgtacatctaggtgatcttactaccttggattacagaagtgttgaatatggagagggtcttctctgtaacctgctaatgaggaagggccctggcctaatggatgggaatggatgttctcttgcaacaataaaattttgtttcttctcttgctctagaaatgaaaagggtgtgatttagagacacttccttttatcccactgcatgatttcttctactacgatcacaaaaaagtgtcagcataaaatcataaatttattccctagtaagcaaatagtcccttatgagcaattccagactaaggggatgctgtgatttcagaaacttgccgttacctgtctcaaaaaaattatcaacttagtagtgattgattcaagggcctcctagtttcattctcttacctctagccatgcgaccacagttggcccatcccactgggcaaaaggtaatccctttctccgagcttcttcaagaagttcatgcctgaagtatatagcaaagattattaggcaggtatatggaaaaatatggctgtgattatttttaatgataatattttaaaataaccaatcatcctttacaagattttttatgatacaatatagaataacagaattccttattcctttgagtaacacacacacatcatccattgattttattacgaatgaagcattgacatagaaaagtaattttccccaacatttattcatgaaaattagaacattaagtgctaatggaattagaagtggaattatattaccagcaaatatcttatccctttaatgagaaaatggcccaaatgttcatattcaagtatgcattatgggatctaaatgtggcttccaccatctgccctgccctctttgccttactatctccatggcaaagaaaatgcttatatagagaggcagaagataaatttggtccttttagtcacattctagtgatgtggttgattttagtatgccctgtgggtccagggatctatcttaggagttagttatttgtctagactataaaactacatctcacttggagaaaactccaaggtaaattgatttctaacactcgaaagcaatgtaaggtatcaaattcaatggtacacttgcttttatctataatcactactgttttaatgaaattaaaatatcttaataacaacaaatggttgttttgataacaaaagatgcaaaagaactctgaaaaatgcatctataatttcactgaccctcttactgatttttagaattgacatccacttacaaagccaatttgagatcactcattgttaagatagtagctatgtgctttcactgaaattcaaattgatatatacttggccaggaatatattggaaaatacattctctttactttagtatgccttgatcttacacatagatgataaaaacatggtataataattgctttattttgaatgcgtatgttttatgcttaggaatatttcatgaaaatcatttatgaactcccaaatggataatttgattattttctactattaatcaattagttactgtggtagactatattaatacattaagatatataatgaataaaatgcctttcaacacagagttttctgtgtttgtaatagatgcaaccaaaaattcattaaaaaaggtgcaaaatacaaatttaagttatagtggctgaagagacataaatcaactgctgtttcatttgaggggatagaagtgttaagttctgcatgtaagctattcagcacctgggaaagggaacagcgatactcgtgctctgaatctaaaaaagtagaggcacttcttcacctggcttgctctatcatcctccattccctcaggtctcccagtgacattcctttagtgaaaaccagtttcaaatagcttagcctcactgtgacagatatatatatatagaaatggattgaaggatcaaaaacaaataacctattaggtacttattgaacacctgttgtggactgagacttgtgtttggtgtggaaaatagatatgggtctaatttcccaggatatcctgttagatggacaaaacaaacacatgaaactgtctgaaaatacaatacaatacaatataatacaatacattacacaaacagctgctaacgtgaaaacttggtgatgtaccttgtgaagtatgtcattttagaaaaggggttaatagccattgaaggtgttgtgaaggcattgtggcaatggagctggcttcgaagggcaggtaggaaagaggtggggatggcattccaagcaggagaagcactaatggggaggtatggaacttaacatgaaatacgtggaagaaaatttagggtaggccttcacagagttaatgcatgttgtaagagttttaatgttacatccaatagggaaagcgacacttctagttatgtcataggtttgtgacattaaaagggaagaaataaatttacatttacaattagtttttgcttcacatagtaaaaaagcaagtaaatatgcactaataacctaaggagcacgtaacattttcagaagtgtattctatgagttgtacaaaagctatttttaaatattagaacgctttcattttgaaacttctgactagttccctaataaaaatcccactagaaaggccagagtgatccttttgagtctgatcatgtaacttttctgttcataactctccaatcacttcctgtctcactggaaataaaagccaaaacagctgctacaatctatcgtacccgcgccatctctctgactaaactcccatctcagtcagcaacactggcctccttgctgttctttggaaacaacccagacctcttttctgtctcaggatcttggcagctcacctggaatgctcttcccctctatctctacatggctaactctctcagctactttaaatctttactcaaatgtcacctgttctctgaatgtctcctcccttactccctgaaaactccaataaggaatttcttatccccattgtttgctttatttttctccaaggtattgcccttctaacatagtatattatttactcctcattctgtcatctgccaataaaatgtaagctcagggaggatctgtgttttcatatgctctgttcagagatgaatttgaagtctagaacaagatcaggcacagaagaggtgctaaataaatacgtgtaaatgttaaacaaaatgccaatcagtgtttatatttaggtgcttcttgtttcagtaaattgtgtcctataatgttttgtttttgtagtccaaatagctttttctattttaccttataaccatgtacaacattttgtattttaaagaacaaatttttttcttgcatcttacctcctcttgagcttttatttcccactttctcacaatagtactgattctagctgatcccaagagtctgatctatttgggattcctggtgagaatttggttaagaggcaacccaatgtgctcaaatagttctgttctatgaacagaagtattgataacacaattgtttgggaaattattgagcaatctggccactgaaaaagttttattttcttggtttttgttttgtttaaatcacaaactctaataacaggatgactttagtaatagcagtctaagaaaatgagataagggagctcaaatcctttggtttccaacagttagggcaaaatctctagcatctgtcttagggctgacatacttgagactgtggaaaaacggatcagatgggagggatggctaggttttacaccaggactgtgtgctacatgatggtaactccagatgtgcttttccttttgagagaagtaacaattatttaaaaaagaacagcattgaaatttacaaagcaatattgccttgcattattatttttaattataaaataatcggcaccatacaaaatttataaaaggcatatatctaggcatgttggtttgagagacaagcaatgctagaaaaataaagcaatgtgggcaatgctataatacttggaaataactgaatttaatacatgatgatatgctaatagattattaagggtagcactaattacataagggcatgcttattctcatcaagttttggagttactgtcagaaaaatagtgatctgaactgtataagaaatcctaaatgacaaactgatttggcacaaagaagtcttttggatatactgctgttctccgttcaacctgtcaatgtatgtaaagggatttagtctggaatggattttctttgtagccagaattcaactttttttaaaggtcaagtgacagttcatccagaaaaagaatgtgatcacttaccccagtacaaatttaactatgaaaattactctctttccctgttggcctgaagaataattttagtgtgtttttaaaaataatttcagtcaatcaaatatttgaccatcttttcccaaaggatcacccgtacatcactaaatttcggggcatacatttcaggtttaagattcagaatagattttagagggcatcagctgtacttccttttagaggaagtgtcaggcatggaggtgttatcacttgggtcaaaacacaaacaagaaaagtactaattgcaagaaacagttattttgagacagtacaacttctgaatcattgtgcattttcaagaaacactcttcaataaagaatgctgttagtatcttccataggcctcaggttctcctattattgatatcaataagttactgtgactagaaagtgatattttaggaggcccaacatgtggtgagcactcaggtctgtgaataatttgcaagtccgtatctaaatgtgcagagggaagtctgcacttgctatgcctgaactgaagacaggagcaaacaaagggtgtgcagtcaagaaatgacgagactcaaaaatttctagataaaagaccaataggttctagaaaatgtatataaattagaagcattggccaagctacagatttccaacttttaatgcagactaattaaccaggcgggtgcaactctggttgaatgactaaatccagatggaaatgcctggattttcattcttaggttttaagtttctccttagcgattgttgttgtggtctaattggtatacgagtagagtctctggctcccatctcttgcatttgcatgccatcacatgcctccctgccttatctccccacatactttgtcttgattttcatgattcaacaaaaatgcttcctttctatatccatccttctcttgccctggaggcattatctaccactttcatacataggccccatagtactaagcaattttctctatagtatcttttatgtttcattgaatttgttggttcacaagttgtgacccctgactccatgggcttgacagcagagactttgtacgctctgtgtctgagttgattagggggtcagtcatctgatttgtatagacctactatatgccaagttttgcagcaagcaaagaataaagccaactgaatctctgacctcaaagaccatacattccagtgaggaaggaagatttgtataaacacatatacacatacataaacaaaataagttgagccattgatatgtgttctacaggaggtaaaatagactaaggcagtaaagtaggcaatgcttatagtgttctgggaacatagatgtctataacgaggcaacatttgagtagaaacatgtacgttgaaaagtggcagggagtaggggtatggtgggaatgttttaagcagaaacatagtataaaattcctattaaaggagtggaattaaatgtttgagcaactgataaaagccaagaagggccagtgtgactggagtgaattgaaggacacgggagttggtggtggaggaagatgaaattggagacgtagacaagagaaaagcaagaacatgttgggctttgggagctgaagaggagtttattctaaacatagtaagaagccatcagagggtttaagcacaagaacataaaataatttgtacattataaaggcatttctggctgttgaggatagcacggacttgagtcaggccagagttgtgatctaaggatacaagttagaaggttgtttcaattttcaagcagaagataatggttgctttgtcctgagctgtggcagcagaaatggtgagaggttattggaatagggattcaggcacacagcatacattcaataaatcataactgaatgaatgaatgcatggcaaattaacttcttaccagctatgtgttttttggctatgtacttaatctctttgagacttaattttcccatatttgaagatgattataaattgatctcaatttataagaactaaataagataatacttacaaaagcacctagcagccaatatgtattcaatagataactaatttccgttctccaattttttcttattttcccaaagcaattcattgtgtgtgctaccatcagattaacctccttaaagtaaacatttattagcttactatataactcagtaaacatatttattagcttactatataactccaatttctataatggcttttaatttactattggaagaatggcctttaaggtcattcttgatctgcccctaaattgcatttccagatttacctactgtatctattctctctagctacaatggatactcaccattctttgcactttacctcttctgttctactgactttctctccatttggaatggcctttcctcaattcataccattcaaattttctctatcccttgagtgatgccactcatatcatgtgcaagactctggtaggccgttcaccgtatgtacacagccttatttccgctacactataatctcctgcaggcatgagccatgtctcaactatttaaaattacttattagacaatcctttccataaatagctatcctattggcaactatattggaatggtaaaacttgaatttgttagtgtttatatttgcaattctgaaaaatgaaattcattagttactcaaaaaagtcacagaccatagggaacagtatgtctcctcctcattcttcctactgtggatggtttatctctgtcagtgaaaagagactttattcacagacctctcactttagcatgctattctgggatgccaatttgtggtatgactgtccaaataccatacagcactgtcccctctgtcactcatgatggccatttcattcaccttctatttgatgcctgtcattttccccttcatactttctaatgtatcttcctttactttctattgtcactgctaccacagtttttttctcagcctttaattggtccttctctccaggcttcttacactgacattaaagaaaaaaaaaatctgcctggaagataaactttatggcagagtgggtgagaaagtggctcccaaaatcaaattgcttgagcttgattcctttgcctgtccttttgggctgcacatccataacaagtcactgtattttgctgtgattcagtttcctcatgtggaacatgaagctgataacccatctaatagggtttttacaaaggttttgtaagaaaatatgtgtaatatgattacaaaagtaactcacacaaaaggcaatggtcaataaatgtgagcttctttcttactgttttttgtttgtttgtttgtttgtttcgttgtttttttttttttttttttggcagagttttactctgtcttccaggctgcagtgcaggggcctgatctcggctcactgcaacctctgccttccaggttcaagtgattgtcctgcttcagcctcctgagtagctgtgattataggcacgtgccaccatgcctggctaaatttttgtatttttagtagagatggggtttcaccatgttagccagggtggtctcgaactcctggcctcaagtgatctgctcacgtcagcttcccaaagtgctggcattactgacatgagccactgtgcctggccaggttttactttaaataatcatagcactgtcctctaaagccccttcagtctttcctcaaatgtctaaaagattatttttaatcttcattacaaagagattcctggtttaatcttgatttaattatctaattacctttccttctaaccagaattgaaaagtactttcacagtttgtgcattaccaattccacctttgcaaataccacttcccagagctggtaagttgatcgctactttttcaactatcaacaaccttgtgtttacttaactcctggcttcccttttatatgaaatattttgtgatcagcccaatctacaattatcctcttctcctttaaaatctggaagcctgtagtgtcaatctcactcatagagatcactggttaccaccatgtgcccgcagcctcatctccaacccaagacagtaaaatcctggaaataagagtttgttcttcaaccgtatcatgcatctttctctggatgttctagtcaagaacatcttttgaatgactgctaaattgtaatccaaaaaactcacaatgttgacaatcacctaggatccttgattatagggcatttttaaagtattctatatttttataacttccaactgttcattgcatctcaaaaagaaataagaattctgcatcacagttacccaggttggctgcagaaaagattacaatgttatatctaacattcagaaagacattttctagactaactgaatactgccaaagcttttgtttaagccctcatcaattgatgatgatggtgatgggctcctagaatctctctatctctcatttggtaacttgtcccttccaacctccactgagaccttcctaaacacaaatctttttgtaagactcacctgtttaaaagcctccctgactgtcctcaaaataaaggccaaatatcttacacaaagacgcttcacaatctggctgtctccctggctttttctgctcaactaacacaaatatttgctattacccaaatacctcattcgattttacccctccatgtcttgctatatgcccttttcttctgccaagagcatccttcttcacatcaccatcataacaactttaacttatccttcagacagaactcatgctttatttttttctattaagattctaagtcctctcccaggcagaattaactctctcttctatgcaaataccataacttgtatctattatacttgtacttattatactttcacttaaaatttaaaatgtaatctaaatataattaaataaattgcattacaatttaatacagtaagtgctataattgagatacatctaatgcgctctcctgttcatctgaaccagttcatattcttataagatgaaatatagtggtttgaaagagcaaaggttctggatgcagacaaattaggctttggatcacacaaaacagtaactaatgtgcatttatcacttactacctatgaagcactatcctaagtgtttttatgtgtattaattcatttaattttcataataatccaataagatacatattgacacacatttgcagatgagaacaccgaagaacagaggccagttggagtcatggaaccgtcgaggtgcagaatcagaatttgaaccccaataacctgtccacagagtcagctctcttaacctccatgccatctcttagccaattaacatttctgaaatttttcataactgaaaaatgaggataatagcaccttccttattgtaagtgtaaaataaaataatggtcccctacttttctttcttttcctatggttcatttgtttttagaagtggcatacatttatttgacttcctggttaatacataaggtctttaccttcttattgtcacacatttcaatcctcagcattataaaagaacaaacgaactgtggcttttcttttcttgttattccctagtaatatcaggttgtacatcttggccagagaaaagttagcctagtttaaatgaatgagatagaaaagttgaatttgttgccattcatttcatttcaattgattttgtaataaccatacaaaataattctctgggtgaaaaatttaccttcagagctactgatttactatggcacataagaagtacttactgataaaaccagaagaaatacatatgtggcttgataagaatgaagaataaaatataagtcaaataatgtgacaatgcaatatacttaattttgcatcacagaaaataaatcttccttacataatagtagcaggaaatgtacacagacttcacactattattaattgtaaaatgtatattgtttcactaaaattcagctttcaagagggtaaataggatgtaacctcctcaaatttcaaccaaagaatggacttattattcaggaatccatacttgattaagtctgtaaaaactaaaactacatatttgagaagctagttgaaattctggtcagcaaatgcaaagtatggtgccaactcaattattttttttaacatctgcaagctgaacatgtatatcttagttaacataattattctaaacagaaatatgttacaaattccaatcagttgcttcagaagattgattacctaactatacatatttagcttcataaaattaagagtttcaaattcaacattaaatttgacttgatttgaaagcaaagcatactgtgattttgtgtatgtgcaagtgcaagcgtgtgtgcctgtgtatcctattattgcatattttcacatttggtgaaaatgtatgaaaatccatgacatatttaagtagtgttttattcagattccagtaaaacatgctaggctgtttagatttcaaataatttcattacattggaactaaaattcattcatatttaaaccgtttatcttcaagcttctctgaaatatagggcatagtctcaggaaagaaatgtatttgggaattgagttgcgagttatgtaatctccttccttactgtattttgaatttaaatattttcaaagccattaaaaaggtataaatacccccctgacacacacacacatacacacaaatatgattgaatcatacaattatttatgctgttattgaaaatgagaggggcttatattcctccccattaaacaatttcacttttgcaagacaccatagtctgtactttccagtcacttcctaatagtaattggggacctactggagaatattgtaatttttcaggttatatgaataccacttagattagattgctctagtgtttcatctaattttaagccctcttttacccagtttggaagtgtatagtttgtatgcttctgaaggtacagacaagtagataataatattagtaagtacaaagaatatgtcagtcactcagggccatgtagcaagtaagtggggaagatggaatttaaactctatcttctgattcctaattcagtgttgtttgctcctcacatcttcctatgtcatcttcactatgttgtactatcttccctgatattatattatccaaagctttcttttagtaattgtactagggaaatggtgttaaggtcctaaaatgtttaagttcgaggagcatgtgtaagacaataagaaaccgaattgtagaatgaagtccattatatcagtttcttacagtccattaataagaatgcatcattcattcattgtttttcaatatttaattcaataaggactcaggggaattaagttttatttcttgaaattattttcctctgaaaaattaaaaatcattagaaaacagaagacaatttatatgatgacatgaaaactgtgttttaaaactcaatgtctataatatttgttattttcaaaaagagcttacaatattcatttggccaacatggttgacgagtactctaaacaaaacctgccttgcatttttaagaacaccttactagagcttttcttaattcctcaatattgtaaaacatcctaactgaagcaaataatacatcaccaagtcattttggcaatggcaactgtaacttaaaattatattaaaaataatataaaccttactagttaataaagtaatattacaaagtacaagaatttgtactggcatacaaaatatttatatagccaactagtaatatgtttaatagtttcctggataattgtatctcattgcagtcattttattgataaaaaataacactgctttaaatttaaaagcaataccttcttctcagtccaaagtgttttaatgagctcaccatgttacaaatgcagtagtctacaccaatgtaaatattatgcatattttattttacttttttactttgaagtcaaatttctgttaggaatagataaatactctaattttagctcaaagaaaaggatttaaaatttgaagccattatctgagtaattcaggtttttaaagctttagaaatcaaccagtagtacaggaaacaatgggaacaacacacattcaaccaaaaccaaggattattcttggctctctatatgtaaaagctctccagggaagaacagcatttaacccttttcagatatgtgccgttctattcattgatgaataagtttgtctcttgaacataacacaggtggaacattaagaaaggtagaggcggcccggcgtggtggctcacgcctgtagtcccagcactttgggaggccgaggcgggtggatcatgaggtcaggagatcgagaccatcctgactaacacggtgaaaccccgtctctaccaaaaatacaaaaaattagccaggcgtggtggtgggtgcctgtagtcccagctactcgggaggctgaggcaggagaatggcatgaacctgggaggcggagcttgcagtgagccgagatcgcgccactgcactccagcctgggcaacatagcaagactctgtctcaaaaaaaaaaaaaaaaaaaagaaagaaagaaagaaagaaaggtggaggcaattcagacaggcagcacaatcaatagtacctgagtggtctcaaagtatgacttgagcctggctgcttgccacattgaccctttagggaattacttgaaaactagagggaaggagtctagaatgtcttttgacatgtgtataataaaactgaagaaatacaagtgcccaaaagcttacataattaattaaaatgtgaacatttctctgaaccaatgattccttttactgtgtggaaataaatatgcttcatgattttcatttcaggtcagaggcagtgcagcttgtgttacaactcaaaagagtaatactctgaaaaaagaaaaaaaaagatggcgctgaaaataaacatgttcagcagccattgtgattcaacttacccagatgtgcttttcatgagatggagaaggacggatggaaaagaaaagcacacaaatgttaatggatacagttcaatccaaagaaaaccatggaataaaacaagagcattatttaagatgtgagaaagctcaggtatgagaaagacatggtgccattttgtatttcatcatgacacacatactcactgcgtcgaaaagcatagtcaggctgagggtagttctaatagttgaccaataagtctatgtcttgagtatgagccactctgaaacatgcatgaccacattttcccagcctcgagtacatcccaggaggaaatcaagaaatcttggtaaaggacattctttacctcaggccacttccatgctattttaccagtagaaacaataacttattaattggcacttagatttttatatagctttataagcctactgctaaggcccaagaaaaaagaacagcagacattagaatgggcagcaacttgaagtgaagaatgtccttcctagtttgaggatctgaaaatctagattctatttctcatacacagtttggtcaaaattattagcagattctgatcttcaatttcctcaacacaatccctggcaatagaaatgtgtaaagtccattccagatccataatgttattattccaaccaatgctgtaataataattactattttggtaaacatatatggctagtaatcagaacataagaaagtgtaaaaatgttctattcctcttcttcggtggccatattacttccttctctatttgactggcaaaataaacatcaagtttgtgtctattgtggctctttcagtggtagaaatatttaattatttgaataggtgtttataaatgttgtttttggggaaacatccataaattatattggttcaccaatattaccagaaatcatcactaaaacgacattgatacacatatagcttttgaagaacccacttgctccctggatgtagtagaggcattgagaaaatatggaagttaaataattcaacaaaaattcatgagagtattgttttaaaaatatattacaagcataatagcctaattattaaaaaataaaattgttactacaactcataaaacatgttcaatataacaaaatagaaagcagaaattcctatgtcagaaattaggcaagttagagcatcttcttttttatcgcacaattattataaagaaaagattgatgtgcaatggaacaccctgcacatgcctcctctcaaggcattcattcagagaaaccgtgtactttttattaaatcggcactttgaaaaaaatgcatatttttggccttaactccacagcatctgtgggaaactccttagattttcacataaacaaaagcagaaatgttcataaacactggcactacactgtcccaagaaatttatcatatttttcacatcatacaccccacagaaatgaaattaagaccaaaaggagatagtttttagattttaaaatgattttcttgtcaacatacctgtgaactctacgatgagctctgaaaaaataggcaatttctgagctttccaggaaaattgccaaaagcatttgggactagttatcaccatggacaacataatctttctgagcctactagctatctaggaatcacttccctataaaacaagttgattaaatttgcacgtagtgaaacctaatatttattagatgttccttgatcattttttaaaatagaaaacttacacagtataaataccttaaaatataaaatataagataaaatatgaaaataaacagaaaacacaaatttaaaagatactgctcaaaaagcattgcacaaatttctaatatttttgttatcaattcgtataaattatctgatttctcatagtttttatgagctttcttctcttccatagtaaataaagttaagaactatttcaagcagctatatcactttagaatgttaagaatttcacctcatgactttcaaacaaatgtgttctgcaaaagacaaaaatctatagttataaatgacccatattttgtgctaatatattataaacttcatataggaggtaatatatatttgcagagaagttttttctgattaatttttcttattgtaaatattgatacattcttttctacacatatttatttatagtagcatatagcctcattatttttctctccatgtcagaagtgtcaaggctatgttaatagtaagaaagattctgtcaagaataaatattcttcagtgaaagaccattgtgagtaattggcaagtaagttttaattaacataaaaaaataggttatgttaccatctaatgaatgagatcagatccaattattgacattatgttttccttgccaacatcagcatatattcagtcaggagaagaagaaatgaccagcaaacatatgtcttatatttcaaaatgagagccttcaacttttcagtttcctcaccttgatcttccagatctcctacaattgaatgaaccttcttctgttataaactagtcaattctggattgaaaacttcaaataagaaacaattcattaaatgagttttatatttggaatataattgactcttgctttgtaaagttcaagttggtgattcagacatatttttaaattagttattaacatcaaattgagtagttaatggctggtaactgaaatggaaaagtaaaataaataaatattttttttaataggtgaaagttgagaatgtttaaatgctgatgggggaaaaaaaaagacaggagcagaagttgaaagcaagggagaattccgcacaaaatgactaagaaaatggaaagggatgatctgagtaaaagaatagcctagttttctacaataagacagatggggcaagtgttagtgtatatttggcatcaagcaattcagggcacttggatggtttctctctctgtctctctgtctctctaagctagaatgtaaactcatcagcagaagattcaagtttgaggagagtggaggtttctaacaagagttgcagagagtagaacaacactaatgaaagaaaactcttgggattactaggtaatgctgaatttcacaatgaaactatttctaatttctctgctgtaattttctccaacagcacagatgtgccaaaatgtacacatggagaaagaaaattcatcattgggtgtggttgttatatgtagatgtgaccaaatgaaagtggagtgaagaaatttaacaaattttgagggtgttgaaattatggacgtgatctaagctaaaccaggagagaggggaaaacagaaaggtgataatgcactggaaaaggatagaggttaaataaagatgatagaagaaaaagttcataaagcaagatcaaaggtgggaagactgtgattagcaagaaatgagatgcttgaattggtaagtttgaaagaagcatgatttgtggtgatgacaagattcagaataggaccatgaagagtgtctgacttggggtaatgaacaacaatggaagcaataaagttgtaaaatcaaaaggttagtttttgaatgggtgatctatgtggatatcagagcatacgagggtgacatcaagaactgcttaaaattcctacttaaagacagatgatggggcctttaaagataaatatttaagcatgtttctagtgattcttacaaatgaaagaaatggttcagaagtttaaatgtggttcctcatcacattaaatataacttttctttaagttaatattgacttcaaataactaaaatatttgagactacttaaaggagtttaagaaatctttattgctctaagaattttgttaatcatctgcctagcaaacctaatacagttaagcctcaaattaaaatttcaattatggagaatctgaaccaaagatatttaattttatgtttgtgtgtgtgtctacgaaaatatacttaatacacacacacacacatatatatgtatgaagtctttttgtattgaattttttgtctgtaaaaccccggcaagagagagactatacgtaattactgcccttcttagaagtgtggagacagatacatttacttcatgaatggctcatttgaaataactatgggaagaaactaaatctccaaagatcttataaaaaatactatacaaagcttatatgagattttatattaacaggaacagatgtggaaaattctagattaagatgtcagcattatatttaaatatactttaatttgatttttttatttaaaaagccataattattcttgctattagacactctcttgtaagttttactggaatgaataatttagattgattcaagcacacatttaaattccttacatggtttatttattagggaacattcacattattatatcttatatcaaacattggaacattatgtgtggctaattatatcagaaaaagtcaattttataaaacagctacatctcgtgttttgaaatcctccccatccccactctttaaaagcatgactggtttgaatacatttgttgctcatttttaaggatagggtaggggcagataagaaactaattattctctagaggaaaaaaatatgctaccctttccagagtataaagagactggggaattcttcattcactccctatatagaccattaacattaaaagttatataggatattctaagtgcagttgagattggactacatattctttaaatcacagccctattcttagatactaaataattccaaggaaaactgggctctggagatctacatttttgtataacacagtgcctggaaagctatatttcttgatgcataaaagaaaatagcagtttttacattaaaggctttgtgaaaaatattagagataacacatgtaaaatgcatagaacagtgcattgcctagcacattacaactaatcaatgtgattattatgtacatattacatataaaatagataatgtcattagcatgcaaaggatgaggaaaaaaatgaagcagaatatatgcacacaaggaggtaagagtaatcaggaacaaaacaaatagatattaggtatatcaagaccatgaagtgcaagatgggaagcagagagataaagctggtgagatacacagggagcagataatgtagggatttatggactacataaagccatttgaaattaatcctagggttgttagggagtgattgaggggttttaggcagctaaaaaataagatttagataggtctgtttagcttaagcgtgactaacggattataggaaggcaagactagaagcagaaagactattgtagtatgatggcttgagctggaaagaagaaaatcaacagatttgagagattttttttaaaaaatgcaattgactacatttggtaatagtacatggacgtgtgtagaggaagaattaggacaaggaagagcagaagcaaagaagaaacccaggtttcaggtttggtcacctgggtagaaatcactgccctaactcctattacattttctcaggttttcttctttatcctagagttctttccttatccagcttctgtttatacattcaattatttgagaaatgtattttaaatacttacaatatgccagcatctatatgttaaaaattcaaagattctcctctgttcagttctcttctgaattttacagaggatcacagaatctcagggcagggacaatttaaaaagcaggtagttcaaactctcagccaaaagttgaatcctcgatgcaataatcctactatgtacatatgcctgtcaggtcaatattagacataattatggtgaacaattccctttcaaagtggtcaattctttcttcctacctctgtgattgctaataattctcctacagtcagctcaatttatctgtactaacccctgacttctggcctaaggtcttatcacaaggccataaagaacacgtttggttgttcattctgttggcagcatctatatctttgttctgtatataccacatattcctatttctaccagtctttgaggacatggctttgtgtcatctcactagtatggtcatgttcctctgaacatatgctggttttaatccactttaagtaactttcccagaaatgaacacaatacccagctacaatctggtaaatgcatcgaattttgaccctgttactgctattacggatattgaaaaacattaaattatttgtcaggcattgctcatttgcctaccttgtagaaagttttttcttaggagctacaggtaaattatatatgttcccctatatagaggaaatcagtaagtatagtcctaaagctggctgcagtattataaaaattcctctataaaatttcatcttgtcagatttggatgcctctgtaaaaatcatccttaagtatattctttatctaaaaactgagctatgccttctagcttcacactttgacaaatctgatgttcttatttaaatcatgtgtgaaagtgctgggttatgccaccttctgtttcacttagtcatcatcaattcatttgtgaagcccctttggttatttgtctttagctgggagaatgtcttgtaaataagaacattagggtgcctttgagttttcggcacttttctcattctccacaaagatttaaaaagtgatcatgaaccctgaaatacttaaatgcaataattagttttcatgtccatctctctacaagctctttgaagaacagaactacctaattcaaatatcagtaatttaaaacatttcttgggacatactgagcaaaagaatgaaaaattatcattttcatgttctattaatattaatccaggatttacatcaattaagataaataagaatttatttagaaaatgacattatcttctattatatgtaactatcttgattttaatttttcatatactaatttttattttactctttccagatcaaaaatgtttctcctggcagaaattatggagccagcacagggcttctgttctactcactttgttaatatattaacattgaactgctggctcaaaacagcaactctattccttttgtgctgttttccttcctctaaatagatcaaatatatctaaatatatctaaaagagaacactttggttttccttagctttctttttactaacaaatttcagtgcattctgacccttatccttgggatattattattatttacgttcagggaattcttataattgtctttggttgaaggtaggtagggctatacatgatcacatggcaaagcaacagcagctctattttagtgaaaacagagaagacaggcttctggagttccaagtaggaaactgggacatatttttccagagaaattttgaaagcattggttttaggttctaaaatgttgtatattattatattcattgaattagttgccgaggaattttcctgcagtaattgtgtctgtactaaataaaccctcgactaaaataaacaaactgatccaagcacaaatatctgttccaaactaggccataaaaggatttcatctaaggacttcatttttggaatgggatgaaggagaatatatgtgtttgtgacaagactgggaaaatctctcatgatctcttattgtcaaagttttgggaatatcttggctctattgtttctgtaatctgtgagatatcctggctctgttgtttctgtaatctgtgagataatctaatatcatgcaagtgaatccttctttttgctttatctacccagagacagttcctactgcatgcctacaaaacaaatttttgtgggggaagcacagacttttactttctgtgtatatagaatactcagatgggaaaatgtactcagagcttctaacacatcttataaattaagttctggaatacagttcatttaaaagtttaatttggcatataggcacttaacgaatatgtattaaatgaaagaatattgtggagtttctgtgataccttcacatataaatattttccatatcatttattttgcttacagatatgtacactctgaacctgccaaatgccaaagattaaaagtgcagtctcaaaacacattaaagattacacactgaaggagaccctcaggattgtgatgggaataaattaagtaaatctatagagcttaacttttatgtctgtgatattctaacataaagatttattggtagtaattaagtgtgactgctttgctccaaggataaactgcttctcgagagaggatgctgctgatagctgagtcggggtgttaatttcattttaatgatattgaaaaatttgttcacatatgaaatctattttcctttagcagtgttaaccattcagaatacatagaaaagtctaacatataataatatattatctttattgtaactaaagattgaaaatgataaattagtatattaacattcgtatgatatctttcaacttaagttacaaaatagagaagatttcagcatggatatatgctttactaaaaaaattatataatgttacgaggcaagagaaaacattagcagataaagaattaagctaaatatttcatcatttatattgctggagataaataacaattcaatggatattctatcaattttaatatgttcactgcctattcaggatggtcttgagaattagagaggtgaattactgttgaaacagacatcctcatctttaatcccagaagtttctataagactaaggttcttggaatgaaaattgagtgtagaaatgtgagtcctctagagtaacagttgtcagatagtccagcataacaagtcttcagtttgaaagaataaggtagaaaaatgaaacaaaacatttgaatagacacctacttacggcatttctgaacaccaaagataaagcaaaaataaataaataaaacagagagagagagagagaggaaaaagaaatcctacatgttatatacaaaagaatggcaatcaattgatcattagccataactagaagcaagaagagccataacttcaaaggtctgaggacaaattatttttaaccaatagttatatgtttcaggcaattatcaactgatgttaggtgtgacacatattttcaggtctctaatgacttaaggaatttgccacttgccctatcatcacatttctagagatgctgacatgtgaaactgacaactaaatatattccaggggagaaaagtaagaaatttaatgagatatataataaaaatataattaacactgatgattcaaaacttgcttaagcaagaatgttgatgacattaaattttattaattcccttgtaagctcatagttcttgattctaaagtaacaaatttatcaaattataataccataaatgttatttttaatattatggggggcttatacctgtgcaacttgaaagtctgtgactaaccaaatctttctgtgtcaggtagatttaactatttggagcttccagttatgctttttttttccccactatttacctaagccatgctctaccagctttactggaaatatggctgacagtttgatttctaattgactattttgttagtcaacaaataaattctgaacttaggcaaagaagagagtttctatttattgtgccctaaaatactcaaatatagtctctaagtacaatttggtgagttgaaccttattcagaaacacaggaattttggggggcaggcccatgtaggttttaaatctgaagggaccatctatcattccatacagtgtaattgtagctcactgtaaccccgaattcataggctcaagcaatcctcctgtctcagccttaggagtagctaggctacatgcacatgccatcatgtctgtctaatgtatttttattttttgtaaaaacagggtctcactctgctgcccaggctgggtctcaaatgcctaggcttgagcagttctcccacctcagcctccccaagtgctcggattacaggcatgagtcaccattactggcctgtgtggttggctttaatcggctatcctgaacttcgaagcttttaggttaaaacataggctggaaagctaagaatgggaaatacgttcttaaatatgagggcgaaaggtataaaagaaaaagagtgaaattttcaggtctggttgttctaaacgtaatagtaaaagagaagatatttttgttaaataagaagaggtgcctggagttcaaagaaatccaacagagagtgatggataagatctcagagagtcatggcatccccagatgaagtccgcattgaataaactatgaagaattataatattaatactgaaactaaatattgagaataagtgactcaccccttaaatgtcaggagcctacagagaaactgctcaaattttaaaagggaaaaccaataaaattactgtgaagcattcaaagaattacaagctgagttttagtttgacacaattattataggttaactatactctacataaacctgctggagaaatttatggaattgatgctttaaagaaaagtacagcaaagatgaggcatagtaaaggcaaactaggcagagcaacaatagattgactttaggccgaggttacgtgttactctgatgaaacaacaacagcaactgtttaataattatcaggaaggtaaagatggacaagacaagattttcatgactagtgggtggtttagcagattcaatattgttgatttcctatttctcataataagacaatagagagaaatataagcaaaactaatgcctggatcagaaaacaaagaaaaagtaggattaaagtaggaaaacaaatcttgtaagttgttgtaacctatgtgtgttaaatttactggatggtaagtgtgcctcaaattaaacctttgtttaggactgccaagttacaaatttctgaactttgcaaaaatttggaatgtcttaaatgctgctctctgaaagtaactcccccatatggctttttaaaaaatgtaccataattaactcctctagagatttctcccaattaaatttaaagttacagactgtcaattctaaatagctgctatcctagcaaatttgaaaataagatattgtctagttctggctatcctcacaaagactaatgaatctctgctatgaattatgggatagtgagcatagctctgttaagtactaagtcttggaaacaccattttgccagtccaatggatagaatttagaaacaactgataggatagcacaggttgcaactgtgtacgtacgatctgtagtgctcaacattatgaaaaatgttgcttcatttattgtttttatttatttttaaataaaatttacttaaaattatttttcatcctgatagaagactagcaaacatgaaatcggaacccagaaaagagtgtaactcattaaagtgcactgaaagaggatacggtttctttaaaaagaaagaaaattggaattgtttaaatgaaattttaaacacttggaaaaatccaagaataggctgtcaacatttaataatattaataattaacaatgtaaaattcaatagaaataaaatttgaaaccatgtaatttaaaagtaaattgtctatctctaataaaactcattatatgaagacaacttactctctggtaatccagaaatcaagccacagtggcatgcaaattccgaataggtgttaacaattattcatataagtcctttgaacactgattgcatgtttatgctcacagggctattgctatgggataatcaataataagggaaatacttttgtgctttcattaattaactctgacttgccttgttaaatccatttgaacctaaataccattaatccatgggaaataatcgtactaagaaatgttagccatttttgccttatagaatgttcttaatattcttcttaatattaaaagcaagtattctacataacacatcttacagttacattttgccaatacatgttgcaaaataaaacccaaagtcaagcatggtaacatatttaagggaagaattagtatttttttctgactgtgagggtacttagtagttgagaaacgagtctataaaattattatcaaatcaacccaatagtgtataaggttaatgatagctaaactttaaatatgttattttaaatcactgtataattgaaatgtttaactttagtagctatttaaaaagatatttcagttggctccatcaacaactaatgaagtatgcaatgcactgcctcaatatcagacttatatgcaattgtgaaagctgttcagattgccattctttgtcaaatatttgtctgggagaaatgagaattaactttcaagggaaataaactgagtccattagtcaggctgggttttgatcatttatatatttttagactggaaatcaactgcgaacatttaaaaatcttaacaaaggaaagtattttttagaagaatgtttttctcaataaatagtcacgaaatagagtatatcattaattggtaggactaaacaaaacgaagacatttgaaaaagattatgataatatttaaatatatttttgagtgatcagtaactaaagaataaatatatattattgattatggctgagcatttgattgtatggtagaaataattatgttctcaaagtcatttttttctggacaatattcctactgaattgggatatatgtacataatttttagtaactagcaaactaataaacaattaggttagtgagttgttctgcaacttgtaagtatatacttccctattattagtaaacatttacaaagcaagtgagaaagcaaaatatgaagtcaattgattagcctgtatattataatcctaagagcctatctgttaccaaatgatgatgagagcagtgaatattctttcataggaaagaaggaaaatgtgaaaaccaaaaacacaatgtaaggaatatttgagaagaaggaaaagaaataatcaaccaatagattctggaataaagagaaattgatttacatttaaagaacatgtcctaaaggtgccattttgtcaatgaaaatgttactatgtatttttaaaatgttattttgggaactacttgctttccaacagctgctgcaactcaaaattggccaattttgcaagtcatttaaatgtcctatattatatatgaatgaaaagatacactatcaatttcctgacagatgcaaaacaatctgctctgagtctaaaataagtttatattcaatcagtcagagaaatgtttctcctttactccatttcaaagagtagatacttataattgccatgagagaaaacaaagctagatggtataatctcattttatcaaaccaatcaggttttaattttgaacatcaatagcattgcattacttgtaaggattttgaaacaaatctatggatggttacgttgaagaaactgcttatttcaactacaggccaaatatttttatactcttttaaacagtagctcattataaccaggaaacataagccctgagtgttttaggtagtatctggaaaatattggcttcaatatagttcttttgtttccaaccactctctttttaattccctataaataataataaggaattgataaaagttagaaaaagagggaaaaatccccaaacctactttttctttagtcttcgatccttctcagcttgagttccgagtttgcctaaccccagggactcctgagctgcagcttcagtctccataaagcctcctgtgaagagaagtaactaagtattcagattatgttgcataggttgtgtcaattctgaagtcaggttgttaaaggtttagttgagcaactgtttagtatcacatttaaaaattttccttatattactaacccaagatgcataaaatggcatgggtacatacataaacatacactgagaaaatgaaaacaaaacaaagcagtacctatggggatataatttgttgcacccagtggcaacataataaatgtggcctgttcactgacaagacacttaaatatactgtccccaagtcttaaagtctgtttttatacttttcttatggaaaataagagcaaatatctatgcagcgtgtgagatttgtttattttttcaacacgttaagtatttgcaatatttcacatataatgggataaatgatagccaattgggtaggaactcaagtatatgttttctattacaagttgagagaatggagaaacatttgctgacttctaagagctcttcatagactgctcctggaaatttgttctgctctactggctgactcctatgtccttcactataaatcttacttccagaactcgatgtgttctgggcaggttcttgtgttgttttttaaacttcataatattttttgaaaaaattctaaatttcttcaaaagagcttgataaaaatagttatcaccaagtaggtcataagttctcatttagtgtcaatatataatatgtataccttatataactttgtaataaaaggaagaagaaagaaaagtatgatgtacattaaacacatatcacaggatttctaaacttacaaaattaattcataaattatctgttgtaattgaaaaataaggacttactcctatgttctgaagtcgagctaaatgaaaatgctcactatttttaaatgagttaaggtatatactttttttaataaaagaaaattaaactccagttaaggtcaagattaggtagaaagatttaagctaatataaactctcacaaagactatgcaagaaatttcatcactatatcagtaaataactattgaagacaacttttgctcttctctcattgtagtggacacttccttacttaacatttgcaggactcgaccaagatatggtttctctttagcaaagtaaaatatcttaccaaggtgccaaaagcaaattttgatgttactgtttttaatactttattttaccaaataatttataatactggataatattaacttgggaacattgatataaataaattaatctcattcctgataacctttttactgaactatataattttttaaaagtctcctttaattaaaaacacatttattgctgtatagatctaattcagagatgtggagtttgagggccaaaatttgttttagttattattcacatgtttaatgaatacgggtacttaaatctttttttattatgaaagatttttcttcttggtatggattaggaaagccttctactggtgactaaagtactcttgggaaagaaacattttcaaatgggaaattttccattatgtacagtgagtgcatattttcattttatttctctcatctgtatatttgccttactgtatatcaataaattattattcatagtcttcaaataataataaaaatgttttcttgaaatgtaaatgaaaatgaatgagtcacttaaaagttataaaattcttgaatggtccatatagggacatagagattgatgaggcagacatattcaataaacaaggaaagattttcaaccaccaggtggctagatgaatcaggcttttattcttctgagcaatataagaacatttaaattatgatttaaatttattcatatacccaaaattttaatagaaaaaaatcacatttttaaataataaaacttgaaataaaagcaaagaaaaatctaggaatattttgtgagttaaatctagacattttattttctcataactataaaataaaaagcatgaagaacttagaaatactcggagtattgcaaaatctagtatcttttttcaaagcatttgatagataactggaactacatcctactcaaaaatgccaagtacaaatgggacgtaaggccattgtaagtaaagctatttttaagcaacacattcaggccagtgcgcttaaccaggagaaaagtcccagcaagtgcatattttcagcccaattaaaacacttctgagggaggacattttttcacagaattgacctagctgcttcactcatctaatgtttatctttccacatacttgataaactagctggtaagggtgaccttagccaaaccagcttactaattattttactctatggatgattatctaaatccagtgagagtctgtctcattcttgtctaggcatcagtgggctcatatggctatgtgaacttcagaaatatctatttatctataccaatattttattcactccctacatgtgactattaagctcttgaaatgtgcctaattcagatgatgtattgtaagtgtaaaatacacaccaggttttgaaaacgtggtagaaaaatacatgtaattcataaattttaagtgatcatgtgttaaaatgagattattgtttctatatcaggttaaataaaatataggattaaaattaatcccacctatctcttttaacttttcttaatgtagctaccagaaaatttaaaattacatatgtggttcacatttgtggcttatattgtatcaatgttggccagcactatataccagagtttctacctggatacagtacatccacagagggaatgtaaatgtttgtgtatgttgagggagggtgcatttttttgggtattataatgattggcacatattggacaggggacaaggattctaaacatccttcattaaatagagaaactgcagcttgtttcttttttctttttttctttctttcttttttttttttttttaaacagggtctcagtctctctcagactggagtgcagtggtgccatcagagctcactgcagcctcaaactcctgaactcaacccatcctcctcccaagtagctgggactatagatgtgtgccactatgcccggctagtttttctattttttgtagagatgaggtcttgctatgttgcttaggcaggtcttcaactgctggcctcaagggatcctttgactttggcctcccaaagcactgggattacagatgtgagccaccatgcctggcctagcttgtcattctcaaaatgatgagtgcctcagaggagaaacactggcctgtggaaactaggggttactcattcttcaggaggtctattaggaaactatgtggaaagaacacaatgaactccacccctttcatggcctgaagtgcttgggcttgaaggtttgagtcccatgattcagcagactacttacataataaattgtttatcaccttgtcagggtccgcctagtggttgggcatgagcaaggcagccttcttgccctcaaagttttcttggctatcactcaggcatctttacttttgtgaggccttcgaggacttggaattattgagggcaagaccactcctaaggtgtgacaggcacagtcaaggatttttttttgccagcccctcttcctgtgtaaacagttttgaaccaccaaaaaatcagtgggacaacgatctactgattcaatctcatacaataccattcttgccagtgggagcgagggatccaattgccagaccaccctcttgaaaacagggtcagaccactgtctcaggatgactccatagatgcgactcactaggctccctggggcatctggtcgagtgcatgcgtggcgtagagtgtcaaagaaaaccctgaaggggagaaacagggacccaggctcctgctgtttggctggatcgggcaacatgtccagatggcactacttcccttctggtcccagtgtctgaacggtaactgagaacatttcgatgcttccagtgattagaccccgggtccgggtctcagctgggggtgccttgcccagatggcactgccagccctgaactttcccagacatcagagggagtcttaaaatttttcaaggaagttgctacaaaatgtagggcttgcgaaggctcagggctcagggcacaggaaggaaactcacatgcctagatctgtggatggaactagttggaggtatctattcatttggattgtgaaggtgtggaagttgttagaatcaaaatggagtcactattgttaagaaaatcctggcaagtagagccagggaaggccatgaacagaggattctcatgctcctacgcacgatagcaacaacaacaacaacaaaagaccctacgaaagccacaaccttgcacgaaggccattgcaatcccatgccaaaaaatatttttataggtatatctgtctggcaattgcctgtccaacctctgactggtggcacgcttgttattaatttgagtagccaaagataattatttcaaaaaattatgtaatgttcttaattttttgcctttaaaaatctttgtcttcctttccttccctgagtatacacatagtttatagtttactatgacatacatattcttatcacaatgctctattcctaaataaacatcttttcttttagagagcatctctatttggtatttaggtcaacaaagacaaatatctccccatttcccagtccttaaatttcattcaaaatcacttatttcatattggcccttgagatacaagtctgtagaaattgcttgacaaacccatattgcaaggcctctgtccttccatttgtccagcagaggtctctgtcattgtgtgaaaaagagatctctaactactacaatctgctgatgattggtggcttcatctttctttcagtagaactgtcttcatcattaataaatagcacatggtttgtattaaaacacatttgaatttataaattgttacttaattgttcaacatctgttagtctgttagctatccggagactgtatctatacacagtgcctggctcataaagggtatgtaacaaatacagtcataattggagctaaatactactttatttaaagaaagaccctttcactatgcagagcatgagtcatttctaatggacactttgtggaatttacattgtaactattggttccttagcaccaaggaacaatctaagttttggcgtaaaggccgacacagacacccaaattttagaggtagaaaaatacagtcatgcgccacataaagacctttctgttaatgatgggctgcatttatgacagtgttcccataaaactataatagcatattttcactataccttttatgtttaggtacacaaatacttaaccattgtgttacgattgcctacagtgttcagtacagtcacatattgtggattttttatagcaacaggctatacctatagtctaggtgtgtaggtggctattccatacagcctgggtaggtagtaggttatattatttaggtttgtgcaacaaaatcccctaagggatgcaatttttagaatgtatccttatcattaaacaatgcacgactgtacttgtgaaatgatgctggtgtactgctgaagctgtgtttttgtcactgtgaaattatttttttattaagcctattatagtaggtcaatgagttcagacaattataatacaaactggcagataaccataaaagaattgccatttagaggcaaaaaaagctctttaaatgtgtatattgcttttcatacgcatttaaaggaaacttgctaaagtggccctaacctaataatatatgcatttttatacatgcaattgggaattctgcttattcatagttaacgtgcttttctgttttcattatttttttcatagctttgttgttttggctctatttgatcactcccttgtcttgaatatctctttgtcttagatttgtttcatcttttgctatgcctgtcagtagcctcttctttatcctaaccattcactattgacatcagctaagttggtcagatgtgttcttgtttcttcattgtaattattagtagagctctgtgaagactcaaaagagttggtgtttctcaggtggcaaacaaatcagtatgttaagatggtatggagcagttaatttccctagaaatagtaaatgtttaaatatttctgtctcttctccatacactatcatcatttttctaagctgacaaactgcctctggaaaacagagctcgtttgctctaatccttaactctcacttctgcttggatgcttgaccctggaactcagatcatcttatttctgtggttggctctgcttcaagatgctgcctcccaatctctgcagttccaatctgtctgtggctgggtaacttgatctttggtgctaatcacttcctttgcttcataagctggcatcacacttctgacccagccagtacccacttcctatttaaccacagaaaacgccatttccatgacattctctctggagcttgctgtttaacatagtttcaatacccttttctcaaagataggtcccgtttgaaactctacctttacaccttttcaaatacgtaggaagattgcacttagatgatcctagtagaatcaaacatatacagggagagaaagattaacccagaactctctccaaacattatgtctgtatcttgtattagaaaaattataatgtttctgtgtgattttttattgttgccttgagttattatttattcatttatatgggatatcctcaagatgttatatacttcttgaataatcgtatttttaatttctttatgtgcccacacttgttccacagggataggaactcaatgaagtattttttgattgaaataatcccaagagtttcctttccggatcatcagaccaggaagtaggagccaggattcactatcaactctcttactaagtagctgctctgtcttctgaaatcatctcagtttcgatatgtatagaatgtggacaactacatgatcctcacatatcttctagaatctttaggcatacagctctagaagtctgtaatcttaaaagcagaaatttattttcatagtaaatattttatggtgttttagttgtataaagaagagttgccagagaaaagacttaaatgttagagattcatagattcagtattcctagggttgaagtagatcttaaagatcatccagtccaatcagctttccaatgcttggatcccctccacaacagctcttcctagtatttgcctagcttttgctcggcaatttccaagtgacaaataactcactacctcataagccagcccattttgtatagaattctgacaccccactgttctttcttacatcgagatgaagaataattttgtacaactttaatactttggttctagtttcgtatccttacttacaatgaaaaggacaatagctcttatacagaacaactcttcaaatgttgtgatcagctacttggtagttcagcaaagggaataaacacaccattcacttatgttctccgaacgtgattccaatcctctacaggtgcctaattttctcctccaaccttcctccaggttgatgatgtgcctttaaaagtacagtaaccaggatggattccattgcttggctgttcttttatcatagcagagtagagtagaaaaaactttcatatcaactcttatgtctgttaatgtggcctaaacttattaatcaatattgactttagagtcacatgaattttttattttttttctttaaaaacttgcttccaagaactatacttttagagtaggagaatttagatcccacttacatccattctttctatttttggtgggggggatagcatttaggggtaatactaatcttttcacttaggattcctccccttattagtaatccatcaatcagatacctgagctgtggaaacattcatatccaagtgattttggatgtgctgatcaagaacagagtgagtcctaatcatgccacgagaaactttgatcccaggtgacgttactccactcatcagtgggcaaggattatttaaccagttataaatcccacctaactgttccagcactcaggccccattttgacatcttgtccccagggatgtcatgagtgatggcttgctcaccacctttcattatctgttactaagtaaagttgccaaacaaacaaaggacattagtctgacatggctatttttaacataggttaatttactttgtttcaaaatagattaatgccttcagataaaattaaaagtcaagctagtcaggactgcaattatttatgcatgatcacagatcttagggttcatagccactgttcctagttctgacaggacagacaatgtagcagataaaacttttctgggccaaaaatatagtgaagttttagttttaagtataaagtttgtatttgtttacgtactatctttgctaaagtgaaaactcctcgatgccgatagccatgtcttagtcattttcctaaagtccataattggtactctgcatttaagagtggttcaatatatgtctattcactgaaagtaggaataaataaattattttggattatctatgtcttctctccctccaccaaaaaaaaaaaaaaataaatctcctcaactctgggtcataaatgccctcttggtaatgcctatattctggttgaactctttctcttcaagtaaacagatagaaacaaaaatgagtttttgaatggttccacttatttgcatattctattcacatcagataaatcttcatttcattcattttctctaaatttatacattactaaacaaaagtaacaatatagattctataattctcactttggtcttggtgatttttccaattgtctgtctgttttgatggatggcattcctgccactgcttttacatgtcgatgccacttgcttctatctattatttgtcatattctcactttccaatttttgtaacaaatcatttcatgtctgttttaggcagaaaactcccatttcagatacattgcttcttccttaatccacatcatcataaatataattgtgtgttaccatcctctggaattgctttgacagtacacagcctttggtgtcctaactacctttccatgttagttaagactgcacctatttctagcgtttcagtagcagtgtgtttggaattgatgctgtggtaggtcgtaaagtgattgacagatgaggaaagaaaaaagtagtgaacaactcagtcttgtacattaaatgcagggtaaagataagtcaatatttggagataatggcaagatcaagtgatagcttttaaaagtgtgaattagacatgagcatatttgagcaataatgaaaatatcagagatgcattgcatatggatgcataaattgaggggtggggagagatcatggtcattgtgctgtcaagtcttaacaggatgctattacatcctgaatctatgttccaggaagtcagcagaagtacatatcggtcctgttgtcatggggatacaaaccaaacctgtttatttaatttttcatcctgggatttgtgacattgaaagacaataaatggccaggcacagtggctcatgcttgtaatcccagcactttgggatgccaaggcgggcagatcacctgaggtcaggagttaagagaccagcctggccaacatggtgaaaccccatctctactgtaaatacaaaaattagccaggcatggtggtgggtgcctgtaatcccagctactagggaggttgaggcaggagaatcatttgaactgggaggcggaggttgcagtgagccgagattgtgccactgcactccagcctgggtgacagagtgaaattctgtctaaaaacaacaacaacaacaacaacaacaacaacaacaaaaagacaatgaacaaaaatacaaagaaatagaaatgactctaaaaccagatccccgagtaagctagaaggaatgcttcctctgttaggtgggtttccctaaattcaattgtggccttcaggtaaacttggcttaaattatgctttatttttcctgaatagtacttacaaatggaatttgaattctttacatggaagaacaaaccctcactgattcatttgagtctacatcactcctatttattttctgcccatacactgatacacatttcagttgggaaatcttgctcctacattataggtaataataatctaaataagaactgtaaaccctagtaagaacagaataattttttcaaaagatatataaaaacttgaaatctcctattagtaccacagctttttctatcctacttttgtaatttgagtgaactaaccatttgaaaaggatgtcataagaaaattttaaaataaaataattttggttggtttctgttaggtttattcaattgcttttcaatacagtgcttcctttgagttttggggtttccatactgatattgtctatgctagtaatacattagtaagaacagacatattgttgcacatattgagtttgattcttcatgggtaggagttatccatacaatcacatcgactgatccttcctatctgaagtttatgttattaccctagcatttcgaagtattatataaagcaaacaagatatcctttccaaatatttccctttgtgaattactacaaacatctcctttgctgttcatcatttctgatagaaccaaggaaacattttcatagtttcatttatacagctttccctttccacaccatatttctttatagacatgtagtatagctgctttcaacttaagtcatgtgtctctgctcttttgagttaaaccttttaagagttataaatcttagcacatggttcagaatttcaaatttggtactttgacatcactatctctttcccgtagttctttccctggcatactattctattttctagttctatttttactggtagaagaaagaacactggcaatgctcctgggttttagaattttccagatcaagacattaaaatcataatcactcgagatttttccctaggttcctcagatgcatgaataagcagtactaggttgtagtccctgggttggaaaaatgtgcatggtctttccatgacaacttggataccccttctaggaccaaagcagacctaaaactggtagcccttaactaaagtatcagtggggcccatgtatcatttcctttggtgcaaatatggttttctggaacctgtttagacctatgttttatttttatttcttcaagtctcattttcagtaaagactttgttctttttcctggaagctttgattcaccatttatgtagcttctacctagtttcataggtatagcattttgctcctgtcttcctcatccatattgcagtccttaacaagctgctgattctggctttgtttacactctacctctgctgttctatgaaataaagcaatattactcagagctcagaaactttcccaggtataaactgtgacctgaattaacttttgctagtttctgactttggtggggttgatgagaatataatagtaattgagttaattcttatctgctctgacctaaaacacacagtcagtgaaaatgagtaataaaggctaagtttctcaaaggttctatacttttctagactttaacttatatcttgcataccttgattttgacagaatattgttggcaaaatttctaatgatttaggaatttctcatcaaagttaaatatgaaataaaaatataaaattttaagtgataagggcaattaaatatattttaaaagtaaagtgtcaattatggcaactaagatgaatatatatgttgaaatataaataaatatgactatgatgttagcaaaattaatactcaaaaataaccactcacactatagtgactgacactgtaatatattggatatgacagatcatttggtcaaccactagttgtcaaataagataaaacaaattttaaaataatgtctggcatgtatattttaaacacaaaataatctgtgtctctcttttttcctcatgcaataatattatgtatagcctaaagagttcctctactgagaaagaggaatacaaaaagatttaattcctttgctggagaacatataatcacacactggccacacatcagtttcctgtagcttccgatgctttctgtgggtttcacactatggaagccaggaaaggcatttttggatactgtagtcataaatctgcaaacatgaatatcgcaatcagaaattcttttgatggtagggcagaaaactaagtcctggagttgggtattccttgcaaataattattactctatttgagaaaccaaaggatgtactaagaaatttggatcattccattcagcacttaccactgtaggtaggagtttaattctttcccaataatataactctaaaaattaatatatagaaagacaaccccccataagtgaaggatatatataatcatttcagaaatatcacagattcttctgacaattatgtaagtatgtatcatgtatgtatatatctgcttatttctaaatacatatttaagtagtaccatttcaaatgtactgatctacatttttattctattagtcactgacaataactaattataacacaatatctattgccctattcttttccccacatccattcctcaactatacaccatagagtttattagggggaagctatgatagttttaagcaaaaaaaaatcatgttctttacattttatgtaacatattataaagctttattctaactttttaaaaattctttttaattttttgtaggcttatcaattctttcaacaaaaaaacctttaaatctacatagctaagcttttatacacattcatgctttaagtggcagtatactcaatggttttaagctgattttgaaacattggcaccacgatgaatatcacagttatgcgatttatgaagacattatttactcattaataaaataaggtttataccactagcatttactttgtaggcaactgtgcctgtcacaagagttagcattaaataaattctagctattgttataaagagagaaataaaatgactgaaaagttcacaataccctttcactaagttgtattaagcattattcagctaaattgaacatttaaagctaatcaaaatataaattttgtcaggtagaaaagagaagaaatgaaaagaagagcaatgaaatgaaatgaaagatagatggatactgtgacatgactaaaatgagtggcagtggaaagtcttaacacatgcatacttacggagctgcccaagtcgagctttttcttttttaccaaacaaacgtcctattgaagacttgattcctttcttcttgggggctttgtgaagagagtcttggctgctgttggcactaccaagcccgaggctttctggctcaagagagacagataaactactgcaaaacacaaaagaggaaaatacatgcaacatccacaaggtacacaaaagtcatttcctttataaaatgcaccaaaggaggaacaagcagacttgtaatgttgttttttcccctattttcccatgtttccttttaagatattaaatgcagttttttttttcagcctttgggccctgaaactccaaatttccataagataaattcatttttgctccgaatgtctttttttctttacttttttggtataatctcaaactaatcagtgaatataggctgagttattaactgcatgataaatggccttctattatggagcacttgatccattgtctatttatttctcagagtctgtttttctaatcttaaacataatgacctacagcaaggaactgaaatataactattgtgaaattgaagctgctcttctaatctacagttttacttgattttcctctagccatcgttccctttctcagttttggagccaaattcagttaatttaaaatcatctgggtgcaatttggaagcaacaaaccatgtatcctcgtgatcaatgtatgtgttttcctaattagagtactcaaatattattttaaatacatgttaaactgaaatgcttttcaagcagttggttaagtttcaatttatggtcaatatatttgacaccgtattaataggatgggatcaatagacattgttattagtttctatagttgttaattttataacaccatgataaattacttacttttacttactcatgtgaattaatttgaactcacattccctaaccttcaagcaatagctttttatatgttgaaatatactcttttttggagagtgaaagaagtaatattttgaagctgaagtaactgatttttccacattaacaacaaaaaatagttggaaaaaagaaatgactgccaacacagaaagccctacttttaaaagcatttattgtaaaacataatatctagaagatagatatttttattgaagcattcatccttaagtcattatatttggttatattaattatgtgtctacagatgctgcaattgatgagacaataagagaagatatatttcagatataaactacatgcttaggtatattcatatcatcagtgattatagagatctgtttgcagtgctttatgcatatggataagacagtataaagaattgtgatgacaaatgacatatttctccatctagacttatctttttatttaatattttagccaaggatttttttattttctaataactttctgactgaggagttattactgctggcagcagcagtacccacaggatgcacatacctgtctgctaaaaggcacaatcatatacttttcagactttaattacgcttatactgcaatccaaatttatgatcttgtcctacagtctccttagttttttgttaatatttctagtaagtccttcctctagcctgatctcattgtaatagaaaatatccactaaaaaatagaagagttattcttatctatattgaccaataataagaccacaaagatacagttaactttaaaaatacaaatttgatatcaaaattgaaatttggttatttcacaagtgatactgggaaagggaagctggagaattctggctcaaataatgtaaattgttaagcagtctattcgacaacaacgaaggaagaggaatatttttggaaggagggcattcagtgtgcagtgtgcctgcagagtcttaccttcgagcatcattgtggtaggaagaagggagagtgtgagtcattctgagggctctaggggtaggaggaggagaagtttcacatttaattgttgctttgtcctctcgaccatcttcttccacaactgcaatctagaagcaaaaacaatacattcaaataaaccctttctaaatttcagttgaaattgacacaaatggagaatcatgagaacaaggctgtcgagtaattttaatacaaaataaaacaacaaaacttggggcatttaagtcttacatacataaattcccattaaagagtttgattttcacaaatatttaaattggacacattaaaattaaaaaaaaatcatagacccactacacaaaaatgtttgattaataaacaccatagatcaagcttttccaacccacagcctgctggaaacatatagcccaagacggctttgaatgcagcccaacacgaattcgtaaactgtcttaaaacgatttatgcacggaccttttttttaaagttcattagctatcattagtgttagagtagtttatgtgtggcccaagacaattcttcttctaatgtagcccagggaagccaaaagattagacactgctgccataaatcaactagttgctgactattgatctatagtgtttattgacattgatctatgatattttataacatcagaatataaactctttacaaaaaggtattaaacacacatttgaacaattcactaacatatagcattatacatactcaggctatcataataaagacatcttttaagtagggatttttgaaatgagaagttgataaaatataactttatcagataaagtgttttaaatcagtcagcctaatgaaatttattacagggtatttaaaatatgagttgtggtttgtaagaaaaaaatctctttttaaagagaataataaaaggtaagatagtaatgttttcaaattgttccattttactaccatgatgggaaaactggcaaagacatacagaaaaccaaaagaagatgagatgggagggatttccttaaagaacactttagtacagaatccagaatgactcaggatactatccattttgtcagagatgaagatatagagctgtaacttaaaattttttccaatgtcaagttaattgtagagacatagtttttacaacaatgctgcatatttttcatggcatcgttgtgtatcacaatatggagagatcaggattgtagaaaacacagctaaagacttatggctttagagttctgatgaaaaaagttcttagtatggctaaacaaaaatttttaaagttctagggaaatattttgtttgtttttatgtaaagctgttatttataaatgtgtttatctataataaagaccttgtaactttgaggaacttcatgaaattgtcaggacttttgtcacccaatcttaggttccttttaacagcttaggtaggtaggcatttttatataattcctttgctctattcaactagcatattgccatcaggagaatcttttttcaataactgctttcggattgattctgatgctgtggaaaacctttttaaacccacaacccagctaaactcttaagcgtgtttctgaactattcctaatacatgttagtgttttcacagttctgtgatcccaccatgactcttctctgattgtttctgctaagcatggccatttttgctgtcagaattttgcttctgaaacatcttataaaataccctctttgtcctccctgccagccaaactatacttattcccaataacagcttctaaaaacagcatggcacatgtatacatatgtaactaaccggcacattgtgcacatgtaccctaaaacttaaagtataataataataataataataataataataataaatcatgtacaaaactttcctctgaatatcacttagagttttggaattagagagggatttgaattctgatttttcttaaatgttgaataaataggctgattacttacctgctctaatattacatttcctcatcaataaaatggaagtgatacaacacttttcttaatgtagtcttttgaagtgtaaataccatcatttatttaactcgttccccgatacacaagatttttttggttgtggtccctctttccatgacttttctcacaaattatgttgttacttcctgaattatttgagactacattttcgtatagaaccttccatcctacctttctatttcttacagccattaaacttatatagtctttttaaggtgatggaggtcaaagaaaataaggacattatacttggtaaatttggtaaataagaatgaactggtagtgttaaggagaagaggctataggtagatagataatagcccaggaaaataaaatggtaattccatctattcaagccatgtaagaataatatagattcctttattttttttaaaaaaaggacataaaagttatctggttccaggagtgttccaatgtttgggtgtaagctgactaccacatctcgaagatgctgaggaatagatttttgcactgaatagaagtttgaatctttgaaatctttttcatctgatgtcccatgagtgaaagctctactcaattatctaataagatgtcattttgtgaatcagaacttcagttcattttgttttccatattccatatttattctcttgatttcattccaaacagaaaagcggtgtttcgaacatatttttttattttgcatagtcttgatgctctggcatctggagaggatgctcctctaaccctagggatagttaattcctggaaatagcacatcactcacctataagtacacctttcacatgcaaaccaaacaactcacagcccatactctaaatcatcttctccatctggctcttactctccaagaggcaatattcctctgccctaatcacctgtgggccaggctgagacaactagagagagtccctacatcctgaggccagacaaaattaatcaggctatccatcctaacctgcttatcctgccttgtcttgcctttccctaagatacctcagaaaaccttctgccctgctccttctgcctcctgactgacgctggtgctgtcctgaggcacagagtactctctcctcttgggaactgtgagtaacaagctatctttttttgacagctttctcccaatctgttgtcctcaccctatcaaaataataataataaaatatttgaaaacaacgagcattatttattatatattaaatattaaaacatttgtactatattatattaataaatataaatacttatattaaaatataaaattacaccatccttggtttaaatattcaatggaaaacaggatattatggttcttataatctaattattgctccagaaatcataaacaattttatctttgaagtattttctattataatcaaatttaaacaattcaatacactttaaatactctcaactttttaatgttttatcaacattcgactagagggaatattattttaaagctttcatagaataaaacagtattcaattcgtaatgatgtaaaagttatttactgtacctttctccgatgtttcctcagatcacttggctgtgattggcagtaataaaaacataaaacacaattaattaagaattaacaatcatttgaccaagttacaattttaaatagtgtctacaacttgactatcatttttttcttcattttgttattttctaaataaacatattttaattactataaaagcactccgcctggtagttaaatttagagagggaacttctcaggtaacataagtcagatgattgtttccataatggggccatgtgtacaggcactggatacgaggcatggaccctgggaaagagaaactgtggaatgagtgagtgagtctagctagaagagtgagctagctagaaataaacgagactgcatcttttcaagaaaatattattgggagtgaagatccaatgcatatacaaggagtttataaattcttgtttttgccccatctatgcagagctttgggcctcctttgggcagatgtgctgttcctgtgggatctcaaaatttttggcatcctaaaatctttctctttcccacaaatgccaaaagcattttcttcaggttaaaaaaaattacccatattttattaaaaatatacaattgatgacagaattatattaggtgttaaggacttcctggatttcatttcttgcttctctgacttagatattaaacactttaaatatttctttactcttctaaaaatgccttttttttcagtactctaattataatgtaataatattcatattccactgatttatttattactaattgttcaagagaattcatgaaagcactggcatctttctctctctctctgtctctcacacacacacacaatcacatctaaaggattataaatattttattgctatgaaagtaatagcactatcaagagttatgatgcttatgtttataaaaagacttaaaagtgtaaaactgtgttgtaaaaatgtcagaaataaaagcaatacaaaaataatcaaagtattcctgccttgaatgctgactaaattttattctgtggtccaggattcttactataggtttggtactaagttgctcattaatactatgtagcatatcttatataggcagaaactaagcaagagacaataacacttttaactaacaaaatcagatgaatggttcctaaatttctaaaataagcagatcacaatgtagttccgtatgtttggttagtatatctcagcacattggctaaaagtttgtactgtatccaagtggaatcagttctgattagctgggcattttttctggttggccattgtctattctatttaaaaaacatttttagtaggaagttttggaaatgagcagaaaatagtggactcagcagcttaaagaggtaactgtcttctttttaaaaaaaattcacaatttttcttttacataagttttatggcttggaagcctcaaaattgtaagtatgccaatgcatattcactacaaaaacataattttacctccataaacagttcagaatgttttaatcttcatcattggtgtcatttcaacatactatatttctaggtaatgactgaaacagaaagacatggtagtacatgcttttaaattaggcaaatttgtggaaaaatccagctccatttattagctgtgttgaatatgggcactccatttatactctcaaaacctccactctctgttgagataatgccctactacctccagttttgccacgagaattaaatgactaacatcatggtattcagcagtcatcacaatcatattttccagaggttttattatatataaatatatataatgaaatatattttataatgaaatacatatattacatattaatatatttttataataaaattttttagaatggggaaatttgactttttctcagttgcattcaggagacttcctaatttaggcttccatcttctaatcccaaatataaagataaatgaaataaggaattaatgtatacatgtgaaaatgtgaatataaaatctaaaacaaaattaggaattagtagctgttgttttttatggctcttaacacaaataatgcaagaaatttatgttatatattgaaaagttataaaactctatcttggtgtattgaagcaattataatactaagttttgttacttattatgttaaaaacacacacacacagagtccaaagtgatttcctccgtatgccatcaataaaaatgtacttaatggtttaagtcattcaatttttaaaaaaaaattattttattttatttttttcaagaaggaatctcactctgttgcccaggctggagtgcagtgttgccatgatagctcactgcagtctcaaattcctaggctcaaggaatcctgctgcctcagtatcctaagtagcagtgactacaggtacagaccaccaccacacccagctaatttttttctttttctctttttcttttctttttttttgagatgcggtcttgctatgtttcttaggctagtcttgaaatccttgcctctaggtaatcctcctgcctcagcctccaaaagcgctaggattatagctgtgagccactatgcccagaaattcattgacatttataatgtgctatttagatctctgctctaccattgacttactatttgacccttagaaagttacagcacctgtgtgggttaccatttcttcatctcataatgggattcataaatgtactgatcacatagggatgttgtgaataagaaaataaataaacaataaaatacacagaaagtacttagactagaacaaacacccagttaagttttagctaaagcatcattaatcttaacaggaggcaaaggttctctggacacatcaccataccagtgtcatgactcccatccgatccatttccctggcagggcttcgaggggtgagctttggagttgagtgtccactggggggagatgaactggccagcgatgaagctgtaacagaggcagtaatggaggtacctgggtggacccttgccaaattcaggccttcgaggctcacactagccactctattttcaatttcttcagcacgcaactctgtagattctttttcttcctgaattagcctgaaagatacagtttaattatgatccatatataatttaatatggatccattatatgctgctgtaaggatcattggaattcacataataaatcagtagaaactattcttgaacattttacatcaaatctaattttttcatcttttttttttctctaaatagtgtaacttgcagtaaattccagggacttcctggctgcagtttagaaaattgttttcaaatgatacattttttcctgacaacttccagttttaccttctttgtatactaccacctgctaaaactatttaaaaatcttgaacctaattaatttctaccattaatcctaatcttacatttgacctcaggaaccactaaaagagactttagaaactcagccttgagatggcaaaggactagcaatagcttagaaaaagtgaaagattataattacatgtaaatatccctcttaagattcaaagtcattgaatcttacctcctacctaatgaaaaagtttaaatgatagtatcctcagtaaatggtcattcataattagccaaataaaaccctgagtcttttcttaatattaatacttagccaagcctcctttaaataagtaccagaaaaggtaataatgtgaaaatatagttatatagatagatgatgaatacataaataatgaaaaagtaacttgcaaataaaactaggccaggagtggtggctcacgcctgtaatcccagcactttgggaggccgagatgggtggatcatgaggtcaggagttcgagaccagcctggccaatatggtgaaaccccgtctctactaaaaatacaaaaatcagccaggcatggtggtgcatgcctgtaatcccagctactcgggaggctgaagcaggagaatcgcttgaacccgggaggcagagtttgcagtgagccgagatagcgccactgcactccagcctgggtggcagagtgagaaaaaaaattatataaattatttattacaaaggcacaaataggaaagagctttagctaggttgtgtaaaaatcctatttgaatcctgaattaaatctatacacattttgtatgttgttataatgaaactgtgtaccagtatagtttgataagggggtcgtaaaattctcctgagctattttgttcttgattacaaatggtttattgggatcccctcttatatagaacctgtaccttcaagtttatgatcacttcaaagttttctttttacatatttagaatggagaatgtaatttatttgctaaatttattcgctaaatttattcaataggaaatacttctctggtgtacgtttactatgggaagttgagctacatttactcacctgtttttatatgttcaccagctctttgattattaactcactgctggtgtcttcactaactattctgcaaatctttcagtttttaagtagtatgtgtttgctggccaggcagaaagtactttggtagtctacttacatgtcattggaataagtgatctttgtgattttaataggctgtttaaaaatcttacaaagtatggacttaaaatctaatcaaatatgtttcacaaaggttcattttggttaaaacattatgaggcacatttacacttaattataatctttcacttagaaaaagaacatgaattctgttactctcaaagtttattttcatgaatgcattttttaacttcaccccaaggtcagaactccaaagaaaggtttaatcaagtaacatagtacatagtaacatagcttaacacacatttgaaagaaaaaactatcttcaccctcaaaaaataaaaatgtaaaaaaaagaagacattttgtacttttaaaatacttagtagaaaaatgactcctagaaatttttttctggtgagatgtaacatggttatgctgtacacagaaattttggttattaactttaggtattctataaattgtacaagacagccaaacctagaggaacaagttgggtaagagagtatattgaagtttaatttaacagacaatagtagctaactataaaagcacagatgaatgaacattgctgtggcaaatgagtttgaagtaatttgaatcagcgagctgtgaagacagaaaacatgcattttttaatggctagattagtttatgaaagaagaaaaatcttaatcacagaaaaattctggttgttattagcagttcacctggtttgaatcaagatgactatttcttttaaatgtgatataatctcatttcatgtatttttaaaatcttacaaataaacaactatattaacctactggccaagattgttactagaaattactaccctaatgttacaaagctaagagtcactgaagagaaatagcttgttatggagggtgtgttgatctctttggtgcaaataaatatcacaagaatatagacttgatttcaaacttaatttggtaaattcgaccattagctgaacagcctcagaaagtgttattccgttattccgttaatacttgttttacattatttttctatttagagtaatcaaatatttatgaagcactctctaaatatcaagcgaagtgctaagacctgcaaataaaggtgagcaaagccagatacatttcttgctcctgtataaaagttacaatctagtgaaggtaaagaactgaaggacagtactacgttccttgaagaagtgatggaggagctgtccatggtgagtaagggtaacatgagtgaaatgttagggtagaagggtgtggaatgacaggaatgttccagaagaaagggatgacacaacaaaagaaagagcatggaacatcaaggaactagaaagtaggcaaggtaaatggttagagaatggtgagacaggtgaggtattgtagaccatattaaaaagtgtggttggtatcctaagaacaattgaatggttagaaaaagggggattacataaacacatttgtgtgtttaaaagtcttctctggctgtagttaggttggtatatggagaactagcatactacaaagaaaccagatagtaatggttattgtcataaggtaaaaaactattctaaagtgcagtagggtgatgataggtaatttgaataatagtagaaggaagccaactgatttagctagacccagaaagaaaaaagaaaggcattgttcaaaagacttaaaacctgttcacccattgaaaaaacaagttaagaatggtttgttgatattcagaagaacacaaatctacctgacacaattgggttcatcactggggttagtcaaggaaatgacagaaaaagctgatgtcattggaattcaagaaaccatatattaaattaaaataaaagtatcagagtgccaacatttctcaatatttgaaatgttaatttgtccaatttcaattgtaatgaaaaccatctattattagggtactatatagcaacagtacatttttttcataactagtatgaaatagttcatatcaccatatgttttattgcctttgaaatgaaaatataataaagatatttgttaggctataatattaaattatgtctcacagatatagtaagccttttatatttaaagaatgcaaatgaatttggtccccatttacttagaaaatgttcgcacatatgtccccaaaatgctaggggatttttaatgatcagcctgatttgttataaacttcagcattaatatgtgaaaaatgtattttcactgatgtaagaatattaatcataaaaaactctataagaattgtgtctcagtttaagatatggtagcagcccaacttcaaacgcaagttttaggcaccagtgaacacaattaaacagccacaagcactaagattaacaatctgaggctgggtgtggtagctcacacttgtaatttcagtattttgggaggccaaggcaggaggatcattagagcccaggagttcaagaccaccctgggcaagggagactatgtctctacaaaaaattaaaaaaaaaaaaaaaaaaaagacaggcatggtggcacatgcctatagtcccagctacttggaaggctgaggtgggagaattgcttgagactgggaggttgtgggctgcagtgagccagatctgagttatggcacactagcctgggtagcagtgtgagaccctatttaaataaaaaaaaatctgaattttcatgcaatatgttaatacagaaatgtaatttttattattaagaatagtagtaatatgtttggtttatcccatttaaaggcattaacttttattttttctcaagtgttccaggcagagaagaggactctatcctgctttctgcatttgctttgctatgaactgaattttatctcccaccttcaattcataggccgaagctgtaaaggccaaagtgactgtatttgaaaataggatctggaggaggtaattgaggttacatgaggtcttccataaatctttctttagtaaaggctctcagatcccttaaaagtatttaaaaattggagtgaaattaatttgctcttctgacaagttcaagatcaaggttccagcaggattctgtttttggtaaaggctctctgttcctggctccaggaaaagggaaaggtgggtgggcagtggggggcagacagagagagagagagagagagaggcttaattctatagaattaatatattaatgttctatctctctctctccccccactgtctttctgcctcccactgcctgcctcactttccctttccctggagccaggaagagagcctttaccaaaaactgaaccctgctgataccttcatcttggaccttccagcctctaaaactgttaatgttaataaacttccaagaaacacgctgtccctgatataaatggcataaaattgacaaaaagaatggtaaattaatttcactccaatgttgaaatattttaaggaatctgaatgcacattaatttgcatactatttggtacctttattgcagtatgtaatgtatctgaagaatgtacgtgattaccacacacactttccctttaagtagtaaattttaatttaaaaagtgctttaaaattcactggagaaagttttgcctttaacttattcttctgtactgtcactgatgtcattaatcttatatgtttcatgtatgttccttacaaaggctgtcctaatattataaaggagatatacaatatcctgggaatcttctgaaaatacacattctgattcagtgtgtacggggtgaggtctgagattctgcagatctattaagctcccagttaatgctaatgcttctgatctagtaattacatttttagtacagtatcaaggtcttctaatttcttgaaatcatcagtactaattgaagttacctgatttctttgttgatggcatccaattgttcctgaagcatcatggctagcgtctgggcatcggaatgaccacttggagagagaagatccattgagctaaaaattgtttctctgtcatcatcatcaatatcagacatttcagtgtcactttcaaaagggtggctgcttagtactccaatctgttgagttctattccactcgtgatccccaagagatttcacctgaatggtgaatgaaaaaatgcagaatatttatcatattgctcattttcaaagcattaatctcaaagacagcaacaacaacaggcatgcttttacaactgaccttgcaaaaactgaaccaattattaacattttaatttatttgcttccataaaatagttccttgacatcttaagtaatgtgagggattgtcagtataaatatcaagattttagtagaaataaagatgataaacttctatatgttttatagttcaatcatattccaaggtaacaattactttaaagcatgtatttgtaatacttttccttatttccaaatataacaatctatttatttgtactcaagcactcacgacttaaactaattagtcttcctatattttcttattataagctcagaccacaaatattatcacataagaaattacacaggaattctcttcccaacatttatttacatcgattctaacaaaatattatttaaaatattgcaaaatgatgtacaggtatactccacagagatttcagggttagttccagcccaccctgataaagtgaatatgacattagagtcacacaaatttattggtttcccaatgaatatgaaagttatgcccattctctactgaagtctattaagtgtataattgcactgtgtctaaaaaatgaacataccttcattaaaaatactttatagctaaaaaatgctaatgatcatctgagccttcagtgagttttaatctttttgctggtggaaggtcttgccttgatgctgatggctgctgactgataagggtaatggttactgaaggttgggtggctgtgacaatttttaaacataagacaacaatgaaatttgccacattgattgactctttctttcatgaaagatttctctgtagcatggaatgcagtttgatagcatttaacccagagtagaacttctttcaaaatcggaatcaatcctctcacaccctgaaactgtcttatcaactgtgtaatctaatattttatatcctttgttgtcattttaacaatgttcaccaagagtagttaccatcttcactgggagtagattccatctcaagaaaccactttctgttcattcataaaaagtaaatcctcatctgttcaagttttatcatgagattgcagcaatttggtttcgttttcaggctctacttctaattctagttctcttgttattttcaccacatttgcagttatttcctccacagaagtattgagcccttcaaagtcatccatgagggttaaaatcaatgtcttcttaactcttattaaggttgattttttttttttgagagggagtcttgctctgttgcccaggctggagggcagcggcttgatctcggctcactgcaacctctgccacccgagctcaagctattctcatgcctcagccttcagagtagctaggaatgcagaggtgcacaaccacacccagctaatttttgtacttttagtagagatgagatttcaccatgttggccaggctggtctcgagctcctgacttcaggtgatcacctgcctcagcctctcaaagtgctgggattacaggtgtgagccattgaacctgatcaaggttgatgttttgaccttctcccatgagtcataaatgttcttaatggcgcctagaatgatgaatcgtttccagaatgttttcaattggctttgccccaatccatcagaggagtcactacctatggcagttatagccctgtgaaatgtatttcttaagttataatacttgaaagccaaaattactgctttatccacgggctacagaatgaatgttgtgttagcaggcacgaaaaaaacaatctctttgagcatctctgtcagagctcttgggtggccaggtgcattgttaataagtagtaatattttgaaaggagtatttttttctgagcagtaagtctcaaatctgtgtttaaaatattcagtaaaccatgctgtaaacaaatgtgctgtcatctaggctttgttgttgcattcatagagcacaggtagagtagatttagcagaattcttgaagaccctaggattttcagcatagtgaatgagcattggcttcagcttacagtcactagctgcattcattcacccctgtcctctgagtctttgaagccagtcatttacttttcttctctatatatgaaagtcctagctggcatcttcttccaatggaaggtggtttcatctacattgaaaacccatcgtttagtgtagtcatcctcatgaattatcgtagctagatcttctgaataacttttaacagcttctccatcagcccttgttgcttcaccttgcacttttatgttgtgaagatggcttccttccttaaactttatgaactgaacaaccctctgctagcttcaaagttttcttctgcagcttcctcacctctctcagtcttcatataaatgaggagagttatggtcttgctctgggttatgctttggtttaagggaatgttgtccatgctttgattgtttatcactaaatgatcaaatttacgtagaccactaaaacgttctccatagcagcagtaaggctgttttgttttcttacttgcgtgttgtttcttattttccttcaggaacttttcctttgtagtcacaacttggctgtttgatgccagaggcctagcttttggcttaactcagcttttgacatgtctttctcactaactttaattgttgctagcttttgacttagtgagagatgtgcaactcttactttcacttgaacacttaaggctattgtagggttattaattgatctactttcaatattgttgtgtcttggggaatacaaaggcccaaagaaagggaaagcagtgggaaatggctgttggagcagaagcacacacaacatatagattaacttcactatcttatattggcatggttcatggtgtacccaaatgattacaatagtgacatcaaagatcactgttcacagatcaccataacagatataataataataataaaagtttgaaatatttcgagaactggtaggtgcagtggttcacgcttataatcccagcactttgggaggctgaggtgggcagatcacttgagcacaggagtttgagatcaacctgggcaagatggtgaaatcccatcactacaaaaaatacaaaaattagctgggcatagtggtgcccgcttgtggtcccagctacttgggaggctgagatgggaggattgcttgagctcaggaattcaaggctgcaatgagccatgatcgtgccactgcactccagcctgggtgacagaataataccctgtctcaaaaaaataaaaaaaaagaaatattgtgaaaattgccaaaatatgagacagatataggaaatgagcacatgcattgaaaaactagcatccatagacttgcttgaggcaaggttatcaggaaccttcaatttgtaaaaaactgacaaacaaacaaacataatgcttgtgaaatacaataaagcaaagcacagtaaaacaaggtatacctgtaatttttaagcccaaggcatgctaatttacatggttatgttttttaaatggatacaagaaatcttccatttgaagtaagcaattgaccagtgtttttcaagctgttatctgaatgtatgaggaggctgagcataaaagacagatcctagatctcttttattctgcttcttaaaaaattggtttttatttttgtgatcatataaaatgatttctatggaagaccacatgatacttccctgagcattgagttaagaattgagaaccagaattagtatttgtgttacaatttgttttggtatcaagtagcactaattaatttgtcacataataatgagaaaagaattgagattaacttaatttagtcttcatttgctcatttatttattcatgtattcaacagatattgaatgcctactatgatggattaattaatacatggcatactggtgccagttcaaacccaaaagtcatcaagggcctgtgtacaaatatggacaaatggattatatagtatttggggtgaataaaagtggttgaaagaataaactatgcttaggcaccaaaggactattttacttctctgtaaaatacaactacattattcaacaaacagcttgcaaattttaaattaagttactgactgaatggaaggctagcactgccccttatcattaatagttctttatgaacacaaggaatagtctatgtacattttcttcaaagtgtttttaaaataccaattttaattaagttaatttgaatgaacaacatgaatgccattgctcaagtgcccaagaaaatcaaaagactacatgtttggcaatgtagcataatagttaatattacactactaatagtactggaaactacacaaacataggcccaagttttgactccattactttgctacctgtgcaatgttgaacatttagcttttctgagcctcagtgtttttatgtctgaacttagtatacaagtagtacccacttcataatgttatatgaataaatacatgggaaatgcttattcaactttgggcccatagtaggggctttatgttacttatagtttttttaaaaatgtcatactctgtgtttcaaattaataaaaatgctagcattttctaattatctcagtgttaaaattctatcaaaaatgaaactatgtatttaaataaaactagagaagagttgaagttaaaagattaacctttggctcatctcttcgcacacccatgcggcctctccttggtcttcttattactttagttgttctgtaatcagactggctgtccactagggatcccactgagtaccgcaactcagctgaggtgtctagatgagttctggaaaaaaggaaaaatataaaataatccaatctcaaaaattaaacttaccaggaaattactatctgctgttttactggcaataaagcagaaatcctcaaggaaataaacctcaagaaagataaccgataaattgtcatgactctctgaggcctctttagagacttatgtcagaagctgcagtcttaggtccattcctgaaagtcaagtgcactttcttcttttagaatatacagtgcttataacctttctgtttattatcattttcaaatgcagtagtaaaatgaatcataataagactgataatcaaaatccattaggttaaattctggcaatttagtttgagctcttttgtgtatatcacagtatgtgctattgattactgtatttgttttaaatatttcttatacatctagctaaaaatgtctgaaatttgagggtcccagaacttttccaatcttaaaatttttggagaaatttattcacattgtctatttttcacattctatttttcaatttagagaatcaacaaaatgcttaaatttagatggacccaaggcttatggtcttatttttataaaagaaaataggatatactaccaaaaggattttttaagtttttaataagacattgtttcaaaaggatgaagaaaaatcttttcataagcacatttgattcttaaatctgcttaaagatgaaagagtcggaaaattttagttggaaagtatcattacactagttttcaataaacatggtaataaagtaccctataatcaaagtgcagaaaaggcttctccaggcatattacttatatgtagatttatagcaaattcattttattgttacaataatgatgataataacagtgacataatgctgtcctataaaatgaaataacagatctatcatcagtaggaaatatacttaaagctgttagttctattgaatttgaggctcctgctgattgactatactctctttttcagttattcttgtgaacaaagacaagcacttccaaatatctggtaacattaaaaaggggaggtgaggtttgggtgtttgcaacagcagaagacactaacttaagaaagttcttgttttgccaaatggggcattagaacaaatgaactaaaacattttccatcaaataggtgacagctattgtttttgtagcaatgtatttgagacttaatcaagtaaacaggttttatcatggataagttacatttaaaaaaaaaaacaactaggccatattcataaaggacacaactctgtctttatctcttgggcagaggctctaagtttcatgaagaacaaagatcagattttagtcaccttcctatgtccaggaaggcgttcctagcatataataagcacttcataaatatctggcaagatgataaataaaagaaatgattataagacaggcttaaactgtcttgttgtgatcagtctgggttcctttttcctgtggctgcttaccttaatgtccctttaggcatcagggtgaagtttctaacattataactcatcatcctaggagcattgttttcttgttgatttatttcacagctccagataatttattttaaaaaaaagcaaaacacagatctaatcatatcaatttcctgcttaaaattattcaatgtccttaaaggccctctataacttgggcctttgccactttccagtttcattttaaggtactctctgcctagcttttcatacagctgtactgaccttctttcaattccagtaactcacactttcttttcatttctttgaacatgcttttgtttttgtttgtttgtttgtgttctcctgaaaacagtctcaacacatgtggttaacagttttaaggtctcagtttaaaagtgctattgccatctacccttctagctcctagtattcttttttattgtaccagtcctcaaactcatctctctcctcttttttccagttctctgagctagttctctaacaggagaaaacagaggcaatattatcatactagttcaatttttaaatcattctaggtgttcagtattttgaaaggcttttggaaggtctaagtaagtcacaaaataggcatcagttcctttaagcaatgaaccctgtagcttctcctcctgaatctcctgtgactcttgcatgtaatctcattaaagaacttgcataaataagccaggtaagaatttttttagagaaaacctattacccatcgctctgcttcctggagtgttctctgttgtcctttccaattacccagagtctatcttttttcagagttgagccaaatcaagccctttgtagtcactctggaactcattttactttcttcttagatgagatattaagagagaagagtggtcactgatattcactcaccttagcttatctctcctcacctctccacctattagatcaaaacttagtagactgagttctcatgcacctcctatttccattattgtttttacgaaattacttgtcctcagaagcatgaatgttctataaataattgttgtttaataaatattcagttatcctgtaacttattataataagttctgtttagctagcttaccttaattatttctataatactttatacttgtgatatgatttactatacatataatccctactgcttgtcttattttatctgcaaaccaagcctgtgatataatcagaaaaatatcatttatgcatatttaggtacaaatatgtatttatttagaatgttattaaggaaaacaggtttccaaaatgaagcagcttgtaattatctgtgagtcctaggaatgtggattgtcttattcttggtctagggttccttccactacaatctgttgatcaaagaataattgttctatataggccaaatcatccttcattgtagataaatgtcacattgttaggctgcccataatgactcagtgcagtgatagacttttagacaacactttgaaactctgtattttgagacataaggtcaaaaaaacaaggaaatggccatttattcttaatcaaatatatttaatctattgatttgataatgcttattctatgcattgactcccctgatattttaccagttcttctccttctccttctccaccatcctcattataatcatcataaccatgtgaacacataacattgaaataataatttcagttcacatgtaaaaatcagaatcttaaaaatgtgaaaaataagaacgattttctcaattaatgacttacatatgtaaaagttctttgagtgtttttatgcctgccgaactttttctcatattcaattgagtatggaagtacttaaaatatcaaatattgtttttccttacatttatattgaaaagaatttaagacacttcaggattttttcaatttgaatttttatttgagaatctgaaaaatgctttaccagatattcatttattcattctataatatatcttgagagcatactatatgcaagatagttttttaggtgttgagattatggtagttatcaaaacaaatacaaacccatcctctggtggagttaactttctaaagatgaacataacaccaagaaagatgaacttctactaaaagcctatggtagtggaaagtttcaaacggctgctattattctgtgttgcctagtaaataagtgactaaatgagtgtgtccttctagggtttctaacaactttaaataaaacatctcaaacacaaaaggaaattatgtgtgaattattaacatatagatctatctatgtatctatctatgtatctatgtatctatctatctatctatctatctatctatctatctatctatctatgatctatcaagtaagctgccatccattgcttctttttcttaagatgagatagtgaatcaaagtagatgagtatggctaaatttatttgaagtttttgttttcttttcttttatctgattcatttctcttttcctcttttttttttttgcaattactttaccgaaataggtagatgctaagtgaccataatcaataatatttgtttagtcacataagcattgaacatatttctgcatgtttctacactgaacacatatagaaaattttatgtcgaattcaatttctgtattgaacacatataaagagaagggctgacgcctcttcttgaatgagatgcaatctccctgtacacagttcaatttcttcaattaagaatcttttaatatatttatatatataatgaaatgcagaatacaaaagttaacattttaattttttattgattatctacagaaataatctctaagttaaaaagttatttttgaatgtaaaaactgcaaatcagtgaagagtcaaaacatgataatgactagtgagcaataggaagtactgatttattttagttgaggacatatgaaaccataagggaattcatgttgattttcagtgaattatagataagcttttagtttaatgttaccttggtattgtgggttcaattaaagagccagttctcattttcaattggtcaagttcagatctcagcttttcaatttcttctgctaatctttcctaaaaaatcaaaacagtgttactcagatgccagtaatatcagcaagcaattatgataaatgagtcttaatgattttttttaaaaaggaaaaactgaggatatatttttattaaaggttattacacataataataaagcacgccaaaattttccccttgtaataaaaaatgtggatagcagaaattaataaaaatttatctacaatctctggcattcactaatcctgaatatttgaaaattcgtgggaatattaaaattatgactagctatgtagatgtcacttaaaaatgcagagtagaaatcatatgcagttttgaaaataaagaaaatgtcttatttatgcagtaaatgaagaactttcattattctatgagggttaaaggacatatgggtgaaggaaaaagatgattggattgaaagaaaaaggaaagtaaaccctctggcttttactctgcatgagataggcaacaattggaggatttttttaaaaaatattaattaattaattaatttatttatttatttaaagacagggcctcactctgtcactgaggctggagtgcaccttaaaaagtaaagttaataaccaattagcttgatattgtcaccattatttgtacttaattataattttctcaaattggcattttctggtctataaatttatgaagataggggttgtcttagagctttaattaactgctcatgtaagcattcaatttggttttaatgattataactgttatattgttttacaggtctaaatgtatcattctagatttttctattactgtttttccccttcccagtggccagtgcttgatattttactttactcaaacttttctcaccacatttttttttgttaatgtggcctttgcaatgtttctcttttctgttctttttattctcactacgtcactaccatcctactctaagccctttttatctttttcctgaatgatttttaccagcttcagtctctttcctacacatttctctgctagacatataatttcaaaacacatgtacaataaactaatgtgttgctttaaaatgttcaatagtttcttattgatttgtaaatatctttgttcattattttcacaaaagtgcgctgagtacctcttgtgtgtcaggcacctgagatacagtagtgagctgacaaatgtcttgccctcatgcaatttagaatttagtagaaaagatgaataataaacaagtagtaatatagaaatatagcatgttgttagaaaggagaaaacaggggagtcatggaagggtttttcaataaagtgatacttggacaatgacctaaataaaggagaaattaaaaaatgagactcttaggaaaaggcatggcagataaaagcaacaacacgtgcatacgcctcttagtggaaatggagtagagggtaaggagtccagtgtggctggattgcagaggttaaattgacaaatagaggatactttttaaaagtatgattgcagaactcaggaatggtagtcctaaaagaggttgtaaaccacttcaaactctggcttttactctgcatgagataggcaacaattgaaggattttaaaaaattattttatttatgtatttatttatttaaagacagggtctcactttgccactgaaactggagtgcagttctgtgatcacagttcattgcagtcttgaactccagggctcaagtaatcctcttgcctctgccttccaagtagttaggaggactacaggtgtgcaccactgcacctggctaatttgtttttaatttttatttttgtaaagatggggtcttgctatgtttcctggattttctagcagagaagtggcatgatcattctaatggctgtgaaatagattgtcaagttgaattgggagtcagaaaagagaggaaattttgaggcaagagagtaatggtttggacaagaatggtgttagggtaagagtggctatattttggctatatcgtgagagtagaaataagaggatttgatattggactagatgtgggatatgaaacaaacataggggtcaagactaagtccaagttttttagcctgagtaactgaaagaaagaaagaaattgtaattatgattgactgagaagactgctggtgtgttaggttagatggtggtggtgtttgatgtgtgggagtggggtgagaatagactggcatgttacatttgaggtacctaggtgtccaaatggagatattgagttggcaatagaatatataaactctctcagggaagaggacccagtaggtaatctaaatttggatgtgctcaatttatagatggtgtttaaatccaggagatcagatgaagtcactaggggtgaatcagagagaagaaaggaaagctacctagaaacttcaaattgtagagataaagatggaaagggaaacactgagaaaagagtttgagcctacagagggttttgctgataatggactgtgagtacagttagtttagtggaaatttgaggaattatagaagatgtggtcagattagtgaatgtgcccatctaaatgggatgatagttcagacatgagatatgatctgggatttactctctctggagactgacataagcaaggatgcaaagcatggcatgattagtactcttggttgcttaggcagattgttggagttacaaggctttggtaggtggtgggggagtgggttctggggatattgccaggagcacacagagctttggataacataacatgcataacagcatcacgtccaaaattcacaatctgctcaaaaactacttctttaaatacataccagtcacagtaaacttctgatgattcatcaaatcaatcatcttgattttctttgtgccgttgcagaggattcatcctctacttagaatgctctacctttatgaagatcatatatgtctttaagaggctactaaaaatgtaatctctgtgttgtttttgtgaactacctcagaaagaatcagatactatattctaggccccacattacattgttctaaagacctatctttcaggagattgtggacaccttgactgtagaattagttatttttaattgcttcataatatgcagcatccagtagggttaaatgtataattgttctctttcctctattcttcatcttttccaataccttctatatcccatactatccctccctccctccctccctcccttccttccttccttccttccttccttccttccttccttccttccttccctccctccctcttccctttccttcccttcccttccctcccttctttcttccccctctcccttctttccttcattctctttttcccttccttctctctctccatttcttctatcttttctcaacatacagttatagatcacttcttaagttagcaatcctttcttctttaaaaaaataagataaaattgctaacaataactttaaaggctaatgaagaaggaaaatactattagcaattaccattaaaatttcacaatctgcccttagtttcctcttctaccacataccctacaacaggaataattgattccagccaaatagttgtgcctattatttaaaatgtcacactcattacccatcccctcaccccaccaagcacctgtgatcatgccacatgcactatgtttgaaagcctggggtcagagtcctactttcccttaaatcttcagtcaagtccctccttcctgaagtcttcttcacagcagcaatatatcatggtctttcctacctgtagctcttactgcctacttcactaatttggcatttggcatctgctaccctgcatcctcattggtttgtaagggctgtgttctctctcctcagttagatttttttagctcctttggaactaggattatgtttggacatatataacttagcataattctatttataatagtatttaatgtatttctgctgaaagaatatctaaaactgacataaattagcgcatatattttaattctatttatataaggcataaagcaaggcaaaaccattttttaatgttataagtcaagatagtgattatcctttaatggaagagtatgagtatagactaatttggggggagtttctgaagtgctaatttttggtgaatttgggttacaaagattcatgaagctcttcctctctatgtacgcttttctgcacatattctaaaaagttaaaattgttttacaaagatagcatactaaaattattttttcaaatttattttacaacaaaacattcatcagtggaatagaaaataaaaatagaaaatgggcccaaaacataagtttccattataccttatcatgtaaagattcttcaagattctttctgaaagtttctgattcttgaattaaaacattctaaagaaaagaaaatagcagaaataattaataaattaaacataaaatacttaaaaatatattgattaatatcttatcactcaagaatcctcttagattccttccttagttcaggtatttcttggtttccatggaaaccatgctttgatgaaattttcaaatgtgagaccttcacatttaaaaaatacataatttaaatgggaaatgctattttgtaacacttgaatgaacaaatgaaataaatattgcattttaagctacttctgtttgccttttctcagaccacattttaaatcagaaactattggttattcttcaagtaagaaaaagtgagcaacaagctaaatcttagaggtgttataaaaaattcagaagaactcacttctattgtctgaagaaagaagaaatcatgaaatcatattttttaaaatttcactttctggacatctactgcaatgtggaattaacaatttataatgatacttaaattattagagaaataacaaactctagctattcagaaacctaatattacatgtcacaaagtcagtggaaataagttggcatcatagatacttaaaataaaccttgccagaaaattatttttgttgttaaaaattatttatttttctacaaaacacacaagtactataagacattatttaaaataatgtattctttttcaaagttatagaataaaattaaactaagagtgtagtaattgcataggggccatgtatttgaagttgtatgagaggaagtcatgtcttattactttctaatgggtaaattaatcaaactaactttttgtcaaaacattttccctattttggtttattttatgtactaatggaaaatgtctagctaaaatagtgattggcattcaatctagatttctaaaatgatgtgatcatccgggttttataccctaccttaatttatgctctggaattggtaaccagctctcataactcttgctggtctggtagctgccaactatcaatgagacatatataactgtaaatcacattgcagactgtacagaagcactatttctgaaataatgcagctgaaaatactgggttcctaaaccctctactgggattgatactagttcttttgatgatataaactcacttacattttgacttttagactggtgtgtaggtatcagtcacttgacacgtgaatatttcaaatcaccttccccccaaaaaagtattgacttgtgtctcatcacttttctattttgcataccaggcaaaggatatataaaatattttcatcataaaagcacagcatattttaatacatttgcctcatatgaacatgtgaatataaaagatttatatatcatgcaaattttttattcatcccaaatttgatcttacacttttttaaataaaaaatatgcattcctttctaagaatataccaggcatttttaaaaactaagtaaatggatcatctgaccattacaatgattgcagctgtatataaaacaaacatgagcattgcaaaatattcatgtgattttacccttctatcgttttaccttttcttctagagcagccattctttcctttaagtgtagttgtaggcgttcattggattcagtcagaagtctatcaaccgtatccgataatctcttgttatgctcctcattcattttctctctttgcctagccttacattttaaaaaatgacataaaaatccattcaaaaactgtttgagattatttttatagtgttgctagttttaaattgaatttaattttacatctgttttgattaaagtggtggaaacattttattcaagtcaacaggtcatatttgtaagttttaaatataacccatactcagttaaaggctttcttcttatatacagaatacgaattcataaaccaatgattggggggtaatagttcttaatatacatactctttgaagttcttgattcttctcttcaagttgaccctctaaatgtctcatacgttcttcaatatttccatgtctctcttcagcctgttaagaaatatgaagaatacacctgaaatgtaagatttggttaacacttttcctctaaataaattgaaataaaatgtaaagcaagctactaccaactgcaaacatagtttttaaaaaataaactttcttcaaacaggcagctgaacagcattgcttgaaatgtgtcagctacaaaggcctgttacatccaagcatcagcaaaacattggagttatttatgagcaatgaaatcagccaaatgtaacatgcagactgtgcatggtttgaacacaaacctgccattgtccaatcttaagctcctgaagcactgaactgcacagatggttgattatcaataaataaaagtaacataatttttataaatgaaaagaaaaacttagatggattctatttagcaatagaaagtaaagtccagtaggactaccttcctacgtatggagatcatttcttgtagtttagcttccataacatattgataatcatcagatgaggtagaagaggttggatcagactaacgagtcaaggaaaaggagagggacaaaattgaaaaatcagaactaaagacactgacaccaaacagaacatagcacagaatgcttaaaagaaaagtgtgacagcaaatttaatactttaatagacagaattttatgtggaaagaactacattgatatttggtgaacacgatgcagttgatggttttaaataaaaaacaataatatactaaaataaaaagctatcaacctaagatatgaaaggttagtgatggctggcaatgaaagactactacagaatgaataaagcaactctgaaagagttatataataattggaattatgggaaaccaaacaccagaatatgtctctgatagattgttaaaagtttgtattagggtttgtttgtctatattacttaaaaataatggaaacagtagtttcacaatgttgaggaaaatgctagacaatgactcaggtgtaattaatttggaacaaaatttattctaaaccttgctctgtagaaaaaaagataaaaaaactaagcctgggggttattgtgagtagtccccaattcaagcaagattgagtttcctcagcaacaggaaaacttatgaaatgacttctggtctctgaatgcacactatggtcattggtctagaatctaatggcctactctcagatacttggtctcaaatattggtctaacggtccactctcagatattggtctagaatttaatggcttactctcagataggtttaattagaaattttaaatgaaaatgattgaaagtcctcaaattatcaattgacaacaatgctgtgagaacaagaaatcttgtttgtgactctcctaaatgacattaggggccaatcccaaactgttcctgcattgatttgttgctgtggaaacaaaatagtgcctaaagtgaataggcagcacagtttccttgtaagctcatgtttgcccagtgccaaggttagatacatgtcttggaggtgaccgtcaggttaccacaggtgcagagtgttcaacacatgtgacattgctgatagcaaaattgttagtatgttatgcaaggattacatatgaagttatatcaacattttaatcattgcaagttaagtaattattacatttaaaggactctatgtcaggactacaaatttaactccacagcatattctgtcacattttataagctcattctaaaacagtgaaactcactttatgccaatatagaactatatataaatatgtcatgcagtaactgaaaagaaatagtaacctattcatttgattcagatgcatatatactattttatgcaataaattcaaatttaatctatgaaagcaaacatttaacatttcaattctggtgtgcttatgcaaactacaattcaacatttacattttgtaaggctttccttctgatattcttattttataaatgtggaagataataaagacatgataaccaattcctttcctccaagtcgtcctcaaatttccaatttagaagctatacagagttaccatggtccccaaatgccataattttttaaataatattatttaaaaatatattttattaaaaataaaaatttaaataatattatttaaattttagagtaagtggatcaaaatgttgttgaaattatataatctaaattcataaagatatctgtgatccttcaaaattacattttaacatgcagttagtagtgtttaaattaattaggtgactgactcaagacacttgagacatgaatatttcagctgccaaaactgtgtcttcaaaaatacaagtttttagaggtctttaaaacttctagttgtttctgtttacttattaaaaacacatcaaacttaaaaagaaaaaacacacaaaacaccaaaattgtgaaaattcccttcagagaaaaaaaaagaatttggtcctgtttaaattcctattattgctgatacattttattggtactagaaataaataaaatacctcattcaagatgaattatgtccttgctaaaggaatatgcattttaattaaaaagtagatattataaatcataagactgggagcccaaagtaatctttattggttaattgcgtataaactcgccaaagcaaaacttttagttgtatccataaccattaatcaatcattctgactttctaaaagacataaataagctttgcctatacacacacacacacaaacacacacacacacacaaacacacacacacacacaaacacattagaaggagaaaaatagtttatcaaccaaagaatgcattcagacatcccatctaaataatatatactgggaccaattttcaaccaacactactgatttgcattctatgtgaaaactatagttttagcaattgttgtaaatacaaagatcacacagaaacagtctgctattttttatactccttggtgaaaaactgtttatcttagtttcactccttaatatgatataggaaaatttaaaatatactaaagttttaggatgaactacaggcagaaatggttttgagaacatgaataacctcagaaagggagaagaaattaaatttaaagagaaagacctagaaaaaagaagaaaaaaaggtgacagtaaagtagaaaaacgtatattggtgaaataaaatgtctgaggggttattaagaatatcattcaaaatataggaggaggaacccatgtttaagctaagaagaaatatttttactttagtgagtagtcaaaaggttaatgaacagaaaaagactatgatgatccataataaggaaatatcagaaacaaattgaaacagaaaaaaaaaaaaaaaacagatataaaaatagaccctaaaggtcttgagaacagagtacaagaaaaagtacaaggctgttgaaaccacaaaacttgggaaaaggaatgaaagagtgatcctcaaatgtttaaaaaaaaaaaatgacaggcaaaaggaatgtgttcaggataaaatctcagtacttaaggagctttcataatgaataaaatatggtcataatataaaaagtatatatttaaaatatgttgttgacaaagcaccagtcagaagagaaagtgataaaaaggagagtgaatcagagcatttgaagactttttggaagaattccaattttctgaaaaatgaaatcaaagaggttcagggacagtaaagggaggagaaagctgaggggagctattttttgtgcccaaggtaatattgtgcccaagatatatatatatcaacttaacagactagacaagataagaggaaaaaatataaggcacctaattccagttatttttatatattctaaatcaataattcttgggagtatttaatatagtgttttttatgtcaaatattatattttaaattgtttttattctcagtctatcaaaggttaatgtggggcagtgattttctgaattgtaaattgtgttacttgggggaaattgcagattttcttgtgttttagtcaagataatattgataattattttaagctacaattttacaaaagttatttttcttattcagtaactcatctaaccccccaaaacagtgcaattgaaaaagataactctttttgaaagtcctttatgttctttagatgaaaggcctaattatgcatatcttagtctaggttatagtcatttaagatctgtgtttgcaagaaaaaatgaaataatatgaacatgtttaaatattttttcaaattaaatgataaattaatctttatcttagaaatcacatattcctgaaattgccagagtggtttactggcatggtttgtgactacagaacgatccaaattataatcccatcttaatcagttttatccaactagttactccaacactctgtaaacaagcaactatttaaatgctctctaatcctgctctacgcagtcaaaggtttgtctttcattacctggttaattgtcctattttaaccaacaggaagatcagtccactgttcatttttaattatttgcttttttagaaaatcagatgtgtgtgtctacttcattgctgcatcaattattttgggtaaatcctaatcccgtaattttaaacttgaagtccagatacctatcatactcacttattgtagtggccttgaaaacttagcaaatattaatgattgtataaaaatataaattgtgtgattatttttgaattcatattaaatgtcaaacatgcttttagtgacaaaatgtagttttatataacttgtgacatatacatacactttgaaatgatgccatttccgtttgattgtcagaggtcagaatagttctttttaacattataatgcttgtaaaattctaaaatattcagatagttgcagaatctactggccatattatacagaaaattttgaacactcttcagcgtattattgattttaattttcagatgaaattacaactataaaactgctttctgatttttaattgttttagacctcagacttttataagtctaacttcccacttctaacaagttttatactgtagttggagaggaatcaagaagttatgatattctctatacttctaatagcaattgatgtgaagcctgttaaattgttatgtctcatataacattatcttttttgtttatctccaggattattatacaaatattaccatggaaaattaactataacaatgacatgaaattttacttgttttgttaatgtttaaataggcagggggatcatcacatttgtataacaattattcctgctggcataaatatgtatgacaagaaaaaaattgacttaataacagctcaatataatagagattaaacttaattttcataaagcctatagaaaatctttacacattccattttgattacaagtcctttctacaaatatatctaggttgaccagttgttctagtgcagtaccttggttagggctgcaattctctgagccagttcagcctctacttcaggcaaggtttcagcctttctcatggtctgctgcaacttttgttcagctagctcaagacgttcttgtaactgtctgtttttctcttccatctgaaatgggaatgggagcagagacacttaaagagtcagagtttggatagcaaacaccagtcgccaggggctttgcacttcagccatgattctagatttaaatcagccactaccacacctaaatgtgcaaagtgttgattgttgtcttgttatcatatattgcttatctgtttccttcatacatttcagcacattaaaacaatgaagaagctcttaccactggcagcaaaaaggaaagaaattactcatgagtatacattttaacaaagggaatatagctcagtactaagacatcagatataccaccgtagcaaaatattgaaaatcatggtatttagactggagttggagaggtaatgtagcatgatgatccaggctctagagataaggttgacaaacattttctgtaacaggtcagatagtaaaaatgttaggcctcctgtatcatatggcctcaatcccaaatactcaactgcgttgtagcacaaaaacagtcatagacaatgattaaatgattgggcatggctgtgttccaataagactttattaacaagagcaggcaaccaaccagctttggcccacggctatagtttgcctgtttctgctctagagcccaataaacttagtattccattattggctctggtgtttagcagatgtatgatcttgggaaagtctgactgtctctgaactgtagtgtctttactacaataacgccacctacttcataggtggtggttagaattaagtgaggtaatacatgaaaactgtttagcacagattctggctcatgcctatatgaaaagtaaatcagagtcattatttgtattactattaagataaataatttatctttctggaaagtaaatttcacactgaaaatcgtatttgttttgctagagaatttcaaattttagagaatgattactcaaacatctgtcaagaagtaccctattttatttactccgttttgtgagaatgatgagaacgcacagaccagaagaaaaccaagacagagatactgaacctgccgcaggatagcttctttatttgctaactcattttctagtttatcattcatgtcatgtatggaggtagattctctctgagcactgaggtaacgcttttcaagggttgtaattctttcttccatatcttccttttgtgccatggcctacaattaaaataatttagaaaaagcaaatcagattctcagattgtttaattattgtcttgttagttaaataaaaaagaaacataaaaactattgcattcttgaagtaaatactcattcctttcttttcattgaacgaatgtgagattgcaggtgcatgttcccaacttagctatcagaattatttttgtatcttcggttaaccaaaagctttctgctgtctaagaatgcaatggagtagcttttgaaactctctactgtagaattggcattcttgtaagacaagtggcagataaattagttcattatgcagtaaaattaagtacaataatgagtagagttgcaaatcataaaattgttaaaatggtggctacagttctaaattgtaaagcagtcttcaaatagataacaaataccatccgtattcttacctttacattaagaaagaggaactctgtggttaaaaggccaggccaaaaaaaaaaatagtacatttggatcttatttataagtttaccagctgacttagaaacttagccatttacctagttatatatgtttcaattacataagattttaaagaagtccatgaacacataaatataggaaaaaatcaagttcaagtggagaaaatcatggcattgataatattttaaacagtaatttttaaataatagaatttatagatagtaatatggagataattttacctcacagcttacatggaaatttattggtagttagataacctactttattgacaagatgttgggtgaaaatcaagtgcagaagtgaggctcattggcctggaattgtttcctgagaatgtgggaagcttctttgtataaggatcctggaattgaggaaatggctatagtttccatatcttattatccagaatcatttcatcacttattcttaatcagtgcctttgtcactctcctacagggtccagagccagtcctgtcacatataataatcagataaacagacagcctttcttccaattttctttcttttttttttcagatgataactctaatgaaaagataggttgaataaaaagtaaaataagaaataaaataggtaatgtcctaatctaatataatagcaagacataaattttgtttaaataaagagagaaaataccagaagtagtggataaaagggttgaaattaagaatttcagggaaatgggatgaaaacttgaagtgagatgctgtgtgtgtttatacatgtaccatatttatacgtgccattatttgactttgagaatttttgtatatataaaaaattaaaattaattaaaaagtaatagatcagccagaggcgatggctcacacctgtaatcccagcattttgggaggccaaggtgggcagatctcttgaggtcaggagttcgagaccagcctgcctggctaacatggtgaaatcccgtctctactaaaaatacaaaaaacttagctgggcatcatggctcatgcctgtaatcccagctactcagagaggccgaggcctgagaatcgcttgaacctgggaggtggaggttgcagtgagccgagatcgcaccactgcactccagcctgggccacagggcaagactccatttcaagaaaaaaaaaaaaagaaaaaggaatagatccaccatgaaactcatcatgttgtccctagtctcctgcccacccacaagttagctctctctcttgtattttttgtcttttattctccttacttttcctccacgctgctgcctgagagatatttctaaatgatcatattgcttcttggtttcaatacttttatttcttcccctccatcttcagggtaaaatctgagctacaaagcctggaataaaagtggttttgtgacctgatacttccttacttcagtgtactggggctaataacatccccccaaaattcgtgtccactctgaacctgtgaatgtgaccttatgtgcaaataagattttgttgacataatcaagttaagatgaggtcacacaggattaggataggccctaaatccaatgactggtgtttttacaaggaggggatttggggacacagagatataccgggaagaaggaggaagtcagtcagagaattgcgttatacggagttgtactgctaccagccaagaatgccaatgactcccagtaaccattagaagctagaaggggggaagaagaaatctcactagagccttcagagagaatatggccctgctgaaacattgatttcagacttaaagcctccaaaacagtgagtgactaaattatggttgttttaagccacccagttggtggcaatttgttatggcaggtttacaaaactaatgcactctgacatcatgtctacctggaatgtgtgctgtcttctttgtctagctcaatcctactgaccaccaagacccagtcaaaagctacttgattaattatgttgacattaaagtgcaaacataaaaaattaaatttaatctatgaattcagcaaaaaatagccagactaatttttaagaaatattatatacatactcctagattttagatatcctaaataatgcctactatttaaaaagctatttattttcacttttgactttttctactttacatattttttatctcaatgatggtagagtttttatcttagaggatcttttcagagtgcttaatattgtattctgtcagtttcatttgcaaacagaactctgggaaaattttgtggtctgaagagaaaagtctaaagctaacctgtgtaaataaacttcttactaaattttaacagcaataaagtcaataaaagatatacacacatttctcaagaacgtgagcactgaagtagtacatacttgctccaaatgctagtttgggacacttattaactctgttataagggatcagtattggtcaccttttccgtgcttcaccttcttcatatattgtgtgggttgagattctaatatgtagcacatagcattgttgttaagaatcaggaagtgctttgtatggtgtctcatgcagaaaacaccctcgataaataatagctgttatttattattaattactattatgtacacaattagatgatctcactctatgacgtagattacatgcaggaatttttgcattttgtaattttggtactgcattttttgattcagtgattcatgtgggagattcaatttttaactgcaggctgtgttgccaaaaataaactggatttacaagtcagagaaatagcttttccctctgtcatttgaaaaattctgaaagaggaagctttttctagtccctaaaacttgctacctacaaaaaaaatgagaaaaaataaagattcaatgatctcttgacctgaagttcatgtataaattggattttgttcatatttaataaatataactctctggtaatttagatctattaaagtgaaaaatataactacatgtttcagataacagaaaaggcaacactgagatgtatttaattcatttaatcacatagtgaaattctgaagaactgttaataggaagttggaaatacaggatggttttattcacaaaacaaaatgtaattaaaatactccactgaaaattttagctactggcacagctatgtatttgatatatcattatccatacacaattaataatccttttgattaaaaactggagagataatccacttgtatgagattgtctatttttctaatttgagtgctgtgtctagctttaatccaactcacgtattcttcctagatcaaaatcaatttaaggagttttgtttgaagacaaaatgtaaaatgaaattaaattttggataatttcttttttgacaaagaaaaattacaaaagtatattctgaagccatcagtggaacatatttataaattagattggtgcaaaagtaattgcagtttttgctattcaaagtaatagttaattttagataccttagaatgtcctcacatgcaaagcaaattatatttctgttttttattatatggttgttttttcttatttcctaatttttactcaattattacaacatacatttattacctgtacaatttataaatcatactatgctagcaatgctataggagtatcaagaaaaacgagcttatttttttctactaagaaacttgcaatccgtggcttatgcctataattgcagcccactgggaggatgaggtgggaggatcccttgaaccaggaatttgagaccagcctaagcaacatagtgggaccctttctctacaaaaaacacaaaaattttccagacatcgtgacatgtgccctgtagtcttagctactccaaaggctgaggtgagaggattgcttgagcctaggagttcgaggttgcagtgagctgaaaacactactgcacttcagcctggacaacagagcaagactctttctctaaaataaataaataatattttaaaagaataattaagaaaaggaaaagaaacttgcaatccagttgactctatgtgaccataacccggaaaaatattattcaggaaaataaaagctttaagtgctaagtaatttgttttttaagtacgtgattttcacatcttcctgcttattgaaaaaaaaagatccaaatattgattatttagaggacagttatgttgtagcttcattttatgatagttgctatcactgaattatttattgtgctgtgttgattttggaagcagttcatagtggaagaagcacaggttttgaagccatgctgatcttatttctcttccgtgctgccgaggagggaactgcatagatctttggcaagttactttacctcactgaaccttgtgggtctcatctgagaaaaatggagataataattagcattgccccttttgccagttgtgaggaatttgagactttccatgtaatacacccgtaatagttttcacatgtgactcgtccttaaaaaatctttcataaaccatgggcctgggtcttgagacctgaatatttcagaattcgtttatttagctttcacagtgctgtgtgtgtgtgtgtgtgtgtgtgtgtgtgtgtgtgtgtgtatacaaaaaaaaaaaagtgatgcatgcagtaacgcaggctgagtgtaggccatttcacaggtttcatcaacgccatcagttcctacagtcttgcacctggcactttacacttttccattgccagcctggctctgaaaacatttgtgtttgcaacctcccttcaaaggtggatgatgagagatattcctttctcaggaaactcttctaaaatatatacatagaaacgatggggctgataagagtagttgtattttaaaataattccacatgaaaggagaacgttttgcccattagaatggattcttaataaaagaacacctggcatcataggagtgacattttccatctgactgggtgttttgttacctacattcagaggctattagtatcaaggagttatttttaaataggcagttagaaaatggggattgaatgttgggccttacctgtaagtgatgctggattagataagcattaatagagcaatgagtactaagatgaaaggaaatcatctaaatctccagggccaagagaatgaagatggagagaatgaacaacagaccaagaagtgagcccggtgatttgatagccagaaatcctagtaattccttaacagtgatacagaagaggggttaaactgcctttactttatgaattctctgagtttgaattgtggggagtagtgaagagaagagatgcatccatgaactattatattaattcataaaaagttgtatcattatctgtgctgcagtggagcagtctaccacttcatggttcatctatctcttttttttgttttgttttgttttgttttgctttcaggcattgtcgtagtacatattctgatatcattcacaccttctgatatttacttataaatatctattctttcagcaaagattttttgagtgcctattatacaatcaatagctgcgcaggttctctgaagacagcagtgaacaaaacaagaaaaaaaccctagctcttatagatgtttacgaatagttggggtgggaggcatatgataaccaagtatatcagtaaaatatacattgtgtcaggtgatagaaagtcctgtgggataagcaaacaaaagaagagggagagtgtatatgtgtaaataacaaggtcaggggacatttcactgagaaaacaacattgaacaaaaggcagagagaaaagaaaatgtaacaaaacaggtctggcttgcttaagaggtcactccagttgagcagagcatgttaggatgagacagtagatgatctccaagaggtcaggaaggtggtagtagagagattgtacatggcttgtagaccactgtgagggttttgataatagtgtaagtagaataggtagtcactgaaaagttttaagcagaaaagtgacatgaactgacttataggcaggctgctcaagctgctgtgttgagcacagactgaggtgagctgaacgcatgagcaggaagaccaggaaacagatgaccattgaaataatccagtgagagaaagtgattgtgtagaaaaagcaaaagccatgaagattctgagaagaggtcccattatgaatactttgaaattgtaaataacaggatttactgctgaatcaaagcaagtgtgtgaggggagagatcttaaggacagcttcaagattgttggcctgagcaacaataataatggataaggaagactgcaggagggtctggtttgctgagaaaatatcaagaaaagagtctgaagtgctaattttgagatatcccttagtgactgagagagaaacatctggaaatcaggaaagaaggacaagttggagatattaattgggaatcctaagatgatggtggcttttggagccatgagactgcagaaattcaccagggaaataaaggtaggtagagaagggaagacactccaaggtcggggaggagaaatagaagcagtaaaggagccttcgaagaggtaagcaagtaaatacggatgaaaaccagaagaggataatgtgctatgagcccagtgaagaagtcctctggaaaatggatcaagtgcttcagaagactgagaattgaaccttggattcagtaacatggaggtcagtaatgacttttatgagaagagttttggtggaacagtcagggaaaaagtaagatacaattggcttacgagagaatgggaagaaaagaattggacacatagaatagggccaacttgatgaacaactagctagttatatacaaaagatacttttaaaagataaaaatacatttaaaagaatatgtaaaaatggaaaaggcaaaaagtcagaaaacgcaatttccacaaatataattttcttttcagttgtgactgaaaaggtgaaaaagtgaaaagattctaaactttcaccttagcaggtaaaatgatttgacagtgttacaaattaaacatctcctagtatttttttttagtaacttaaagtactctcttcacttgatattagccaagagactgagaaatgactaaagtactcatttttttaagtagaaaaagggatgttatgtctaacaggaatttaatatatagacaaagaaaggtcatgttatacatatgcgtgtatatgtatattaacagagatacattccccttcatgacacaaaaccaaaataagcaatggaacaatttaaggcatttttgtagtattcctatatgctaagagtatagcaattcatgattcatacacatatctagagttatttaaaattaaaagcttacatttaaaaaattttattaacagcttcagaatgtctttgttatatctgacccttgatagcacaaatttctttccatatatcatgggcatttaaaatgctcatgaagtaaactatgtttgcgctattgaacaagtttcataactaatataatgcatgccaaagtatggtcttttgagaagtaaaaagtgtatggtcattacgggaaattatggaaacagtatctcagaagcagcattcagaaatcaaagactgaaagtggcatgaatcacttacctccctaatgtccctttgatacttggtgttcatttcttctgttttaatgagatcctttcttgctgtctctgcttcctgttccacctctcccactcgggaagaaagggctgctaaacgttctttcatctgggccatttcatagttttgcttttcaagcaattcttgtagttcaactatttgactagtttcatcggttgagtctatagaaccattggacaaacgctgcagaaatagaaaaagaaatggcacttaagaattttcatctttaatttaaaatttaaaataaacttaaagaaattaaactgacactgctttcacagtgagaaataagaaattctgaaaagaactagttttgccgaaaaactaagtttctaaggaaactgttaattgacattaaaatatgaaggtagatcagtaattttcaaacagtttaatagatgtatttgaaatatgctatgctatgctctctctatatataaaacatagcataaaacattgatgtatcctaaacatttaagtgttagctactattttataaattagatatataatttattattaatttacaatgctatgatataacaccatacattatttttaattaatgggtaaggacctataaggtgtacaattttaaaatttttcttcaagatcccttgtaaatttttaagttttattttcaatgatgcccagaagaataacttaccaaatattttttatcaaagattattcctgctgtgaatctgacctagctggaacaaacatatagtatagaaaagtttttatttctatattgctattaacataaaatcatgtgtgcacacaactcacaggaaggaggttgaaaggggttaaatattttgagagctgatttttcttctttccgaaaggactgcttagaaaccagggttttctaaaaatatgtcttcagaagtatgccctacagctaaagtccgaaatatataaacaactcaaacaactcaatagaaagaaaataaatccccagataagaaacagggaagagacctgaataaacatttctcaaaagaagacatacagatgaccagcagatacatgaaaaaatgctcaataccaacaacgcatcaggaaaatgcaaattaaaaccacgatgagatatcacttcatacctgttagaatggctattagcaaaaagccaataagtgttggtaaaagaataagaatgtggtaaaatggaacccttgtatgctactagtaaaaatgtaaattagtatagccactacagaaaaaggtatgagagttcctcaaaaaatcaaaattatcatatgatccagaaatctcacttctgggtatataaccaaaggaattgaaatcactgtgtggaagagatatctgcactcctatgttcaatgcaaaattatttacaatagccaagaaacggaatcaacctaactaagtgtctatcaacggatgaatggataaaagcgagtgtggcatacatacacaatgaaatcctattcagtttctaagaagaaggaaattctgtcatttgtgacaacatggatgagcctggaggacattattctaagtgaaataagccaggcacagaaagacaaatacttcttcacctcgcttatctgtagaatctaaaaagtcaaactcatagaagttgatagaagaatggtggttgccagaggctggaaaaaaaggatagctgtgatgagttaatgggagatgttagtcaaagagtaaaataattcaattatacagtaagaataatggtctattacacagcatgatagctacagttaataataaataatacattgctagaagagtagattttaagtgctctcaccacaaaaatgataagtgagtgagtgatggatatattaacttgattgaatcattccacattgtatacatatagcaaaacattacattgtaactcacgaatatgtacatttattatttgtcaattaaaaagtaaaaggcctggtgttgtggctcactcttttaatcccagtgctttgggaggctgaggcaggagactgcttgaggcgatgaatttgagaccagcctgggtgacatagcaaggcctcatttctagaaaaaaattaaaaaaaaaaaatagggtgtggtggcatgcacctgtagtgctagctgctcaagaggctgaggcaaaaggatggcttgagcctaggagtttgaggctgtagtgagccatgatcatgccacagcaatccagcatgggcaacagagccttacaacctttaaataaataaataaataaataaataaataaataaataaataaataagaaaagaaaagaaagtatgggctgtatgtggtggctggctcttgtaatcccagtattttgggaagctggggtgggaggatcacttgaggccaggagtttgagacctgcctgggcaacatggggagactccaactctaaaaaataggaaaattagccaggtgttgtggcacgcacccatagtcccagcaactagagaggcagaggtgggcgggttgcttaagcccagaaggtccaggttgtagtgagccatgattgcattagcgcactccagcctgggtgaaagagtgaggctctgaccaatagtaataatgataataataataataatgataaataaaagtatgctcctcagcctagctactttggagaagttttgtagtgaggacggtgcagcaatttgggagaaataactaagagaaaaagaacataagtagaaacaaaaagtatggagagaaaatacagaaagtacagtcatttccgctcatgttttcagcacttgtttaaaaacatgaatttgtttcaacatgatagatatattataaaacaatttcaatgtaatgcaaatttttttaatatgcaattttgttcctgagaagcactggctaaatacagaaaaccacacctggctgaaacaagccacataggaacacataaaatgcacacatgcccattcctcaaatatctaaaactgacctcaatgccccttgtatgtcataaatttgcccatcgacacctgtgttacaactttctgatttcagatacctttccttctaccacttcacaagaaatgaaagcctttaagtcttctaacacttctacaagcaaacttcagctctttctcggggaaaaaaaaatacttatcactgtatttgtgctatctccaactatttaacaggtgtaaaattgtgctaccatttttattagcttttttacttttattttaatgtgacactgataaagtttttagtgttgtgccataaacttcattacccccttaagccctgtgatttttattgcacaatattgcatagttcatgatatttaggaatgcaaatgacacatagagtagaatggactatagaagaatgagaagaacagaaagcatcatgaaagcagtgagaaagataaaacacagagaaaggaaatgcaggcaaatggcaagaagtactgtaagtccaataacctaaacaatgtgagagtgtggagaaatagctgagagaatcaaaattaaaagagcagagaaagatagagacaattgcctttttaaagttgactagaggaatttctcaatgtgagaaggtagaagttctaataaatcttatggtggtctagttacttgtagactttatacaggatttgaagatatttaaaattatggcaaaacccctctaaaatcagttatcatacctcagttatctcaaatttggaaataactgactggcaattggttccacccatcttccctaatccagatcttgggtgctgcctaatgattataaactggcctttctgagttcagtgtacagatagttgtgtactgtagaagttcacaattccctccctctaagagcaattcccagagaaatgttcagctctgatccttcaaccagcaacatttccagcagaaaggggaatacagactctaaagggaaatgtgattaatgaactgcagtatgcactccaacattcccacatattcgtagcagcacttaccccttttattaaatagaatttggcacccaaaatacaggagttctatgttcagatatggaatgatatcttcaaagaattaggtctgtagattcaacttgtatcttaagagacaatttagtaaccaacagggattccttggaaataacgtttacatactataaataaaagtacaatgcaatcatgctaaataattaaattcaaacacacttcttaaaaatagaagaaactattgtactcttggggtaaacaaatataacttgatatgcttgtacaatgaaaacaaacatattactgatctctccaatacaatgaatgaatcacaaaaacattaagctgagaaatagaaagtagatacaaaagagtacataatgtgtgattcaatttatttgaaattctagaaaagatcatcctaatctatcatggcaggaaaacagattggttgttgcctgggctgggagttggaatgggggaggtggggttgacttcaagggggcatgagagcacttctaaggtttatggggatgttctttatcttgatttgggtgtttacggaggcacatatatttatcaaaattgacagaattgtgcacttaaattgtatgttacttgtacattaatacatttgcttaaaagcctataaaaaccttgaaaaacaaatttttattttgaaaaatgtttcatagaattgaaaaatcatatttaagattctagagctctgaagaattttggagaaactgagactcaggtaatcacatagaggtgatctgaattaaaatgcagaacttttattcccagttcagttaatttacgctttaccacattgcctctaatcagaacatataaatcaacaggataaaattatatatgacgcatggtataggcatgtaccaagcaggtaccaagcatccacacaccattatatatatatatatcactcacacaccccaagccccagacaaccactaactactttctgtcacacagattcgctgttctggacttttcacagaagtggagccgctgaacatgtgttctttcgtgactagttttatgcactgagcatgatgtttttgaattttattcaatattttatatatatatatatatatacacacacacatatatgtattcagtggagtttatatatatacacatatattatatatatataatattgataaatatttatttggtgcaaatgaacgatatttattttctaatttgaaaaatgtttgttccaattctgtgcacctgcgctccattaaaatcttgttaatgcacttaacaagaaaattgcatacttttaaatgggctcaaggtaagagaaatttaactaactatagatagtaatcaggcaattaaaataaaacgcttttaaaatgttaactttttaaattccattaagcagtaaatgttcactgcatagtctttatgctactgtgttgggattacccatgaggagattttaaaactctcaatttttattccatagtgtttatgaaacttgcatttgcagaaaatatataatcttttatttgttctcattaccttaaatagattgtatcgtgagcttactgtgtgtcttaataatatcagaataaaaagtcatattaaaactgtgatttatatcttagaaaaagatcttgtttttgttccaaaccattgttaacttgacttacctttaaaataaattgtggcactttaatttaaatgacaaatggctgtattaaaagtcagtacttattttaagcagctctactgggatataatttacacgccataaaacgcaccctttaaacataaaaagttcagtggagtttagtatacttacagagttgcgcaactatcaacattagttaatctcacattttttcacccttagtggaaatcttataattattagcaatcactgacacacccccagccccagacaaccactaactactttctgtcatacagattcgcagttctggacttttcacagaagtggagttgctgaacatgtgttctttcgtgactagttttatgcactgagcatgatgtttttgaatttcgttcaagtaccgtagcatgttatccacacctcatttctacattgatgaatagtattccatcatggggatatattacatgttatttatatattcatcagttgagggacattaacgttgtgtccaccttttggctactataaataactgccgtgaacttttgtgtataagtctttatacggacaaatgttttcagttctcttggatcgattcctagagtagaattgatggaccatatgacaattctatctttaacatgttgaggaaatgttttccaaagtggttgcaccattgtacattcctaccagcaatgtatgagagttctaattttccacatcttcaccaaaacttattattgtctatctttttatttcagctattctagtgggtgcaaagtgatatttccttatggtttggatttgcatttcctaataactgatgaagttggacatcttttcatgtacttattgttcatttgtatatcttatttggagaaatgtctatttaaattatttgccttcatattaattgatttacatgtatttttattgttgatttacatgaattttttacatatattttgattcaagtattttatgaaacatatggcttgaaaatagcttttctctattctgtagaccatcttttcactttctttcatgatagtattctttgaatttcaaatgtttttaattttaagaagttccagtttatcatttttttttctttgtggcttgggctcacggtgtcatttctaaaaaatcaatccccaacagaaggtcataaagattttcaattttttaaagcagtacaagtatatatttgaaattattaatgatcaaatacaatggtgtctcatatgttaaattttaaaatatatatttatatttactcattcatcaatatttattaatcacctactttggtgtcaagtggaagataataagttttagaatgttttaaaaggtgataatacttttctgacatcaaggcaattctatcaagcaaagaagtaatacacaaataggcaaggatatgcattgcaataaagtattatcataaagttttattttgcttcatatttatgtgtgggagcagaaagcagagaatatctttgtgatatcctttgagttgggtcttcaaagatgagttattatatttcaagtaaaggaaaggaggggagtacttattctaggagcagaaaataacatgagcaaagggagggggatatccctgaagaataattgtaagtcgtcctgtatgcagagcagaaaacatgtgctataaggaaatggtaaaatatgagacttgacagggaaggccagcatagattacgatggcctttgtttttccatactgaatagaataaactttgggtaccagatagaatgacaaggagccatcaaagttgtttgaacagggaagtaacatgtaaaactgtgcaagtaaactgttactctgtcatcacaaacccggtaattcagataaagccattcctatctgtaatggataatttttgcttgtttgttcaatatcctcacagctagggttgccagatgaaatataggatgtacagttagatttgaattttcaataaacaatgaaaaacttgagtgtaatgatgtcacatgcagtatttgggtcaagcttatactaggggaattgataatgaaaagaaagcattgagctaaaccctgcaatacaagcataaatcatgcagttttctggcagaggaaacagaaagatcaaagacaaagtgacacaagtgggtttaggattttcaaggagaccattgtagctagaatggactggactaaataaagcaagagggtgggagtggatatagatggaaatatgatgtgtgttcttgagatcattttaagactggcttttgctcaaggtgatatgaaaactataggaaggtgttgagcagaggagtgacatgatttcacttacattttcgatggattcctcagtcctcttataaaagacaggacaaaaaaaggaatttaagaaaatgaattaagaggtgaaaaattacgttggcttagaccagggtaataggactaaaggttataaaaggggtcatattctttgaatggattgaatatgatatgggacaaaaagcatagactcaaggatgactgcaagatttgtagtcttcgattagaaagatggagttgctattttttgagaagagaaaatctgtaggagaagcagatttgtggttaggatggggcaaaatcctggactgggttttgaaaacaatgtttgaaatgactaattagatgtcaaaataaaggtgtcaggcaagctattgtataagcccacagtaaagaatagtgaatatatggatgttttctgcaagcagctataacattggatgagatcacctgtggagtgaagtagggggtcgtcaaagatgactaataacgtctttgtagaactctcttcaattgttactttatcagaaaggcctttcacccctgccatattatatatttacaaaatatgtttgttgtctttctcacctaccaaaatatatattcctaaaatttttatctctattaaaagtttaaatcttaacttatatattattgtacattcaactgcaatacaattttcacacttggctgtcaaacagactttccaaactcaatatgtttaaaatctgtgttcagaacgtgcttctcccccaaatatgttttgctttaattcatccccaactcaattagtgagaacttcactttttcactttctccaaaaacggtggagtcatccttgagttctctctttttctcccatcttttatacaatctatgagaaaaacttgttggctttcttttcacaaaatatgtgaatgtgacccactgtcatgacctccaccattgtcacccttgtctgggtcatctactctcctttgaattactgtaacaatcttgtaactggttctttttttctaaccttgtttcttattttcattcttatagcagtcagactgattcatggtgatcctgttacattgcagttaagtgaatattcccatgataaatgttaataattatcagaaatataaaaaatagctaggtcccacattacagcatgaaataaacatgttaatgattgatagagaaaaacattcatctgtgaaattcttactctgtatagtttgaagagatgagaagtgtgtatattgagtttattttgtgtatattgagtttatttttttctttagagaaagtcatcaaattgaaagctttcaaatgttttgttgctattgttgttcatctataaaataaagaatcaacactagagtggatctttcttcctggatgaattaccaagtagtccttttagatgtgtaaatataagtcaagtaggctcccacatcccaaggaagaatatttaatagaaccctgacaaaaagtgtctcctctactgtgtcttgatattaagagagtggaggaggaagatatttgacataaaccaggaaacttcaggaaggagaggaaaaaacagattgctcccctttcaattgtgaagttcaatgtttttcttaattctctggtagactgacaattgactagatcacaaggagtaccaagagtccacaaagagaacttaccatgagggaagtaagagtatgaatttgaactatggtccaacacccagtggtggttctggcatggaatctgaaagaccttcctggctcagtcatcttgatgaatttgggaacatgagtatgaacctaaacttcaactggtaaaacttggagaatggaaaattcttcctgaagaatcactttggtagaggttgtcactactgctggtggaactagtttggaaaaactaggccatttattggcataagatggtttaatttggcctgtatgacagtgggttattgcagtggtgcatggatggtgttggattttgagggaacacttgtttcaaaagtgatactttgagggctaaaaatatgcaatagcagttttttaaaaatttactcacttgttactttatcacattttccagttatcttttcatgaattgtaaacaaacaaaaaacaaaaacaaacaatcaaacaaaaaaattcctttttggtctgatcaagttttgaaagtttttagataacttaggcagaacaacattggccccaagaggctggtaccagacttactgttacttggattacttgggctcttatatattttagatagtcaaaaaagagctcaacttgcctgtatccaggtcacaaaaattatgtatgtaaaggattaatggtaggcatagaaataatgaacactaatcaagtacaacagagtttaatttattttctatttttaaaaatttcacttctgtcagagaatcatgcatacaaaaaaaaaatcaagttgtttatccctaggaaaagaaaaacagttccaaaagaatatgtgccatcattctcagcaaactaacacaggaacaaaaaaccaaacaccgcatgttctcagttataagtggaagttgaacaacgagaacacatggacacagggaggggaacatcacacactggggcctgtcagggtgttgggggcaaggggagggagagcattaggacaaatacctaatgcatgtggggcttaaaacctagagacaggttgataggtgcagcaaaccaccatggcacatgtatatctatgtaacaaacctgcatattctgcatgtgtcccagaagttaaaaaaaaaaaaaaactgtccatgaaatccactacttttgaaagatgagtatattgtattctgaaaatacttcttagcaaacttgtaaatgaaattccaaacctgataaaagctatctaccagttactatgataagcatcacattaatgaatagcattattattaaagtctatacttttacaagctttatatgtcttggacaataacaataaatgaaaactgaaaaggaagagaagagaaaagtaaatcctcccaatctgtgtaattacttagaaaataccaagagtatagcaaactcttagaactaatagttttgcaagtttgctgtaatccatatcaatattggaaaatcaatagcatctttatatgccagtattaatttattaggaaaaacatataaaggagataacaatcacagtaactataaatgcctagaaataaatctaatcatatataagatctctatgggaaaaattaaacaattttattgaagaacataaaataatacacaaatgaatggagacataagccatatgtacacatggtaaaacagtatacaatagaggcaataacttcccgaagttaatttattaatttaagcaattgcagtaaaaatcttgttggggcacagaaaacgattcccccaaatatgactttggcttgttgagcgctttgaaaattgaaaggcctcagaaataatccttagaaccaagatctgtctctgaccttcctctcctccctttctctctctctctctctggaatttccttatctgactgaaaacacttctttccacaaggaatgtaattgtctcaagattcccctcttcaggaatcctgtcagattaaccactagagaagagcagaaattgggagtcgtcatgccaagacagatttataatctgttcttcagaggacagctcccagagattacccaggggacttaatctgcaataataaagcaatatttattcctgcacagtctttccccttactttcctttaatttgtcagtcccacccagcttccaaaaagaatcatttgcaaaatgtctgcctcctgaatccatacatatctcctatgtcgagaatatttaagcatcagccctctggcccctcttccagtctaatacattgtaaatggcagttatatccatatgcgtgttaaaataagttttgtgtgccttttttcacattaatctgccttccctcaattcattttcagcaaacctttagagggtggaagaaaattttctccttggcccctacaatctcaacagagttgaaaaatggaatttgaaaagttgatattataattaagctctaagaatcaagatttataaagttaatcattaaaacagtgtgatatttatttcttattcttgaacacgtatttattaagtgttcatcatgttctaggaactattctaggtacctgagcttcatcaggaataaaacaaggatcctaacttttatggaggttattatctaactgggctggcagacaatacattacagacattataaataagtaaagcatataaacacatgctgtgctataatacattactatgttagaatatgttatgacatttgaacaaagactggatggaagtggggaagttagccatgtatctggaggaaaggcaattcagacaaaggaaagaggaaatcaaaagtcaacaggaggccagtgtggctggggtggatttggatgtgaagtcagaagataaagacagtgagatttatgtagagccttgtgtaagtggaaagaagttgcagagttttgagcagacgattgatgtgttcagatatatggtttaaaacatcactcttgtatcaaaatatcacatgcaccatataaatatgcataattagaatatatccatagacatttttttaaaaatgaaaatgaacagattactctgattcatgctgttttaaaaatagactggagatggcccatgggagaagcagagagacctcataaaaagtgattgattacaataattcagctgagagatgacagtggttcaaaacagagtgatcaatggaagtggtaggattctggatatattttgaaggtagagtaaatcaaatttctttatagttggatgggaggtgtgagacatagggaggatgtgagagtaattccaaattctttagcttgagcaactggaaaggcaaagttttcatcatgtaaactggagatgatggatcaaattttttaaggggggatatcaaatacgtaagcttttgatattttaaatgtgcaaagtcttttagatatacaagtggagatgttcgattgtggctggatatatgcatttggttgtagggtctgaactagaggtaaagattcataaattattagtatatgaataggatgagattgattggaatcatggagagagtgtaggtagagaacatgtggagggctgagccctggggtgaagaaagaaagagaagaagagaagaaactgggagttgtcatgccaagacagacttatcatctgttcttcagagagcagatgctccaacattcagaagtcagagggaggaaaatagatggagatgtagccactggtaagtaagaggaaaacaatgtagtttcctgtaatgcaagtgaagaagtatatgaaggaagaaaactattaactatgtcatatactgctgagacatcaactatagcaaggcctgagaattggccttatatttagcactataaatttagtgatgactgtagcaggagtggcttctgtgctatggtggggcaaaaccttattgaaataggtttataagggattttaaaatgtggggccaaaagataattttttttaagttagggaaactttgtatattataagaatacagtcgaccaggggtgcccacgttccaagccatggacatgtactggtctgtggcctgtttgggaccagacttctcagtaggaggtaaaggtgtgagcaaagcttgatctgtatttacaaccactccctatcacttgcattaccgtctgagctctactttctgtaagatcagcggcagcattagattcacaaagtagtgtgaaccctattgtgaactgtccattcgagggatctaggttgtgcactccttatgagaatctaatgcctgactatctgtcactgtcagacaggaccatctagttgcaggaaaacaagctcagagctcccactgattctacattatggtgagttgtataattatttcattatatatttcaatgtaataatttaaataaagtgcaaaataaatgtaatgtgcttgaatcatcctgaaaccatccccaaccacacccccagttggtggaaaaattgtcttccacaaaactggttcctgttgccaaaaactttggggaccattggagtagacaaagaaaagaaaatgatggcaaaggaaagagcagtaaaatttgctggggaaatatacttgattaaatgtttgctgaagacattacacatggtgtaacaaagttttctttgactaggcttttttgaaatttttgtaagcctcatgctcagtctaataaactcttccatcctcttagaaacatggacaggtttaagactttgcttaaagtaaataatcttatattttgaaatctataaaatcaggtagtttttatgctgccttttccctccatagttcacatttattctttacttacttgttacctgtttatctccaatccccctgttcatgagctacattactttgagccattgatccttgctctgcaaacctcacagggttgttgttacagagatcaaataaaacaactcacataaaggactttatgctggttacttatctcattcttaaagacccgtagccgctttgttaatgaggtttccagacaagtttgaaaaacaatttggctaactttaaaggttaagcaccagcattccttaattccatattaaggcatgtcctgttgaattctcattctgggatactcttatttccctgtgggtaaagagcgtctctggaaacactacatactgtgtttctttcttgacgctcgacaatactaagagttaaaatataaatactgtagtacttacaccagttaaaaattgtacacaacaatatttcctaatctgcttctcctgggaatttcatttgttgggtgagtgggtcctatcaaacacccactaaatttctggggagcttgtgtttcatgagaaatgatgaaatagataaattctaccaaagtgaaaaaatacaattagatcaactgaggaacttctgaatgaaaaacttaaaaattctcctagccttgcttaacagatcgcacaaaacaaaacagaggaaaaagaacttattcttgtgtacatcaccaaaagacaacagattccttggcacaaaatgaaccctccaattatgttaataagataaaggtaactgaacaaatttccagtcagtcagtcttttaaagtctttggaaatatccttcttcacaaaaaaaaaaaaaaaaaaaaaaaaaaaattctgagtacctcaaatcctggctaatacaaatgatacttcttactgaagacagcagagtggatttcacttcatctttccatctaacaaggtcttagttaacacacaataacccagtcactgcacccagagcgatttgttttgaacctaatgagtttccacacagcattagaagacttttatttttgccattgcatatagaagattccagacctttcgttatgtgcttcctcgccaactcagcttctagaaaattgatacaacttcatgtatatatggataagccatggaagatcctaaccttactcttttggtcccttttctagccaatcattgaacctctgggccagtccagcccatgtatatctttagacctgctctttccaagttggcaaattcataaactccattcagtttggtgtttcactgcttgacaattcaattgaagaataaaggagaaacattcaagtcgttatgttttgtaaggaattagaatacaatatatggaatcaatacacagaagaaaatattctgtgagtgcaatccatttgtaaataagcccaattatatttttgagagagggaatcaataatgcataaaatgagctacagttgacaagactgaatctttgaaagaatggttgttggccgtagttaacatgtattgatgaacacaaaaaaatgaacaaaatatagtcaatatattgaagacatgcctgtggatgatgacttttagtcagaacttagtgagaatgattaaaagaatggcatttgtgataaatgatgtttattagtattttaaaataggatgagatattgataagccaaacttttaactggacagctgacaggtttgcatgagagtgtgcaaatcttcacactatgatatctcaatatttcacaatagcatgatggaatgaaatactttgtctccactgaggatcacattgcttgtagagctatgttggcttgttctaagtacctatttttgtcattggttgttcattctaaaacagcattgtattgctaaaagtccacaaaacccttaattttgataaaggcacatcccgtattccatttttatcactttggctcaatattcttcatgaacagtagttctataataaaaatactagacaattatttattaaatttaccgatctgaggattattcttgccactgattcttcattttgctttatgtacttttttgtccataattcttctatctgacaagaactaaagaactgaaaacatgcaaacaaaaatctatttctgattttacatttattcagctttcacatttccatattactgttgcttaaattgttatgttgcatttttagagaacagtcacgaataaatgtcagattcaaagaggagagaagaataagagcaacaacttaaaaaaggaagctttaacttagttcacttagtaattaagctcaaagtgggaatgataagcaaacaggcctgggaggcgagaagaggccagccagcttgggaagaacctcatgtgacatgccgaggatgtgcctcatttgttgtatggtcattgaaggatcagtcaactccactcttcgatctatgaagaactagtgtctcagtcactaatacatgacacgtataaaaattcactgcatatagttaagtgtgactactgttttgtgaaagtttttcatattgttgactcctggtactttttcaggcatcagttcaaatcccaccatcttaaaaagatcccttctttaatgtcttcaccactcaccttgtacgggtcccttgatcatatctatgcccttttacactgtgtatatttgtttattgcctgtaccctcaactgtcttatcatcattatattcctaccacctagaatagggcccatttcttagcacctttaataaggttgccactaaatatttatttgattgaaaacacaggattaataaatagaataagcatttattgcttctatacaatatgcctaagatgatgtaattcattgaatatagtgtttctattcttataactctgtaagttggcaagactattttatctgaaactcagagtcagcggtgttaagggtaaggttcatacagctggtagctggcagagacaggaacttcaaacaaatcgctattccacattgcctctctgacacccctcaatgaggattaattaaccttgtttttaaactctaatattatttttgataccacaatatttatcatgttttatgatattaatttgggcatgtttatttctcactgtagattcttatcaaatttattacagactatatcttctgaatctctaacatatctaatattctactgattcacatcagttagcaaatacttgcagctgaaaaaataattagaagtacagattatacaagtaatgagcattattataaactttacaagagtagcatgtttactttttaaaattcaccaattaacttccatctagaaagaaataggaaaaagttattagagcctggttctgaaaaggtggaatttagtgttatgaaaatttgtattatccttgaatatttatattcttctcaatcagttaaatttaagaccacacagaaatatttaaattcgtttcagttaagtgtattttttctttttattttttcttttaaaaaggctgataataattaccagagttttccatgaataataaggcctatttcagattgtgcttttgtgaggctatttttgtcaactattttgtcaacagagttctcaatccaccgacacaaaacatcttctttgggctaatcacccaccctgactgtgtaacttaagcaaattaactgccctaaacaaagggtaatccttccaactaggatttagaagtcactttcttagttctatcagtatctaataatagttttacatttttgtcctgatcaaccacttttcaatttacacactaacactacagtcatcgttgataatctgccaaaataataatttcttttcttttgtttgaatatacctttttaaaagttctcaataaaaaaaaaataagtattaggctttaaattacaatcctttgacaacttgttttatggcattaatataccttgaataatcatgtcatggaggatgattttgataagaaaaatgctctataatattatatgtgtgtaacttgggagtatttatataaggacaatgaaaataataatcaggatactgttttatgttttatcaagaaatgtcaggtaaaaaaatgtggtatagctgagcacggtggctcacacctgtaattccagcactttgggaggccgaggtgggcagattgcttgagctcaggagttcaagaccagcctggtcaacatgatgaaactctgtctctacaaaaattaccaaaattagccaggcagggtggctcacgccagtaatgttagctacttggaacattgagatgggaggattgcttgagcccaggagaaggaggttgcagtgagccaagttcatgccactgcactacagcctggactgtctcaaaaatatgtaaataaaaataaatttaaaaatgtggcataaataaaacttcttattacaacactttattggaacatcctgagaaatcaatcacaggattaatataaattgaaacatgtttacatatttttaaatttagactaaatatatatgatacattatacacattttaggtttacaccaaaggatatgggcatgatattatgcatgataataatatataattattctaaagcatttagaaatcactgttttagaaattcaaggaagctgaaaaaagcaaatgaataccagtaatcataatgtttaaaaacctttagttacaccaacacaagaagtgaatgacttagcattggcacacaatttcttttctccactggctgaaatgccttcactaagaactggaagtcaaaaaaagttaaagacaattgctttgggtcaccaatgtctcaaaatcctccatatgtgcacttatatctgtgaagaccaatagagacaaatatcaattatgcataaatcctcatcctaattctgtaaccagttcccgaaaaataatctgtcataaactgtcttacattctctaatgtctgcatattcaaatatttagtggttatattgttagagtaggtagttaggcaaccaataggtgatggtcaggtggttgttaaactctctctgtaaaacaattattggttgctgccagtgccagggaagacagactgtaataaatagaaaacattgaatctggtgatcagcagtttccagataagatctcaggagttgggcaagtggactcaagcatgtgcactgagaagcaaaatggcagcatttaactggtataggaatagaacattcctctaggaacactcaactggtaagggaaaaatgcctccagtaagcatgtataggacttcagtaaacatgctgtgcatgcggcccctcccaagtgctgacaggccaccgtgcatgcagacagcccaccccaaaggaagaatcagggcagaagtaccacaactccagaagcatgccagtgtataaaaccccaattcagaggtcaaattgcacacttgaatctctcaagttgcccatttggcccttttccagctgtactttatctcctcttgttcctgctctaaaactttcctgccctgaaacttgccttggtctctccctttgcctcatgccccacagtcaatttctttcttctgagaaaacaagaattgaggttgctgcagacctgtatggatttgctgctgctaacagtaccttgatgaaaaaatatttgaaaaaaatatatatgtatgagcattccctgccctcctcctccataagaagaacacttcaagtatgaaataacctgttaggggataaaaaaaatctgaagttgttcatgtctgagaaaggtatatttcttcatttctggagtagattagcataaatacagcattattatagaaaacaataatttgtagccttttatgaaaaagactagatgaccataaaatccattttttataaccagccaattgtgattctataattctctgaggagaggtatactactaatgacataattaaaatgaaagagcaatatcaaattacatgttggtttcctaaactgagtgctgagtgaaaatgccttattaaagagcttggtggtgtatctactgaagcagtatcagtttatttagttgaaggaaagataaataatgttattctaatctcagataaagctaatgaaatacgtcaaattgtagtttatgttttatatttagcttaagatttctataaaatacatggataaaggctaaattcgtggtcttatgtgaagatctgttcatttgtcagccaccagaattgaagcttctttccggaaattcatctgatttacttactttattttgcttttctacttgaaggaagaaacataagaagtccctctattttttctaaccacataagtgaggaaatgctaaacttaatttatagtaagaattctagtgctatttattgtattgtccagtcacttgcttcttaatcgctaggttttagaaactcttgacattttcaattacagcaatttagctagctgattcatgtggtcttcatttaggagcttaagaatccaaagatataacttgttacaggcaaatgattctcctgagtttccaacacaggatgtgtgaatgcctccatgtaattttcatctgattctagacctaccaataacttaccttcttcctcttctgttggaaagaggtggtccagcacagacaccttttgtcttttgctagtggagcaacagagcgctagtttcctttgtgtgggactaaacttcacccaaaaggagaatcattccattataaaaaatgtaaaagtcccatgacttcacatttcattttatgttatctctcattaacaagagtactgctgaggcctcaaacaatgcaagaaaaatactaatcaaataaaagattaccaacaattttcgcagtcataaacaacaaataagttaccaattgtatattatatcacttacaattcaaaagtgttgttttgcacttaaaatagtcctgcctatatatgtacatatatatacatatgccatatatacacacaatgtgtatatatgtactttaaattatattctttatacatattataaattcaattctatataatttaaatacttttaagaaaatcaattaagagcaggtaaaaaatttgaatatgtgtatatgcatacacacaacatatacacatatgtattatatttaagagaatcaaaataagaacaaatattagaaaggaaataaccataaaccttgaacctttgaccaaagaatcaacaaatactaaaaaaatgttcattatgtggtttttatatttcctgtcaaatgatataagaagtaaacatttccatgtaagagcatgtggggtgtgtcataccttctcatggactttctgtccaggttccatcccttcaagatgttctgactctgtggatccctcgcttgatgccatttttctttgtatatgaacattttgttcacgcaaggcaacaatctgcaaaataaaagcactatgcctttaaagtctaaatagggaataaaatataaaaagaaaatgaatttacttcaatgtggttaagaactaatgaacactaacaaataaccagaaagtgaacattacattttactgaattattattcaaaatatgtgtttcaatgtaggtcaccattttgaacaatatttacaaaaattcataatatctctactaagaagaggttaaagcactgtaaaatttacctaagaaaatattttcttgttggaaatgtatctaaaatcaatgatatatttgtattcacgtgatgttaattcagaaattattttttaaattaatttgtaggatgtaataaaaatgtttttttggtctgtatttttaaagtatacaagaaacataaaagattgaaggttaaagactaattatgagcacagcaatttcgcctacactgatagcccatctgcaatttaatataagcagacacacagctgaacttaaaaaaaaatttgtaatgctgtcatgagcatgtattaaatttgttttattattataattttaatgtccattattttaccaaatttagttaatttgcaaacacaaattaagaaagcagttattcttgcaaactttcagctcaattttaatgacataattatttcaattaaaaaacaaattctcgggtacttatagcataagtgatcctagtaatagagtgaaaaatagtatttcagtctttttaaaatgatgttttaaaatacatttgctaaatatatatatatatatcactttgaaaatattttacattatattaatgctgtaacttatttattccatggcatattttattgtattatcaactcagatagtagtcaatattagttctgggagaaataaaggtacatagtatttagtgcacaataagatctgaataatattaaacttacatgtggaaattacaagaccaacatgtcacaagacgaataatcattaactgaaaaaaacatgatatcaaggggttgggtgtttgccctgctacttgacactatttcaatgccatattaccaccatgtgtccatgacatcagttgatctagctatatgatctctggtatttgagcatttggtatatccttctctaggtatatgttcttttctctcgtataactgtaaacaccaaataattggctccctcacgcttactcttgttcatctacaatctattatccacaaagcagccaggtacatctttcaaacttaaattagattgtgtaacccttcagctttctaacaaaactaatgtttggcccagcgcggcagctcacgcctgtaatctcggcactttgggaggccaaggtggccagatcacttgaggtcaggagttcatgaccaccctggccaactggtgaaacctgtctctactaaaaatataaaaattagccgggcgtgatggtgggcgcctgtaatcccagctactcaggaggctgagccaggagaatcccttgaacctgggaggcggagattgcagtgagctgagattgcgcgactgcactccagcctgggcgacagagggagactctgtcttaaaataaaataaaataaaataaaataaaataaaataaaataaaatactttaaaattttgttaaaaaaacctaaagttttcccagcttatttagccaaaatttaaacttcttaacaaggtctatactgtcctacttgagccctttgcttcagcgacactggcctcctttccatccctcaaacatatctgtctctttcttacacagaactgaggaatttgatgatcttcctgtctaaaacattcttcctcagctatcacaggggacacaatcccagctttaaaaacagttgagatacaactcctcagagtgaatgtgtgttgtcatcaaacactttgtacaatatatccctatttatttttgtgcatgtagcactcaataaagtttattattccatttctccacttcctcatttgcttatttatttagctagcacaagtcctaataatatctcctgagaaaataattttcaaaagaatgcttcattgaaaacagcattttcatatgaagtagcacatcaaattattatgtgcagggtattcactaaaaatgtgttgaattaaataatacatggatatgggaaaacaaagaatctaaacctgattaattcaaaaaataacaaaagataaagatttggagtgtaaaaaaaacttcagaaacattcttttcacattagtcaacatggaaatagattacatcaaaggaatgacaagaagaataaaatagctcctagatatatcatttttatattacactcttaacttattgctttttgcataaatattacaattgatacatgagattttatgaattataaattttaaaatattcaagtatcatttgttgacattccactaagaaaacatctatgactaacagaaatgctaatacaaagtaccaggccatttaaaaattatatgctttgttctattattaatctactcagaagtgaagggagacatttaaaaaatatttaaagaacaaatttaactctcagcttacagattagcttacatttgtttaataaacagatgactttcaaatatgtcctggtgcctgaaataaagcaggccatctataaaagtttattgaatgaatcagtgaaaagatgaattaatgtccctattaaaaaataatcaaaaaatcaaattcattcagaaaaaagtacaaatataattgagccactatgatttttaaaattctaaacttcaagtttgctacagtgtatacatgacaattagttccaaaaatgacataattttcaaccactaacatgcaaactttgttttgtaaaaatgaatcaaggctaaaaatgttggctcttgatacagaagaacaaatgtgacatattctatattctctaccactgtaatatgctattttctccaataacaaattatcctgggtagttatgaaaccaaagtttcagcacctgatttaattgtgggtgttaataagtggattatttttgacactggggaaagggggaaagtttgtagttctcttttaaaaattcccctttgggtgttaagcattttcttcaatctgttttaaagagtgaagaggtcaccaataaataactggagcctaaggtagcacagacttctttaggaaattctcttagctggtttgagaagtgaacacaagagatggctagggaaccagcttgggacaataaatagaatgaaaagaagctaatggcctcaaaatattccctaggctctcactgagagggaatgttgtcagaaggagggcccaagcaaattgcctacaagaaaactaacgtaggtctggatgcctcaccactaaacaacatggcctacttgctatggtttaaatgttccctccaaaacttatgttgaaatgtaattgcctttgtaatggtattaagaggtgggacctttaacaggtttttacggcatgagggctttgctctcataaatggattaaggctgttatctctggagtgggttatttatcattggagtgggttctggataaaaggatggagtttgcccctcatcctctctctgtatcatctcacatgcttttatgcccttccatccctctactatgggataaggcatcataaaaactcatgccagatgccagtgtcatgccttggacttcccagcctccagaactttcagaaataaatttattttctttaaaaatcatccagtctgtgatattctgttatagcaacacaaaacagactaagacactactccaaatatgattacatgttgagtaggaggaaccacttatgtacaagtcctgttgtttacccagttcttatataactgtactgaaaaactcactatgtacaagtactgtgctaaactatttttatctgctaagggggtatgattcatatttaacaaatgatcagattaagataaagaaagattaatggggacaactgctatggtttgaatatatgccctcctccaacccccaacatttgtatgttgaaacctagggctcaatgtgatagttttgagaggtaaggtctttaggagacgataaatggaattagtaccaatataaaaggcctcaagggtactagctaattaagccttttgccagccaccttctgccatgtgaggacgcattgttcagggtgccataatggaagtagaaggcagtccttccaaatctgctgatgccttgatgttggactttcctgtctccacaactgtgatacatatacttctattgtttataaattatgcagtctcagacattttgtcacagcagcacaaatggactaagaagtaagagtcaaataaaacttaactccgtatccttatacttcctaatttgtaacattggctcaaatggctccccttttaaatttggggtctactaaatcagaagttaatagcgggctgggataggaagcataatcattttatttccaagggctgatacccttgctggaatcctttgtatgtcattaagattggacgtctccctggacagattcatatggaggcaaagttttgcatatattttcagtgagttagcaacccactgaaggctcatggaactctgttcaagataaatatttcacaactgtttttaatgttcaatcatcatttatcaagtgtctgttgacatttgctttcaggtatcccttcacatttctttgataataacatcttatattttcactggagacttttcctttcttattctaatcccacagagactgtcaatgaaggaaccaagagcccatggcaaatgggtgggcacatgacccaagccagggaaatcagaatattattactttacatgtttctggctgagctatgggaaacgattctctctatctactaaggaaggtaagctggtagaatatgaaaggggtactctttgccattaattcctattcatgcagaaaacacatggaagagatgaggccctaacaaattgcttctggtcctgattctaggcatccttaaatcattcctacccttggcattttagtaatatgatccaagccccaaatttccccttttgtgccccaactcatttgaaatggttttctgtcacttgcaactaaaagtgacttgcaaatgcagcaggaaacatggaagacaatacagagtatgcaatacctaagtgaggattttggagaatggctaagaatttaccagacagacatggtagaagacttttttaggtgtgtagaagatcacaggcattttgtgtttctacaactttgtgttcctcgcactgtaagttgtttaatattcctgtggcaaaaagtacctggaaaaagttggaggaatgatgggactagcaaagctaaagtgcttcaactaaatctcaggcatctgtgtgctttttctctctggcttattgctttgtcttgatccttatttgtgttttctggttgctcataagcttataacagcctgatccattccttctaggcactctcaaacacgttatattttcaagccaatcttctaggtttcattcatatccttgcctctgtcaggttgattttggctctgacaagctctgaccctacacaatagacaactggtagtcttggcggctgggcctccagtctgcaaaattctttagccttcatttttcttttctaccagcttgaacactactatgtcttgcaacagactctcttctagctccttgcctgtgaacaactgtttttctttgatatcctggagagattcatttatctcaaaaatattcattcagcactgatgacataccaggcgttagggaaacacaatgggaggaaaaggcagaaatccttcctaatggaaattgtactctcattggggaaaataagttataaacaaacataagtagagcatatttttaaatggtgttaacagaaaagagaaaatcaaaccaagtgaggaatgctgtgaggtataatttgattacaaattaggtgatttctgagtatgggcttgaggacaagagggaacagcaatgtggatatctgggagaataactttctagaaaatgtaaataactattgaaaacaaatattgagatttataacaatatttcagggagttctttcaatgatgtaaaatgtcctccctaaaagagaggtaaaacatcagtgcaagttgatgccttggagacttaaggaaacatattatcatgaaaaaaatgatttgggcaaaaataacaaagaccattaaatatctttttatgctaaaattttaggatttcttgagggtttaataaatattaatacatttattcaacaaatattcatttgatcactgttctaagtatcacaaaatactgggaaaaatgcagacagtttccttctcttgtgtagattacattctagttaaggaggcaaaaaaaaaaaaaaaaaaaggaagcagtaggactacaataacaaaatagcaattatttatttagctcttataatgtgccagaaactgtgctaagtacattatataaatttgcttcttttcataaactttgcatctacattatcttttctttccaggtttgagatttcttggtaaaagaccctgagactattatatttaatggcaacaaccacaattgcttttgcaccaacctaataataatcaggtacaagtagtttgaaaggtgattcctggaagtgaaacattccttaaatatgcttgaaaggctgaggatgaatcctggcccatgtagttgttgctggttgtacgatcttgtacaagctatttaacctcaagttcaggttcttgttatatcaaatggagggcaaataatatctactttatattgtatttgtttgtaaaatacttagtcaaatttgatgtacattaaacacttgctatgtaatgacaatgacaataatgaattgacttccacttgcctcttcaattttatctttctattcatattgcgtgctctagcttactgaaaggcttcgatcacacatataaaaagtgccgtcttggctgtgagtttttatattcacctgggtaacctttgttcctctttaactgcctcttagtcacttagcttttaagtctttcagatgaattcggggacaatatcttcccaaggagttacagaatgccttagtaatctccagtaactcatgtcatgcaagtgattatcacaactggatgttagttttctcaccaaccattttgacacagtgccttgagactagaaactgtttctgattcattacttattctcagttcttaggacactgactgacaaacaggaggcactctagaaatatttgtagaatgtcaaaaaaaatgatgacaggctacatgaatgaaaaaaaagcatatgaggagttggaaaaattggacagaaatgttcacaggatgtatacatggagaagaaaattagttatccatatagaggaatataagaacttgaaggtctttcaaatgttcatattataggcttcaaggttaaaaaggattctgggtagagctcactggggaaataaagaaataaaagaatgggaaatactgcaatggctttgtaggaaagtcactgctctagcgtgaggaggcagataaagtagaaggcataagcaactgtaaaggaggctagcagcaggatcatggaaggacagtttaatgaaagtcatcaagagttgttttgtaaactcaaagtaataggcaatttcattgcatcttaaaatataacattaaaatgtattctcaagtatactgcagcttaggtaatatgattcacatgcattgaagcacattgtgtatttgctttagatttagaatgaatcgttgtttgtggacagaaaaatggaattctaagagtgtctaagaaactaatttctgccaatagaattttccaataaaaaaggaaaagcaatgtaaattgatttagtattcacttcattttcctttgtctttctgaaatattaatatacatgaagaaatgggagttgagaaattaaatttctaattaagaacttctagctgtaataatagctatgtcttgaacatttattacatgccccatatgaaataaaacaatttacatacattacctcatttaatctttccagtaaccttgtaaatttggtatttttattttcattttacaaatgaggcaactaacacagaggaaatatgtaatatacttgaagtcatacagaaaaagacacaacagagatatttctgattcaggtctgattccttcaaaacattttaaaaatattatgctgtaatgccttttggtaatcagtgaaatgattcattgcatacacaatttaaatatttatcaaggtcaggactacaagtttgtggtctgattgcagggggcttttcctgacctgcgttggcaaacaatttagaagatgtcttcaaaaacatttaaaaggtgtcttcatatattccccaaaataaaaaaagtcatggtttttaccttactgattattttcatttataactcgtatacagcataagcacttaaacttaccctgaaaaaaaattaactactttttaaaataaactacatctacataaaatctttcatgctatttctacagggattttcattctcatgtttttaaattaatatttgtctctacttatttaacaacttccagatagtgcccacatctaattaacaaagattcttttcatctatttttatcccaaattcaattaacaattcccagggtgacacttattgaagtctcactacaccaacacataatttgcttctacacagatacttattctacttctagctgaattccatgcttagattataatgaagttgaaacacacacacaaacaacaagaaaaaactagtaaaacagtagggatttacaatttaaacttaagcaactttcagtcacaatagtttgcatttgtatcgctatttattaattgggaaaccataaaggttgaaacacttatttaaatagaattaagaaacccaagccagtaactatttccttttctagctctgcatttggaaataagatttataagcatcactgaagcacgttaaaaccaatggagagcaacttcatgtagtctgtgcagtttgatcagcttacatgtaacattcaatttaaatggctttcattaaccatgggcagattttgaaagcttgtgacaccaaactgttccagtgaataatcaaattgctttgaggtaagaatgagaggtttgcattgtgagaatttatcttggttcaggtaaaaaaaaaaaaaaaaaaaaaaaaaaaaaaaaaatatatatatatatatatatatatatatatatatatatatatatatatgtttgtaagaatttttactacataaaatacttccactcagtcaactaatatttattggatgaataagaatattctacatttatttattttaaacttcccaccccaaatttggctgactagtactcccaattcctatacagataaattacctaagtgctaaaatttaaatgcacattaccagtaagtttctggtgaccttttaattgaaaatacatcatataaaaagtacataaatttggctatttccaaattttacatctaaactagtctttcttgtatctaaatacacatggaattcaaactcagttagtttataatgattaaaaaatcctctttaaattaatatttaaagggttttttaaaaaagaaatcttcctaaaacagtaactggaatgcaaaactgttatttttagttttaagtttaaaacagaatgattccaatagcaaaaaaaaaaaaatcaaatatattctcaggtagaaagttttgcttttttgcaggagatgtttacactatccatttaacttagaattataatattcaacaatagtaattttgacaatagctatactttgtcattgttattaacatgtaattctaatgaaaattacaactttgtactaacatctctcttctttttgtctaatcagtatttcagtcaatacattttctgatgcttgataatgcatcatttattttaaccatctatgtagttccctaataattaaaatgacaataaaataaaatactagcatcttcattagaggcatgtaaaaggctacagaatatacaaaacaatttatattggtcagaagaattagtggacattgttaaggcaagactgttattttactaggttagcaactaagagtggcataatatggaagaatagtaagaaaaatagccaaggaagctgttaatacaggaaagtgaaagaattaatccagagaatgaaagcaaacaccaatttctaaacagtttttcaaaagtgttagtggtaggaaaacacattcttaaccacttgtatgtatcactgcatgaaagcaagactcaatttagaatatatataagcagataaataaggaagggtagagagtattcattaaggtaaacagtactgagaagtgccctaccaaagataaagaaactgcaataattcagtgttgagtgctgacagtattggcagtaattgcgttaaaagttttgaatttcataaagaaaatatggtaaaatctccatcaccaaggaagatgctattgctaataacttctcacctccttgaacaagacagaaaaatcctattcaaaaagggaaataggtgtctcacagtgaaaacagcaaacagaacttactgaaggtattgattattataaagtacttctttgtacagaatggaggctatcttgattcatactggttcctcacaatcactcccacagggctctttgccctctaaagtcagaggtatcaaaatctgctaacttggtttagtttcagctaagggcataaatgacaactgactgcagtaattaattatctccccaactacaataaaaaggaaaagcaaaattaaagatactgagttaggctgagaagagagtgaatgcaaactaaataatccaatgtgtgtgtacgtgatcattttataaagcaggaaacatgctctgtgaatgagagcatttgttttcaaaagtctcaataaatatttatttttaaataaaatgaaatgttaatatatgactaaaagtttatatttcatttactttatgtatgctaagaagtataaaaatactttgagcaaacactgttaatagtattaaatttaaaaagataaatctgccctattctaatcatgtctttgtcttctgtttattcaagtgtattccatttgctttcgggaatatttggatgttttagaactaacattctgctttaataatccaaacacactataattccatcaatttgagtctcttaaaatgttacactgaaatgaatctctctgaagatggacttattgatttctatattcttcctctagcatcatgaaatttgacctcttcagccgtgcatggttaacactgtaagtatacatgtgtttttttgttttttctccaatcatggcaaatgtgtcgaaattataggctgtgtcctagatctattattttagttctattatggcaaagaagagagttttagggaaaagcgtttcaaagtgtttgaaaagtgcttgaaaaaaatatagaaagcagaaacaatattcattaatcaatcttgcatataacaaagcaagctagggcaataaaaaggatttattcatttagttcctttcttagaaataacaaaagcatactaaacccattgttctggccaattccttttaaagtaatccatttacttcagttctaatggtaattatcatgttacatttatctgtacccatttccattttatttttatgtgatttttaaatgtgcacatatcaaaataatgtcagtatgagaaggaagcagaacttaagtggtctttacacccttactattatgaataaagaaaatgagatttacagagaatagtgataattctatttgtctccaacaaattgccatctagtcagtctcactgtagacaggacactctgcctccctaaatctcagttcaattacctttaaaggagatggatagtatcatatctaaaaagaccacaatgacattaccaaaatcaataataagcataatatttactgaaagactctttatgccaaccacagttttacgttgtttgaatgtattaattaatttaaaactcacaacatcattataagttattattatggttcagccaattaaggtaaaaagaaaaaggaaattgcctatggttacaaagctagtgaatagcagaatgacttagggagaaagtaagtttcacttggtgggcgttatagctcctctttggagtaggtttgtctctttccttagccttctatttccagagtagaatatatttactggaaccaagtaaatactctatttagaataaaggtttttttatttaccacttttccttacttgccaacgctaatttctaactactcaaagctatccactttccataaaatatttcatacttttattgctccttatttctgtttttgtcagacctgcaagctaaaaattgttttgacatttttgaatagttgaaaaacattaaaagagaataatattgtgtaaattataagaaattcactttcagtgtccatgaataaattttaattggaaaatggccaaactcatttgtttacacattgtctatgattgttttcactccacaatggtagagaagttgtgacagagaccatctggctcataaagccaaaaatatttactagttggacttttaccgaagtttgctgatacctggtctagtggttcttgtctatctctttaaggaaaaaaaaactgttcaaatggatacagttaaagtcagaactataactaaaattcctgagttttaggtttatacgttgtttctaatttccttcacataagtacaaagaaaaaattacccctgaaaatgaaattatttgatagtgataatgtgttttttcacatgctattttgtctactcatgtctaaatagcagagattcagataatataatgatgttggttaatattaaaatggaaacagttgagagaacacagaaaaaaaacagtttaaaattgaatgtcaattgcattttcaatattctccttctatagaggtgaaatttatttcaccgaatttatcagtatataaaaatagttttaacttatatatttctaatataagacccttaaggaaagcagtttattctttggttactgatatgcccttgacatccaaaacattgcttggtatccaccaagtagacagtataaagtactgattaagattatgatttgtgcggtagaattctggttctaccacttactaacactgaaattaaaccagttgctcaactacgctctgcctcaattttcctatctataaagtaatgatgtttgcaacatcagtctgaaatgttattcatgaaaaaaagaaaatcagttaaaatatataaagtacttacaagagaacctcacatgttgtagggaatccataagtgttattattgttgtttttataaatatttattgaatgaatgttcttacaataaacataaagtctcatgatattgcccttgtatacacgttttgatttaatcatgttacatggtattcatttttttctgtttttttattgtaataaaaattttaacttttctaagatggaatcccagtttttcttttgctataccttgtattgtttgaaagatgtcagtgtattatttcaatacaaataatatttcattccctagttataatttcactttttatatttaactcatttttcaccttatttatgttggatattcaagtttgagaaggaataaagagtatatacatgacttctggatataaattagctttaaaaatgaagtggtttggccatgtgcatttgcatccatatccaaatccatagccatgccatatgaacctgcattccagacctagtaccaccattgttcgatgtatgttcacagttcagacacaggcaccaagaagaatcccctctaccacaacttctcctgtgggtgaaaaggaaagcaggaggacttcaaaagctttcatgactggggaccctgcaagtcattgctgcctttgcagacactctcagccttgtctactaaaaacgctgtagtcttcaccagtgctgacctcagctgatggaactacctggagtctaactgctgcccactcctggagctggaacagccactgtgtccttcagagaagaagctaccatacccacccagttggtggcttcataccttcccataggtgaggtctttccttactgaagccagtacataaagtttaaagaggtgacaactccttcaaatgtgcagacatcaatgcatgtctatgagaatatgaaaaatcaagaaaatgccacaaaaggaacacaataattttctagtaactgaccacaaagaaatggagaataataagttgcctgacagggaattcaaaataattattttaaagaagctcagcaagctacaagcaaacacagatacacaacttgaaaataatcagcagaacaatacatgaaaaaaataaaagttcaataaagaggtaaaaatcataaaaaagagtctaacagaagttctggagctgaagaataaaatgaaaactacaatagagtgcttcaatagcagacttgatcaaacagaagaaagaatctaaaaattcaaggacaggtcttttgatcttaaccagtcataggagagaaaaatgaaaaaaagggaagaaagcctatcatatctatggaacaccatcaagtgggccagtttatgcattatgggagtcccaaaaagagaaaaagaaagaaagaaattgatagaaagcatatttagagaaataacagctgaaaaatccccaaatctcaggagagaaatggcatgcaaattcatgaagctcaaaagttcccaaataagatcaaccccaaaacactgcaccgagacaaattataatcaaattatcaaaagtcaaggacaaagagattagaaagccaaaagaaaaaagcaactcattatgtgaaagagaatccctgtaagactattagtagatttctcagcagaaacattgcaggccaagagacagtgggatgatatattcaaagtactgaaagaaaataactgtctaccaagaacaatatatccaacaaaattattctttaaaagtgaagaagggataaagtctttccaatacaaatgaaaattgaaggagtttttcaactatagacctgccttaaaagaaatgcacaaggaagttcttcaaattttaacaaaaacatgctgagtagcaacatgaaagcatgtaagagtataaatctcactggttaaggtaaacatacagagaaatggaggttaaagtaacattataattgtattgtataaattacttttaatcctactataaaggttagagatacaaaattgttaatggatacacaatataaaaagaaactctaactacaagaacacaaatcgggcagagtaaaaaggggagtaaaagtgtggaggttttgtattcaattgaagttaagttgctattaacttaaaaaagactgttgtaactacaagatattttatgaaagctttgagctaaccacaaataaaattcccacaatatacataaaatatacaagaagaaaaaaaatcaaagcaaataactacaaaaaaccatctaattaaaaagaagacagtaagagagcagagagagaaaaatcaatggcaaaatgtatagaaagcaattaacaaaaagaaattagtaattcctcacctgtcaataattactttaaatatacatgaattaaaatcaccaatcaaaaggcatagcatggctgaatggatttaaaggaaaaaaataatataacaagatccagtggtttatttttcataagacactcattttacatataaagacacacacagtttgaaaatgaggagctgaagaaagttatgttatgcaaatggtaaccaaaagaaagctaggggtagttatgcttatatcatgaaaagttatgccatgcaaacggtaatcaaaagaaagctgggaatggctatgcttatatcagacaaaatagactttaagtctagaactgtctctagaggcaagaaggtgattatataaacaggtatatatatatacatatatatatacgtgtgtgtgtgtatatatatgtgtatatatatgtgtgtatatatatgtgtatatatatgtgtgtatatatatgtgtatatatatgtgtgtatatatatatatatatatgtcattttcatgagatctcagatgaaaacgagaaacaaggtattggaaactaaagtaaatgccatcctgttacacctctgcaaagactagtagaattgtgtctatattattggactttatggaatgaagaacttaagagtgaggaactatgatatctggtgaaagaaatatctaagcagcaaagcattcaccctgctgcatgactacttttaactgtttacagtgaagtgtgacagaaaaggattgtcttaagggcagaatttataattaaaaggaaagcagagtgaaaaaccttggaaaattcacagcatgggaaggtaaaatgtgaaaaaatgtggccaagcaaccatttgctaaagaaattactacagatggaagggagtcaagggctactctttaagataaacaagtcacttcttacatggacggcagcaggcaaagagagagctcatacaggagctcttataataaccctcagatctcatgagacttattcactatcacaagaacagcacaggaaagacctacccccatgataaaattacctcccattgggtccctcccacaacacgtgggaattcaagatgagatttgggtggggacacagccaaatcatatcaccactcattaggctctacctcccaaaactgttgcactgggattaagtttcaaacctatgaacttttgggagatgtattcaagccatagctttctgcccctggttcccaaaattaataaatttaataaaatcagacatgaaagaggagacattacaacgaatgcctaaaaaatataaaggatcataagagactactatgaacaattataacccagcaaactgcagagccaagaaggaatgggtaaattccaataaacatacaatctgccaatactgaatcaaaaagaaatagataatccgaacagaaaaataacaaataaggggattgaatcagtaataaaccaacccaaatatgtccatgaaccaatgccttcacagatgaattctaccaaacactgaaagaggaattgataccaactcatcttaagctcttccaaaaaatagaagaagcagtaacacttaaaaggtcaggatcccctaattccaaaatcagagatactacaagagaataaaattacaggccaatatttctgatgaacaaacatgcaaaaatcctcaatataatactagcaaacccaatgcaacagaacattaaatagatcacatatcatgaccaagagagatttatctctggaatgcaaggatagtttaacatacacaaatcaatcaatatgatacaacacatcagcaaaattttttagaaacagaattatctcaacagatacagaaaaggcaaatgaaaaagttcaacatctatttatgaaaaatattctcaacaaaattggtatagaagaaaattacctcagcacaataaagatcatgcgggaaaagtacatagctaacatcttaatccgtggagaaaaactgaaagctttccttctaagatccagcacaagaaaaggatgcccacttttactacttctttttgacatagtactgaagtcctagccatagcaattagacagggaaagaaaataaaaagcaaacaattggaaaggaagaagtaaataatctgtatgcaaatgacatgaccacagacataaaaaactgtaaaggctcactgttataactaatatctattttaactaataaacaaaacagtaaagttgcagaatacaaaatcaacattcaaaaattagttgcatttccacacacaaacaacaatataaaaaggaaattaagaaaacaacccccttaataatagcaatgaaaagaatcaaatacttagcaataaacttaatcaaagtggtaaaaaactttaaaatgtattttaatatctgtgcattctagggaaaccccatactcaacaatcttttaattttcataacattattaaatgttttacattaatatttaataaggaaatttcagaattattttatttaaatctcaaaaccattatattagaattttgattgaattacacctataaaataacttgggaaaaatagatatctttacaatatctagctccagacacaaaaatgaaactgttgtttccatgtatttaggacattttgtatttcctaaaacaatgggatttgctactttagctaaaaatttctaaacataattcagtgtttacatataaaatacatctatatatctatctttatagttatttgaacgaaatatgcttttcactaatgctttctatttattgctggtgtgggaatactactgatatttacatatacatttttatattactttattaagttcattaataaattccaaacattctttatgttttgtgtgttctagagtctgctttttgtacattaatattcattctcacattctttagcaatagaacttttgtatatggccatgaaaatagagattgcatgtcctggtctcttttacagcttagagtgatgtgagaccaagttttcttcaatggcatgtaagtaagagtcatgtgtgctacttcctgatctcgcccttaaaagttttctttatatgtttattagctccctataatacctgctggctggaagtagtgccatctgtgacaggcactttaacccatacagcgtatttttatgtccctcagcccacttgttctggatacaacagacatatcagtgcaggtgcaaatccatctaattccatggatagatacaaatgtatgcttcttggaataagtgttgattaaccaaaacctggagaaaagattttaaaaggagagattagaagaaatgaatacatccaagaaaagggaaatggctcaggcatttactaactatgtaattcaggtgaattactttaagcattagaaccatattttctgcatctttaaagtggtgatagtactccctgttttaaaggtgattagataatcgcaagatctcaatacattttcactgttaataacagcaataacctcgtaatgtggggatccatcaacttgaaggtagggaaaggtaagtaagtggttggagctttctgagaacgataaaacagcacttacataaatatacttgactcagccttatgcctcaaaaacaccagttgcctttcccaaacttgctagtgacagtattttatttttttatttattcttttttgagatgaagcctcactctgtcacccaggatggaatgcagtggcgcaatcttggctcactgcaacctccacctcccaggttcaagcgattctcctgcctcagcctcccgagtatcggggactacaggcctgtgccaccatgcccggctaaatttttgtatttttatgtatttatttacttatttttagtagagagggggtttcaccatgttagccaggatggtctcaaaggtctcgaaatcctgacctcatggtcacccaacttgggctcccaaagtgctgggattacgggcgtgagccactgcacccagcccctacagtattatttaattgttttgtaattttcttttaaaagactctctctctctctgcactggctttacaaaacttccacgacacattttctgattgtactgtaagttattttcttccttatctcccaatgacactgttttctacatgaaaaataccattttggctttatcaacatgttattaattcataatatgagagatctatcagcactatttgtaaaaatattcaattaaaaaaattaagatgatttatagttgtgtggtaaagaatttgaccttacccaaaggaggtcaggcttttgccctcagccttaaggagataatcttgtcatacccaataaaagtgttattttaaagtgaggctgactacacctgataatccagcttgagggacagttatgccagtttgaccaactagatgatttagggagctttctctcccaacttcaaagctgtgatgaatcaaacaggtaattaatcgatcatgcttatgtaatgaagccttgattgaaacttcaaagattgattgacgttccttggttggtaatactctgtcatgtgtcaattctagaagggtaatacgtcctgaggataacagaagctctgtgtttggaatcatcctggactctgcactttgtttctcctgctttggctgattttgatctgtaacctttacctataataaaccataactataatataatagatttcagtgagtgctgtgaggctttctagtgatttattgaacctaagggtggatgtgagaatttcctgaacttgcagttggtatcagaagtgagggaggtcctatggaggactgtgccctcagatgttgcagtttggctaaactcaggtaatagtatatggtaaataccaactgatcaagttatatttgttttttgctaggaagttttttaaaagtaaaatcattagcagtcaattatcaattaaaaaattaagtcaattaatgtatatctttttcatccatcttatttatttatttatttatttatttagtgttccaagagttcagttatttggaacttccacagttttcaagacttgagagctattgcactttcttgttaaaaatgacatgggaacaaataggtactgcagaaatcctttcatcttgtttaatatgacctgaggtgtcacattttctatatttaaaacatagtggccactgcaatgttctcatgctatttattactattatactgaagtctatactgtgatataataatcaaatgtatcttaaaaactgtaaatatctggatgctttaattaatcttttatgtatagttaaatgttaaattttatcaaagtatttggcatttttaaaggtagtttaatttgattaattgattgaatacatgctttattgatttacacattttatgtctctttcagtgtaatggagttataaattttgagataattcatgtatatatactagatatgaagatatcatgatggattcaaattactgaaagatgaggaaactataccagttttatacaggaggaaatattgttgggagaaaggccaggtgacatagtaactacaccgaaattgaaagtcagacatcttggatttggattcctgtcgactagtgataacactcagaacaattcacttaggttctatatgactcaatttcttaactttcaaaatgctagtaataattatccttttctcatacattaattatgataactaaaaaatgtgtgtgggttcggggtattgttacagtccttactgtagtaccaagcacacagtaacctcctctaaaattgcagatgctattatttttatcaaacatgtgaataagtgaaatgcaatatcatttataaaatgcatatagtgctacagaattattctatgaacaaataaggtatttgtttattcacaagaagaagatttcaaaatacaaaaaaaaggagatgtagtcgtgggtataacataaagtacagagtactactatcatttcattttttatcacattcaaagtatcaacagaaaagtattttcatttgctcaactaataactaatgtttacttttgagtccaataatagcaatacaacttcagtatgccaagtttacaaagtgcttccctgtatattgtctcatccaaatattacgacttctttgaaagatacgtccaaaatttactaatacattctatttcatggatgaaaaagaatgaggcactgagaagttgaattaattgccaggtgctatggaattagtaaatgatagctctataattcaatcttgaatcttctgacttaaagttaatattctttaactttttatcttgcctctcaccaaagttcaatatttcatctaaatttctaagcaataagtaatctttctcaaaatgttagcttaaaaacaataagaataaatatgggtaaaataaaataggtcaatttatgatgcttatgatcaaagtattaatatcaaacacgatcttactattaatagagaaaaaaagcattcaaaatctccacatgcaacaatagaactatgtctgctaccacaaataaaaaaaaaccttatgctctcatcaaagaaaatattctaatcaaaataggagagagtctggaaagatttgcaaacaaacttcaaatgtcttatacacagtaggtgacacttttaacttctattttagataattgcttcacacaagacttggaactagtaaaattagtggaagtagcaaacagcaattttgttacctatcttctttgttggattttaacaggtattgttataaaacaccttgattttttttgtctgggaaagattctttgtattataacagtacaatcatcaacagcaaaagatacattttctattcatgataataacttggacaatttacagtttattcatttatctttataatacaatatcatcataaaggataatcaagaggtacaataagaaatcataggtctttgtaaataactactggtttaacaatactgaaacttttagtttaccaatctaaaattaaaaaaaaatccattgttcaaccattattcaacttttctaggaaattaaaatctatacaatcttctaaccaaaaatgatacatttccaacaggaataatacgttcccaataagtgggtcttttggaatctcacaactgttggcaggcaagctaaaagcatagcatcagacagttttgcattatctttaaggaatataagttcagagctccaagggtgtcactgtcctatgcaaacactgttgtcattaaacgcatactgtcatctggtaagtttagtcatggcgacttgtttcaattgttaataaaacaaacaaacaaaaaatctcttttatctgactttctgttcgaatgttaactgaaaattggtcatggaatttactaatatgattcctaatgtttaaaataagctaatcagtggaattagaatatgtagcatgcataaacatgtggaaaattagaaagtcattatgagagtaatcatttttataaagcagtgatagacatacaaaattaaatctgctttcatctcccagaactgaggaagagatagaatttaaaaatacaaaagtgagtaatttgcaaaggcccctcaaaagaaatgattcttatttttaggattctgaaataatttaacttaagagattttgcagtggtctctttttctacatctggagctttctactcacagatatggcagttttaatttgaagagaaaactgacttagtcacttgattaatttttcaaataaacgatcctataacttcagatgagtatttctattacttccctctaggcaaattccttaatagagtattgttcagcaaatctcctactttctccatgtttttctgcataattatcagctatttaagtttcttttaaactattcaaatatagctgaactactcatggatttcagaagttccctaatttttacccgtgtcaaattttagggaaaagttataacactgattttattctaagtggccaaagcaatcaaagacaactttagctcaatatttgtatctcttccttttgaattatgatgaataaaataactttatagatttaaataaggaaataccattggagaatccatgttgtttcagttgataagagctgtgaaatactggcttttatttaatttgctggggtaacttaatgagaacctcatctgggtccaccatcccatactaaaatttattcgcttagtcttattggttccttgctatgttctatgttgtctcgtttacagtctccttagttcctaaaaagtaactctgttctcactttccttagcagataacccatctccttgagaagaacccctgatgaaaaagaaatcctctccaaatcaatatcttcattcatcactacactacatgttctattttccttcctccatttctcagaggaaggagttctattacttgccattgatcttaaaattatagttatcctccactgtgctgccatccataatttcatgtccttcatttgtggctttgttttcaatggctataagcattttcaattttgtcccattataacaaggctgtcactcaatactgtctggaatcattcagcatataccctctccttcccttcgttgctgaatttctcaaaagagtattaccttctttcatttatctgaactcatacatacttttaatcgcagctattctactttcattagagtttactgcaactatctctgtaaacatttccagtgacctcttaagtataagtgaaatcatttcatatcagacataatcctccatgccttcaagaaacattgaacacctccaatctttatgcttaaaactctctctctctctctctctctctctctctctctcaatatcttgctatctcactacttctatctctaatttggttcagtgactcttgacttgcttgagtctcatatctctccttccttcattccagccttttgcttttagaatagcttccacctttgcctgtatctattcaccttttccagttttccatttaattccatgcatttaacagaatactagttgttaacctaactcaaaggatttgggggatgattacatggaataatgtgtatgatgcaatggctatgatccatgggcctgtaatgcccccaaaatgtgtgttgctgcctctatctcctttcaacatcctgatgcaatatttttctaaatgtgaatattacttaatacgcccatgcaagttctttaatttttccttaggaaaatagacttcagagataaagctgattgtagatgaggtacaataattgttaatttccttggaaaattctaattgaaaattggtaaattcagtggttggaataagtatgcacagagtaaaggcaataaaaaatatagttcagcctgcaactacacttgccagttctttttatgtataatgtaatcatgtggaaaggcttttaaaataagcacgcctgtgtattcactgcaaattagtctgtcaattgaatttttacaggtgcttctgaataatccatttcgtctggcttaattacataattttaaaagtgtacaggtttctgataaaagagaacacattgttaggatgtaatctatttattaccccttgtacttccctttattgtgcttttttttggctttccaattttaagcaataacaataatactctgcaaaaaaataaagactttattgtattttctgtgtctaaattgtctgggctcacttttttaggacaatggcctggaacatgtaatcaacattaacaatccaatctgcctaagtggggccattcaaaaaggcctaaaattacaacacattttcattatgtatatatttatttacaatattttgtttgatttttaaaatttatatttgccattactaaaagaacataagaaatgccacactaaataatacctgtggtctactcaatgctgtattttctgacactgtccccttgattcttttaagatcatgaagattcttttaaatctatccttaaacacagtaccttgaccatctaatacatttcttacctttaactttttgagataccactagtctataaaaccgaaaatccaatcacatctcttctcttcctaaaaattctgttggctcactgctgtctgcaggacaaagcccaactctagccacccctcactcagatctgcctctctctgtcacctcctccccaatcctacctctacctgcttctattttctttctccaagtccatctggtgagctctttatagtcacttttgtagcaccatctgtttttcctattcatacccctacaatgaattcctccctttggtaatattactaaaccttgtacctacttttatattcacattagtcatactgtattataattatgtttactgtgataaaacaagataaataattagttttttaatcatttttaagtgtgccctttaagtactactcaatggcataaagtacattcacattgttaatcagccattaccatcatctgtcttccgaacttcattcatcttcccaaactgaaattctgtacacattaaatactaactcttcattataattgctttttaacaaatagatagggtctcgctttgttgctgaggctggtctcacactcctgagttcaagcgaccctcctgcctcagtgtaacgagtaggtaggatttcacatatatgccaccacacccagcttacaattagtttttaacattaacaggtctatctcacatactggccttcggagcagaactaactttttttttttttttttttcaatacagagtcttgctctgtcacccaggttggagtgcagtggcgtgatcttggcccaatgcaacctctgcctcccgggttcaagcgattctcctgcctcagcctcctgagtagctgggattacaggcacgcaccaccatgcccagatgatttttgtatagagactgggtttcaccatgtaggtcaggctggtcttgaactcctgacctcatgatccacccacctcggcctcccaaagtgctgggattacaggcgtgagccactacgcccggctagaactaactatttacaaatatgagtttgttaacatatttatacccagtacttaatgaaatgcctggcaactggaagatgcccaataagtatttgttaaagtaccatgattagaatcacatattatattattatgttaaccaaacgcatcaaattatgccaactttctagctctttgccacgtcagccttacactttacaaaaaacaaacattaacaaaaaaaaccacacaaaaacatacctttaatggttttcactttaacaaaaattaaaaaaaaaacagaaaaaaacccataatattacctttagtgctttctcatttcagaaagcataaaatctacaaatttttagctcttcagaatctggatcccatcaacctctttaccctcctcttctgtatcttttcacaccctgacttttatcaatgcaacattccttattcttgaaacagcagtttcagattttcttaatcattctgtctcctcagcctgaaatacttcccacagttttgaagttaaatcatagccttccttcaaggatatactcaaatgctgtctttttaggttgaagtcttctccgatcctttggcacagaatacgcttattctctgttcccttctgtattttgcttgtgcctgtattttgtatttagttagttttgcactaaattacatgttagttatacgtgtatacgtctgtctctttcactagagggcaagttatatgaaaatttacttaatacctcatttattttctttctttccatttcttcctttcagagactctcaaaattttctgcacatggtagagattaattaattaaattgaaagacgaaacaacttgttcatttgatacatatgatcaacatattgctgtttattgagcatactgaatgttgttcaaatggttcattaagagaatagtcaaagaacaacatgaaaacactagtcagaatgaagtgtagataatgcaatttgacaaacatatattgatcaagaggttcatatcactgttactgagtgaaataaatataaaggagagagatgaagtctatttctcagtaaactaactacataggcttacacaagtataaaattaaccctaatacttgttgaacagtcgtaatacaggctgaagtaatgagctttagccattaattaattagcctgttggcaaagaattataaaatagttcattaaagaggtgacatctgagcttgagcttaaatgaggaaatatgttttcaatgagtgatttggggttatggaggtattccaggaaagactttagcataaataagatttagagttaggaaaaatgttgccttctttaaaaaaaaatacactctatgacttaaggccttagaatgactcaggcagagcagtaggggtggtggagttaaagtagaatctgtaggttaggaacactgaagaaattttcgatggtatgttacaagtctatgtaacatatatcactatattgttaacatatattaatatagcataatagatcattatgttatcagtgtattaatatggcatatatcatatataagtacatattatagatgagaacatattacaaaaataatcattataattggggcttcacttagcaagtttaaccttgcagaattacacagcaaaagagataagcaataagaacagataaaagcctactgtaatatgtcaggtgagaatgcatgaagacctgaaatattgtaattttaatacatatggaaaaagatgagagtaaacagatatggggaacattatagacacaattatatacataaattgaaacaacctgaaagcagagagttaagacaaattcaaagataaatacattttcaagtaggagggaatagcagtacattaggagaaataacttctctggtctcatctgtaaaataatagtatgtaccttccagcattagtgtactgacatatatgtatttagcaataaatattaactatgattactattaagtgctccataaaatgatctagtattgatgtcattatggacaataaaatctgactctaaaacaactttattattttatttgtttataagaataatgaaaagttattaaaatttcaaacactacagaaacatatggtatatatacttgcaaacaatggagaaaacaaataataacagtttggcacttatatctaaaactttttctattcctgtcataatgaattattattattatttatatttgaaaaatattgagattattctatgcaacttcattctttttacatagcagaatgttttggggctttttccagaaaagaacatatagtagttttgtattctttttaatgaggcaactcactttattacattaatgtgccatatagaatctaagaggacatcaggaaaactaggtggcatttctgacccaccagagcataaggcacttttgtgtaaattagaaaatgtactccttgtaggtggctatgtcctctggtgcatgtctggattagcaaaccctgagctatatttcagctcccactgacctccctgctggaaatttgtaggagagaataatctatacaataattaacaaagccctgtggcaatgccaaagggatgtttgaaattttctgtagagctcagaagagtatataaactttgagctatagattttagtttcttttctacagaagtcatggttgaattcctggatgtctggggagaatagatgagcgatcaatgaaagagattatataaagaaaagatattaggaggtgataactccaaacccatccgtgagaataagacaagtggtggtggtgggaggaggagagagagaaagagagagagagagagaaagagactctatatataataatgatagatagatgagagaataaagcatattaaaatcatataatgatgatagaataaactgtatggtcttttcagattctacatatgcatatatgcgtatgtatgaatatatcaagatatcattcacaatctaaatctcttctcttaattatccgttctgaatttgggaattgaattaattcagaaaaaaatgtttggataagattttatatctaaactgtcactgtaacaaggagaaactcaagaaccaagcagattatcataatatagcacccttactcttcaagatggcaatatgaactcagaaaacaaatagatttgaatgttaagggacacttgtaaatacattttaaatttaatttaaaatctgaaacgttgctgggtgaggtggctcatgcctgaaatctcagtgctttgggaggccgagttgggcagactgtttgacccctggagttaaagaccagcctgggcaacatggcaaaactccatctctataaagaatacaaaaaaaattggctgggcatggtggcatgcaactgtagtcccagctactcgtaaggctgaggcttgaggatcacctgaggctaagaggtggagggtgcagtaagccttgatcgtgccactgcactccagcctgggcaacagagtgagaccctgtctaaaaaaaaaaaaaaaaaaaaaaaaaaaaaaaaaaaaaaaaaaaaaaaaaagttaaatctgatgcatcagataaacgtttctccagctccttgctcatttagtcatacgcaggacttttgctctggttcctgattattcggctcttaataattttttaaactttttcatgaaaatttgctctttttttaaaaactatcttcttcagttattgcctccaacattcaaaagtcacctagttcttatcctaaagctgctaatagtatgaatttttctaaatgtattttatcaggtttctaaatatatcttcttatcatcaatacatgatgctttacttacagtgatttcttataccaattgctcttactatagagaatcaacaactcaaactgcaagtgtcttctgattttttcgtaatttcattttgaaatatcaattttattaagaagttaaagttgactcttttctaattactctcttaaaagaatcactattgataagtgatttattattagaaaactaaagtaaattttctttatcactgggcttgtgaatttctaaatagggattcgagttaagccacatggacaatagttaaaatcaacaacaaaaccaaaatggaagttaataatgagcacgataattactaacagacgtgatttttacttatgcaagtgactcttatttgtacaaatgattttaagcaaaacaaatggcattcagaaaagtctgcagtagatacacaggagtgctaaaaagtaaaaatttattttatctatgtaaaatcaatcaaatgtaccacactgcctataggagattataataatactcgagggataaaactctattccagaaaacagtcgtaaatctttcctccacttttgttctcaagggctgctgttcaattttatgtataattgaagtaactacttagttgctattcctggagcaaattttcagagcctcactttgagacagagtctggctgtgttgcctaggctggagtgcagtggcgcgatctcggctcactgcaagctctgcctccagggttcacgccattctcctgcctcagcctcccaagtagctgggactacaggcacccgccaccaagcccagctaattttttgtatttttaatagagacagggtttcaccgtgttagccaggatggtctcgcttgatctgcagacctcatgatccacccgcctcggcctcccaaagtgctgggattacaggtgtgaaccaccacacctggcctatgggacacttttatttcagcttactttagccaagtggtctcatcacacctttgtttatgacaaacagaaattctatcacgttcatattaagccatgcttttataatagtagccaccaaactttttgtttgtttgcccttatcaataaaatattttgagaaatgcatccaaaatgaatgtaattttatcacatataaaaatcacaattaacattaataaaatataatatgaatacacattttacgtttttttctgatagttccaggaacaagtacaccccatcctgaagataatttatcaaccccatctctttcaaagactgtgtactccttctcattacctattattccagaggttcttttcttctatgatgactgagaggtaccaatctcttatttcttttttttttttttcccccaaaccatcctgtttactaagctgaatctggtcatcaaaaagttttctttcctttttaaagatggctatttcatcatttatggttttaacactactagcctttaattcacatagagtttactctcctactagctgaaagtccattatttctaaaggttaaattgttatggctgggacaaagaaaagcatatatacactcatttaattaatctagcttattttgaagaacaaaagagtggctgggcgcggtggctcacgcgtgtaatcccagcactttgggaggccgaggcaggcgaatcactaggttaggagttcaagaccagcctgaccaacatggtgaaaccccgtctctactaaaaatacaaaaattagccaggggtggtggcacatgcccgtaatcccagctacttgggatgccgaggcagtagaattgcttgaacccagcaggcagagagaggttggagtgagccaagattgcaccactgcactccagcctgggtgatagagcaagactccgtctcaaaacaaaaaacaaaacaaaacaaaacaaaacaaaaaacaaaggagtttgtactgagaagatttattgagtggtttgaaaatgtgtatttgtctgtatgcataatgtatatgtaaacattatcttgttataaatccctttataagacttatctttactgatattagcctcatatatttttataaatctatttatatttacttattttttattgatccataatagatgtacatactttgggggtacttgtgataatttgatacattcatataatgtgtaaagatcaaagcaggttatttggagtatccaccacattaactatttatctttactttttactaggaacatttaaattctgtcttctagctattttgaaatgtatattagattaatgttaactataatcaacctactgatctagatctatggaacactaggtcctatttcttccatctaactgaaaatttgtacccattaatcaaccctcttcattattccctcccctctacccttggttatttaagagtaagaagattttgctaatttatattagtatgtccaatactagtaataccaatattacattactggaataaacttgtaggaaaaatgcagccttataaatgtcagagaaaaagagagatgggactattttaatggctgacacaggttaaacttctctctctctctctctccctctctctctctctctctctatatatatatataattttattttatctatgtaatatcaataaaatgtaccacactgtctataggagactataataatacttcagggataaatatatatatatatagttttatatcttaggtattatatacatacatatttagagagagataaatatagatagatacatgtatatataaacaaatttatgtactctctatatatacctaattatccaagataatttgtgcgttaaaacccaagagaagtaaaatcttccgaagataaaataactctttaaatcttaaaaagatgattgaaaaaacttttttgggggttgtgaatagtagcagaagtggattcagtgacgtcactaaatatgagtacagtgcttttagaagataagaataggcaggacctgagggcaagtatatctctccaaggagttcacttttatttgtagcattttctaagtttaacagttatttgatatgtgttccaattttgagctgtgttttccttcttgaaacgactgacgttctgcctgtagtctttctaaatcttcatctccctagctcacatgtcactagcttttgataattttcctttggtctagtagtgacacatataaataaccaaaaatcagaaaacaagactccggcaactaatttcaacaagccttgttcaatggcatagacagaatgtaatttattttttgtgacagttataataaaagtgacgtgaaacacaagggatgtaatgtcagcgatattgcacctcaaaagaggagaaagtgtggcaggttacctcctgattagcagcagctagttcttcttccagtgcagagactctttctaaagaaaccctcagtcgctcccttacctagaagaaaaatcaaaatatgtgcagtaatgtacatcccatacatattaaactgtgctgaatccataattaacatcatcagagacagtcaatttggcaaattattaaagtatttatatccctgcgtgctcagaatactaaatctggcagaaatacaatgaatgcattgtcacctcgtattgtcactgtatcaagggatttccttgtaagcaaatgcttttggtagttccctgatagagcttcaggtggggttggagattgacttgtcttgctctgaattctgattcatagtaagtggagacaaagtttaaaagtatattatgaattcatctaaaaaatagtcactgtttaagcatgacaaataggaaaaaaaaataccccacctttttctctacttctgtaaaataacaagtgaattttcatttggtacttagtatctaatttcaaaaattatttgcctgaaggaaaggccttttagaacctgaaaaatgttcttcgcttctctgttttttattaattagaggtctactttgtttttgaggaattgtaaactacttaagtatcttggaatttccaactagcttccagataccaaaggttaaaccattgtattttatagaacaaaaatctctgtatattttagtttgaaagtcataatttatgcttgtttcttacataactgaaactcgaagaagtatttctttgattcttgctttcttagaactttgttttagttgttttatgtttagatctatatatatgtcctgatatatatatatatatatataaaacaattcagagaaagaaatattgctgaattaaaatgaatgactatagcagtttaattttccttaaaaaatcaaaaaactttatagctttaacttaagatgcaattcatggtgggttttcgattatttataaattaacttagatttttcttgggaatgctatagtatttgtgcagttaagatgtgttttaacatataattatattcctatgagctttcattttattaactgacagcatattttaataaatggtatttttctcctctaataagatttaactgggaatatagattaaatttataaaatatgtaaaaacccagatacataaaaattaaattggaattataatattatttttccagttagcaaacaaacaaaaagtcagtaatgtcctattaacctagaatcctattaggaatttttaagaatctaagtcacattttagtattgtattacaataccatgtatattcagatgaatggatgcatttaattcctgaaatagaccttgaatcagcaataaaaatatccaagtaggggttttaatattaattatattttgttatgcttaaattctctaaaaacaataatacacacataaatggagacttgatttctaaaagagttgcacaggatctttcatcatattgagctagagattaactgccaagtatcattcctgttagacaaatatccaattgttaacaaaatacataggattaatgctgattaataaccaaacactagttacatagcaggaaatcttcgatgatttgatttggagaatacttttttatgaattttgaatacatgaaaaagaagcaaatatcccgaagccatgaaaatgagcaggacagctgatgtgtggaatgcatatatcaaaaaacgtttcaacagacgtgtgatgtttaacagggattcccatattctaaaataccaactgtaaaatacgggtgtcctgaagaaggcctagtaaacctagttgatgagaacagcaatatgaagcaatctaaatatgttaataatctctccatacacaacgctgatcatatcacacttaagctgctgtagagagaggaagttaccatattttaaaatatcaacacattaaaatctttctaaaagtcattcgcataatataagaaatggttgaatctaggctacatggtaggttaatatatctttctttctttttttaaacttaaactcttagaactgttccaaactgttttctatttactacaagttaagcatttatattttcattatagtgagtttttaaggagtaaaagttatcgaatttatccaacaatatgaaaatgaaataatcatctttcatatatttagaatagtggtttacaaattgagattatgttgtccacgaagtaataaatctaaaactgttttacaagaaaataaaaaattctgaatatattttgagttatgttataaattgaaaaattgatgctgtgaatatcaataatgcaaactgaaattaatataaggcagggttgcatttggggaattatcactcctacaacagaaaatattcttgtggaaatctcctcagaccagaagctctaattcattccttgacactaagatatttgataataaaaatatatagggaaggcatatatatttaatttgttttggtttacatttcccatacatgtctgatatgttatttttaaatagtcaatgatttctgagtaattgaaaaacacaagtatatttctcatgttctccaacccttggaattggtaaatatattgtagagtaatttcaaaattactgatggtcttagctaattatgaatattctatgctacaacttggtggctgtataaataattggacattaatgatgaaaattatgaatcactgcaactctctacagctatgctcaatccttgtagagtttatttagctctgcatatgtactaatccctctatgataaagttgtttgtttcctgtccccaaggcatggttaattgcatctttttctgacttcatatatatatatatatatatatatatatatatatatatatatatatatatagtattacttgtttatatatctatatccacatccctcctcatccctatgagaaactgtgagttactcttagggaaattgtctatgaaggcacttagacacatatgagtccctcgacaactaaatgaaatgctattgtaaacaagcatctggatcaacagtaaaaccaacatgtttacttggtttgaaagttttatcaaatgctgatgcttactcctgctaataataatattcataaacgttcactaaggacttgccatatgctaagcactggctgaaagctttgcatatcagatcatatctaatcctcatgatgactctgaggtcagtactaggattatcttaattcaagataagaggtaattgatgctttgagaatgaatgatcaagtcacttatccagatctgtctgactccagagccccaattcatttcttctttaggccactgagcattacttgttgataatcagtccagttgtccctgaactcaccaatgttcagaatacctatggtgagttaatacatattattatagctcctagggtcatacgatggaacaactcatatagttatgctaaacccactgaacttctataaagtaaattatttctagattacgttgtacaacaaccatttttttcttaaatgtactcacacgaccaggttatttgtcttaaatgctgtttattacctctattctgataaagaatcattcttttgtaaaagcatccctcaagtgatatgggaatgcttatgggaccatctcaaatcatacattctctagtaccttcatttaagtcacaaaactcttgaattttctctggataggtccttctcttcttacagctctgggttattttctgtgtgggtcctgctgcttagagtatctttctctgcttaaaaaacccttaatcattctttaatacctagatcaaatgccaacctttctttttttttttttttttttttttttttttgagacggagtctcgctgtcacccaggctggagtgcagtggcgcgatctgggctcactgcaagctccacctcccgggttcacgccattctcctgcctcagcctccccagtagctgggactacaggcgcccgccaccacgcccagctaattttttgtatttttagtagaggtggggtttcaccgtgttagccaggatggtctcgatctcctgacctcgtgatccgcccgcctcggcctcccaaagtgctgggattacaggcgtgagccaccgcgcccggccatgccaacctttcttgaagacatccttgtctttgtcattactcacacagtcacagctttttctgtggctacatattgtgatggaaatacatctgttttgagttgtttttcattgatatgtgaattcctagcactaactctgaacttctcagtcataatgagcatatcttatttatctctgtgtgtcaaacatgtgctatggagcctgacacatactaaaaattctatacatataaactcttgcaaattcttagcacttttataaaaagagaggaaatataatatgaaactaaatattgaatattaaataattatttgatgtcatatttagcaagaatttttatataatattcatttctgttttattcaaaataattcttatactaattgcctctcgttgctaaaataaaaatgagatacaatttcttcttaatactctagaagacagaattatagttatccttacatacacactccacataatcccctgttctcagaacatctgaaagaccaatgataaaaatataaatgtatataaatattaaatagaacaaaaatatttgcatgcttaaaaactagatataactgggaaataatccctagtttggattttaatgctcagaacttgtcggatactttacaatgaagtgtcccaatttccactctaactcctaaagatttactaatttttaaaagttcagtctttgaaatttcacgaaattgaaatacgtcataagccttcctaatctcctaaggatattatcatcatattggtttatatatgtcagtagaacttattcgagtaacagctaagagaagcttacagctacttttaaaaatatctaaacacaggtttttctactaatactttgtgatgttacatgcagagaatattcaaatgaatatttaaaactatgatattagagacattagaaaataagatgcttctaaaataaatgtctaaaagttaaagtacatcaatttgcatatcaaaatatacataattttcagttagtggtctcttattttggaatctataaagaaagaccaaggtgggggggggggaggggggagagagagagagagagagagaggctcaataataatattaaatgatataacattttgaatgtcatctgaagtagggttataatgtaccataatagaagtctaattctgataagccatagattcagtggtttagaaaaagaagatgtttatgaatattaccaacatccacacagtaatccattttcacttttaaaaaatgatttttcatataactcaaaagtgttcctcaactgactgactttaggagtcaggtgagtcaatggatgaagacaaagagcttgatgctgatgacagaagtgtagttaagcttgaactctttttccatactataccttttcatccaaggccttgtggtgctcaaacaaagatttcagtgccttgagaacttcaacttcactggatactcctgagggagactgggcttgccgttttaccaccgtcattcttagtgatctttcatgtcgtgacacaaggcactccaaatgctccagtaatagctattgggtttaacagaaaatgcaattatcttatgaatacaagtcataaatacttacaaatgacttcccccttaaattattgcaggcttacatagtatctaatgttagctgcaggttacactgcaagcagcaacaaagaagcacagacctgtttaaaacagggtttataaaatacattaaagataaattgtatttgatcatttaacaagttactgaatttaaaaatgtaatgcaaatgtaatgcagtcctttagcaaatgtaataatttcagtacgaattcagcagaaatagaacacttggaaaaatatgtatgataatgatgaaagaacattgcttgatgcatcatgatctttttagaggatcatagtgacagtcaaaatttatttcatttacatatggccattaaaataatttgaattgaataaaatgagcataatcattaaaatgttactttaacttaatcacatggttttattcacaattagtctttagattaattatagaaaaatatatgcaaccaattagaacatagtaactgagattctcaattgtcagttcagaaaaggaagttaaggatacagttttaaattgcctgtgttagaatctatgatttcccagagtagcctctggggccatgacagaggtggagggaaagtccctgaagactttccaggctgtttcaggctttacactcttagcttttgccagaggagttctgctttgaaatgttttgtgaattggggtttcatatttgctttcatttcaaaaggaagttctactgctaaaaaacaaagatacatgagaagaaaatcagaaattgcttgattattttcagttattataattttactagtgaagaaccacacacagttggtgagcattataggaaaggtcttcggaagcatagtgaaaagcataggctaacaagtggtgtctacttatgcaaaataaagaagaaaataaagcagaaattacccaaacaaaagatttaaaaacagatataagacactgaaggtggaaagaataaagaaaacaactttatttttttcttttcaagatattttctaaaagtttaactgtaatgaaaaattttggttttcactataccactgttagattcattgtcaagtattagtatcatattttttggttgatttctctacatttgctgtcactaattatgactcaaaatgttagaaaactttgccattattgggcacaaagaacaccagtatctgagacactaaacatgcataaatcagtagataagagtcacatttaaggatcaaactaatcgccgggcacagtggctcactcctgtaatcccagcactttgggaggccaaggcaggcagatcacgaggtcaggagatcgagaccatcctggctaacacagtgaaaccccgtctctactaaaataataataataataatagtagtttttcagtatgaaaataacctgaaattttcaaggagccctttaaaatttatcaatctctgattatattatggtattctattctctcaaattctttagatacatgtattcattgcataaatccaagctgttttacataggttgtggagatttgcatgaacttaataatgtctgtttttccagtggcatctgatgtcaatctttcgctggcaaactatgttccagacttctgacctacttttagctcctcagtatgtcaagcctttgcttatgctgtaccctctgcccaaagcactccttctttggttcctcatttaaccagctctttctcattctttaagtctcagcttaaacatcatctctcaacaaggcatttgctcactactgtctaaagtaagtttctccttttccccacctccgcaagtctctatttcaatcccttactaattttcttcagaatattttatgatatgcaatttaaacaaatttttctaccaaatttcattctattttcccattgcaataaaagctccatgagagttggcacagtgtccgccttaatcctcttgatcctctctggatttgggtgttagctcaattcccaacatctataggtatgcaattaatatttgttgagtgaactgaaatgttaaatgagttaaatttacatacctcatatagttttatatatctcatacagatttggcctatatgaaagctaagcctgtggccatggttaattggcattatttcctaaaagcttaggctaattaacattattatgtacatctatccttcaatctgatgacaaaaataatgaaacctttacaacacaatgaaaactgtttttttttctaattgtaaattagagtcatcttgcataatatagtcgttcaataaacatatcagcatccaattttgcacaatacagtgtaagatttagaaatataaaatatccaccctctaggaaaagaaacacaataatgatgctataaaggatatctgttattagagactacctaaatcttttgatcacactcttcacatttggcaagtggaactttttaactgcttctccctaccctcatgtcctcattgtctctttacccagcttaaagttaacaattcagtatttgtaagcactctctttcatgctccctcagtttctagaatctgatcacttgccactacatccactgcttacatttgtgtccaagacctataatctccccctggattataatggctccttaactggtcctcctcctttcagcctttcatcttcaggctattctcaaaacactatttcagttaaaatgtgagttaggtcatttatacctctgctcaaatttttaatgtcttcttattgagctcaagtgaaagtcaaagtccttatacatcccaaagggatctaaattttctgaacttatctcctatttttcttcttgctcattctggtatagcttcattggctgccttgcagttttttgtttgtttagttttgttagttttgcttttaacaggctaaacatccatgtccccacaacaggggttttgtacttcttcttttctctaactaaaacattctctttcagaaatctgtatgactatctcacttcaccttcgctttcatattttaactcaaatgccacttttcaatgaggctttccctggttacctacaacattggatatctccttcctagcatattaaaatgttgctttgtgtcattaagtttttggatagtttgtcatatcatgataggtaatcagaaaaccttctcccaaaggatctgtaactatttattagagtcatagtactatggacaataaaatatcaaagtttcttgaatattacctctgagctaggagtaattttctgatcctcactctgtaagagtcttcagtaacctggtggacaaactgattcaccttgtagatatcagcctatttcccttgccaccatgtcgtatttctcaatgtgcataaagaagtgaccatggtttcagggttataaacctgacaaaatgggcttcccacgattaagactgatggagacaccaccatggctgaacggcccagtggcaagctgcagcaatctaacttgagccctgtcatgataaagtacagctggagaccagctattcaccatgaagcaagcatattatatcaaatactttttattaaagaggaggcagtttttcctcactataataaaccccctttttggatatagatttgctttctctaatgaccatacttctaccagaaacaccatcttaccgagtttttgcttacagtcatgttatgatatacaacattacttcagacaaaaaaaaaaaaacaaaaaaaaatctgattttacagtgaaaagagtaatgcaattgatgggtgctcccagggaccccggattttatcacaccattacatcatttagaagtagctgaacttatagaatggttaaataagccaagacttttttttattttttattattatactgtaagttctagggtacatgtgcacaacgtgcaggtttattacatatgtatacatgtgccatgttggtgtgctgcacccattaactcgtcatttacattaggtatatctcctaatgctatccctcccccctccccccgaccccatgacaggccctggtgtgtgatgttccccttcctgtgtccaaatgttctcattgttcaattcccacctatgagtgaaaacatgcggtgtttggttttttgtccttgcaatagtttgctgagaatgatggtttccagcttcatccatgtccctacaaaggacatggactcatccttttttatggctgcatagtattccatggtttatatgtgccacattttctcaatccagtctatcattgatggacatttgggttagttccaagtctttggtattgtgaatagtgctgcaataaacataagtgtgcatgtgtctttatagcatcatgatttataatcctttgggtatatacccagtaatgggatggctgggtcaaatggtatttctagttctagatccttgaggaattgccacactgtcttccacaacggttgaactagtttacagtcccaccaacagtgcaaaagtgttcctatttctccacatcctctccagcacctgttgtttcctcactttgtaatgattgccattctaactggtgtgagatggtatctcattgtggttttgatttgcattcctctgatggccagtgatggtgagcattttttcatgtgtctgttggctgcacaaatgtccttttgagaagtgtctgttcgtatccttcgcccactttttgatagggttgtttgttttttttcttgtaaatttgtttgagttctttgtagattctggatattagccctttgtcagatgagtaggttgcaaaaattttctcccattctgtagcttgcctgttcactctgatggtattttcttttgctgtgcagaagctctttagtttaattagatcccatttgtcaattttggcttttgttgccattgcttttggtgttttagacatgaagtcctatcatccctatgtcctgaatggtattgcctaggttttcttctagggtttttatggttttaggtctaacatttaagtctttaatccatcttgaattaatttttgtataaggtgtaaggaagggatccagtttcagctttctacatgtggctagccagttgacccagcacaattcaagcttggacataatacattgctaagtaggaattctatcatcctggaattagtatatcctcagaactactgatagaaataagatagagtttctttcttggaatagctatggatccatgtatgtaagtccagaaaccaaggtttataattggaattcataactgccaactaggacctgtgactagtggagaaaagaggatcattccttttttgttgacacacatacacacgctcacatacagacacacacactatatatacacacacgcatgcatgtttgtgtgtgaatatatatatataatgtacattaatacattattctcttttctgttttctgtaccctgttaccatcttttacccattaattatccccattttctacccctccccctgactgtttgatagttcctcacaatccaaatcccatcttcccagtaacatttcttgggaatgtttaccactaggtggcagacctgtgacttaagatcagtcaaccagacctgaccaccctgggagttagcctgacggggcagagaggaaccatgctgggaaggggtagtggcagaggctgcgtgtttctgggactgggcttgtgagaaaaatttacaaagctaagaaatgtggtcctagagactgtctgaaagctcagtttagagatttcttatatgctttaattaatgtctttatttaaacagccaagctatatactctgttttgtgcaattaggaactctcatctacatgataataaaaaccaaatatgtttttattaatataaacagactccttaagggatgaacgatttcacttatccccaataccaaggaaaatattctacataataagtacttaatacttgttgaattgggttaatgataaacatcaattattcagattgaagaatatggacaaaaatgttctcatctggcatatatatatggcctaatttaaggttaaaaataaaagtaaataaattaagagtacaaaaagtgatacttagctaagataccattaacaatctactaattacacaccttcactgggagctacaactttagcctaatatttaataattctcacagaaagtacaaatggaactctctttggtatactcaaaggattgtagagactatgtgaatggccatgaatcctatgtttgaattttctttaaatgaccacaggttctatgtgtatacacacatatgtatcatatattcacacacagacacacacacacacacccacacaaacccacacatcatgcgtcattgggaattttttggactaagttttgccttgaaaagcaagatggcccaggtaatctaaatcttttattttactatgattctgtaaggatttctaaaactatataacttcctattagatcttaattcaacaaaaccttgtgaatagttatttccaattataaatggcactgaaacagaaacacattcttccctgtagactaatgtggctgctgtaatatggtcatatagcatgacattaacatctgaaaacgaaaacctttaaattggttgccttcttactcaacccactccatatcttttaccctcaaatatcgtttaaaatcccatgtttcttatgctcatgtttgattatgaaattgaaatagctgttgggagggcgtatgtcctatcctatttactcttgtactgatcatatcctatcatagaactttcataaataactatatacgcacatgcatgtacacatatgtagaatctttatctgttttcagctgagaaggtcttccttttctgaattggaccgtattttctacccattgatgaaatacatttggatgacattattaactcgtacaggcagagatttgtcaataagaaaaaatttttctttagtagtgatgggtgtctaattgtatctcaatatctgttaagataattcctttggctcaaaacaaaagtgagggcatggtaagaaatgtgtcaaatgcaattatgtcttctttttaagtttatgatccatgagattaagttacagctttattatttataactaggtattaatactgtttcttgaaatcataacaatatgaatactgtttctcaaaaccataacgtttttctttttttttaatttttttttattatactttaagttttagggtacatgtgcacattgtgcaggttagttacatatgtatacatgtgccatgctggtgcgctgcacccactaactcgtcatctagcattaggtatatctcccagtgctatccctcccccctccccccaccccaccacagtccccagagtgtgatattccccttcctgtgtccatgtgatctcattgttcaattcccacctatgagtgagaattcaaagtcacacaatagttacattctaaaacattatgaacaatttaaaacatcctttgagatcttcagctataaaaatagttgaaacaactccgacaataaaaatgttcttcacgctgacattcacaggcaataactatacaaaaattcccagtttttctttacctcttcattagttcagataactttgtcaaaacatgtcttattgatcattttgagttgaaataacatcaggaataaattattttctataaatataaccttctgtaaatatatacttgccaaagtatggtcagaggagttttaggaataacaaattttgtttcaatattttttctacatttttatcagtataaaaatattgaacaaaaacttctttgtatgtttctataaatatccactataattttttgaaatttctatttttgtataattgtttataatattataatgattttattaggatattcttaatttaataacttgaggcagttggatttaagaacaactgcagtgatgactgattttctttcattcactcaaatttttgcaatgtcaacgaggtgtttctgtggagaaaacataatacatggccaggacatacatttcagctttgacctcagaataaaaacatagcagattgactttccacatgactaacacaaaataaagtaggattgaattacaaaaatttaaataggccaggagcagtggctcatgcctgtaatcccagcactttgggaggtgaagacgggccgactgcttgagcccaggagttcgagacaagtccaggcaacatggcaaaaccccatctctacaaaaaataacagaaattagctgggtatggtggcatgtggctatagtcccagctacttgggaggctgaggtgggaagatcacctgagtccagggaactctaggctgcagtgaaccatgattgtgccactgcactccagcctgagcaagagtgagacctcgtctcaaaagaattaaaaaaagaaaaaaataaatttgaacaaactgtattcttctttgaacataatacctttgcatcacatgtgaattgtgggtgacataggaatatgatttcttaaatacatagtctgtgggtaaactgagaaggaagtagtggactctctgggtgtttcatttataagccatttataggcctgggacaagttacttactaccttagttttctcttgaattaaatgggaataatgagattgctgtgagaataaagtgagttaaacatgtaaaacattcataaaaacatttagattttaatgttagctattatattatcattattactctctatcttcattcaattcccactggaacttctattttctattttggaagatggtataattcatccaaatatcattatacagaaggactttttctgatctattgtttttgataacattcaaaattaatacaaatgaccccatccacacatggtttcatggactggctttttatgttatttagctcagttcatgaacatatcctaactactcgatgtaaagtgagccacaagttgatcagaactttggaaattggaatgctcaattacactttatattttattttcttttatatatttatttatgtatttattttttgagatggagtctccctctgtcgcccagactggagtgcagtgacacgatctctgctcactgcaatctcaccctcctggattcaagcgattatcctatttcagcatcacgagcagctgaggttacaggcatgtgccaccatgcccagctatcacttgcgctttaaatttgctcacaatctgacaccaattaaagtttctttacatgtgagaaggaaacactagcttgttgctttgtctctatgaccagcacacagatatttatagcaagaagaaaagcacaacatctagaaagagaaacaactataaaatctataaaaatggttttatttagcaacatttgataaggcatctggtgtgaagagagacatatttgattttcagctctggatatactacttctgggggatggaggagggtgagaggtggttatgtaacttaaggagttattatataattaatactgtgtacaagggggttttcataaatctgttttccttgatgcagtcgacaacaaaaatcctccacatcactgctttaaagaaggtagaaatgtattttccagccttattcatattttcaaagtaactattatgcatggttgaaatcaatggcttcaatatctgttattgttattttaaaggaactttgtatttttctaattttgactcccaaataggtacttcacatgtggctcaccttcctccctttattatccaagactcctttgcaaacacaatagcctcgggtatttctggttctcatggggttcaatatgatgaaaattgtacggattctgtcaccaaatctcttagctctctaaaattcatcacaattagatactgtggtggtctgactgttaagcaatgtcctctctagctgtagtaagtctttgagtaataatgctgatggcctcatggttagtgcacaggctctggatttagactgccttacctttcaaattcattctttgctatttactaactgtgtgacttctggcaagttatctgaccttttctgagctcacttacctggtctgtaaaattgagataattataacatctccagaggggtgtagaaaggagtaaggggctgaagaaaaaaggctagatgaacctacacagctaataaaagagtgtctggtgcattttaaatgtgagcattagttataaacctaaccaaagctttgtatttccctgcattctcagctttctgctcctacttttacacttgagtgtgctgtgttaaatcaaggaatgtagtctaaagtactaaaatataacatagtggaatagggcagaataaatgtcatggtataaataaattttaaatttgcacgaaaacacagtgttaagttaaaaaagtcaagggtaggaaatatatagagaggaagacagcaaaagaaaaaaattgtctgatacctgataatatgatctaaactgcccttgttatgccctgtttgaggcaatccatttgacaggttcatcagagtatcattgaaaaccaattcaatgtatgcatgtatgtgaattctctttaccatgaaataagaccttgataaataaggacataaattcagtttgatcatgtaaccattatgcaagcaaccctatctctcattaaaggcacaagctcccagttagtagaactgtattttatattactctctaagactcataaagtgaataggccattagctatacctatttttttcaggattgatctattatagctataacatttaaactatttttcaccaacttcagttgtatttaaattgaacttacatccacatagaagtggtttttttctacttccttttagtaaactgtactcctctatgggtaatgtggtaatttacatgtttataaaatttagtgattttttttctcaaagaaaatatagcatgtttatcaaattctgaactttaatgttacatggcatgtcatatgcttgatgaaaatacatgggtttccaaaagtagaatctagcaaattccatgagtttcatgaaatcagaatatcatggctggacattcccttggaaatttattaaaacataaaggcactcctcttttaatgggcagatttttttttcagtttttttttcttgacactattttttgtttcctttttattttatttattattattatttttttgagacagagtctcactctgttgcccaggctggactgtggtggtgcaatctcggttcactgcagcctctgcctcccaggccctcccaagtagctgggactgcaggtgcgtgccaccaagcctggctgacttttgtatttatagtagaaatggggtttcaccatgttggccagggtgatcttgaactcctgaacttaggtgatccgcctgccttggcctcccaaagtgctgggattacaggcatgaggcatcgcgtccggcctttttttttttttcctttttaaaaaaatcttctgctgggaggaggtgagaaccaaacccaggccactcttttgtagcagcccttaatttaaactcttcctcttttccaaaactctcctcttttgcccatttccaacctctgagggattaccctacccccaaaacaaccttttgaaagtttgaaacccattattgaaatccagatcttctttttaaagccaaataaagtaaaggccagaaggaatgtgaacattttgtaaagcaacatagtgatttagtagctgtgactataatttaggtttcctgtctttttgttttgagttttatagtatatcctcctttactttaagtaactgagttactatctgcttaaagtaattataaagttttaaaatgcatatattttcttcttatatgtgtgttacatgtaatgcattgaactacaaatagaattaattccaaaaaggctgctttacacttactcttgtgttgtttctttcagctttaagttcagagatttcttcttccttttctagaagttgttccctgcaggcatttaattcttttgtcagtgcagcaaattcctggaaaagtaataaaaatatttgaagaaatattcaagatctaaaagcagaaaaaaattcaaaatataaatttcaaaatgaaaagaatggggaaaaatgaccccactgactggtcaacatatgttgctgttatgaagtatcttaaatacattattcaaaacatgctaatccataatatgtgtcatatgcattttattacagtacactgcttagatgggtgtataaagtatatttcaaaatatatcagatacatcacactgagcctaacgttaatatgataacttattcctagagtaaatttaagtttggctaattttatgaacagctcccaaaatcttacactttaattcctatacagcaatgtttatacagagtacagtggatcttcagaacaaccgcaaaaaaccctgctaaacatgctattttgaaattaacaaatttatttgttaacaagatgaagcagaggaatctacctttttttttttttacaaaataacaaaataacaaatatgcctaagatttgatagcattatctaagattttcttattaatttgcgtattgctcagtctttctaaaaggtaagctccatgtggacaggggctttgacttgttcacggttacaccaccagtgtctaagacatagtgggagctcaaatggtatttatttttagttgatagaaataggtcatattgttacaaaaaaattggggattctggagtaattctgtcttcatgtggttaatgacactgtgaaggaatcttcattggcctccttcccctaaatgggatcagagatcatatgatatggtatttttaccaataggtagagagtttgttaacacacagaaaaggttatttaataagaagaccaaaaaatgcaactattctgctattctaccttataaacaaatatttatttttttaaatatagtaaatagatccatattatcaccaaaccctttagagtgattttcagtagtaacactgatgcttatcaaatatttaagtatttgggaaaacttaggtccatgctgagaagtcactcagaagattaaaaaacataaaatgaaggagacaggtttggttaacctaacctccagggaggcaaatttaataaaaagtaaatgaatatgatgattatgcaaagctggggaaggtttggagtttatatttttgtttgcttcaaatcatttattttgcttagtttctctaaagggcttcagcccaagtgagtacttcaaagatctcagagtaggcttcagggcttagattctagatgacagagtttgttgttgctttttggctgacatagggataaatgttttcttccctgattgccgcctgcttaaatgttgctaatactctgagcatattatttaggtggtaaatggaaataaagcaaatagaaaacaataaacctttctctagaaaataaaattttcttcatatacagcatagttttgatagagaaaagaagtgatacctaaagattctttattgcacattattaacatgtaggcattcagaaaaaatcttatacttatgtatattataaacattgactaagataaaacataacatctgtatatttatcatactaattataaaaaatttattcatctattagaattttaacattagatatctctaggcagtgaaattatgaatgaattttggtttttggcttccacccaagtatttctatcatcaaactttttacaatggagaaatatgttttcgtgctttgaaaataagagaaaatataaacctgtaagtgcactgaaacaatcaagtttttaaagcagaggggagaaattagtgaagatgttataggccacagaaagctcggccttttttattatcatggcactgattctgagtaggctagtgactccatgtattaagattagtcttacatttactaacttcctagcaactttcaggcactactttcacatttattataccaccttgctctctaaatacctagtgaggaggtctcactcccatcttatggctgaggatactgaataatggtaagctgtatgtctaagttcacaaaactcacaagccatagggagtgagttagctctgagcatcattctccactgcaagtttagtgcttttctactatttcactttgaacctagttgtttgttgggtttatattattcagatctggagtacatttagaggtaccctttttccttatctgaaacattaaataatattactactgatatggtttggctctctgtccccacccaaatctcacattgaattgtaacaatccccacgtgtcaagggcaggaacaggtggagataattgaatcatgggagcagtttcccttcatattgctttcctgattgtgagtaagtttgagatctgatgattttataaagggaaaccgctttcatttggtcctcattctctcttgctgccatcatgtaagaagtgccttttaccttccaccatgattgtgtggcctccccagtaacgtggagctgtgagtccattaaacctctttttctttataaattacccagtctcgggtatgtctttatcagcaacgtgaaaaagaactaacacaactacaattatcttgcatgatcccccttaattagtccaagagtgtggggaactagaaggtccaaagtatagtataccttccacacagagcaacaagtgttagacaagtttgttctatgtatctgagactgtgtagaggcagatatctcacatggagttaaccaccaaacattttaacacttttcctctgacagttctctttcctatacctattctccttactgtgaacatgaactgaggcttacatcatcttacaaagataccactaacagcaaatagggttaacattgattgcaaacttacagtatgttaggtcctctgccaagcaatttatattaattacctcatctatcctaataacacaccttaagaaactactaaaatctcactgaggcctagagaagttaagtacattgtgcaaagttacacacctagtccatgatggagctgggctttgaacccagacaatctaactcatactgggtgattacgataagttgtttgtttcccctgaccacattttcccttctgatttgtgtttcaatttttggaaaaattatatttcccaaggtcatcaaactttcagtgctttttaccttcaaatatatcaaatttaaaccaactttaactttcaaaattcaaaccacccaaaacataaccctttcataactaattagctttattacttacagaacaatagcaactattaataccactttgagcagttggcactttgttttgccatgccccaagctaaccattttacatgaataactccatcgactccctatttttcagatgaggacactgaagcttagcagtgatgaataacttgttcaaggtcaccgctcaatatgacccactttgattctaaaacgtttagatttctgcaacactgcctccttctggctaaaaatggagtctctttatcaaatgtctcaagcattctgggattatcatccgtctaactatccagccattcatacaacatttgttgaccacttaccacatatcagaccctgtgctagatgctgaagatatgaagataacatagaacagttgttgcagttgacctcatagaaatgtcagaattcacatttgaggcccatcagggatctccatcattaaccagcactcaaaacccatcaccaaagtgccacacagagtaataccagtgtatgccctttagaagtcatatgtccctcaaaagcctccttcttagatggtctatcttctgcaactactgtgaaacatttctctttcctgtttccatttctaccttttcatttttttcaactttttttcttgtttctttcacaaactacctactgtgcctcaaatactcttcatcatccctctgcctaactaattcatttttaaaagcactagttagccttcttaatgctttaaaatacctagttgtattgtttttataactgaattatgtgttcgtctcctccacctaaacagtacaatcctttaaggcaaggttgttagagtatttttatatccttaggtcttagcatagttcctggaaaattaagtaaacagtaaatccttgttgtgataataaataaatggcttactttcctcaaactttggactttgataccaaaataaatttagaagatattattggaggttttttttaaatttttctaagtgagatcactataatttgcttaacatataacagatataatattcttttttactttgtagctgttgttttgtctatattgaaatatgctatattctacacggcaatgacattattgtctgccatgcttttctaacatatatatatatatatatatatgttagaaaacatatatatatatatatgttttctaaaagacccatacatatatatgtcattttgctctttgtagttgtgactgatctaattctcttatctcactgattcaaacacacttctacagattccttttaattcagacatggtgaagtatgaataaagtttccttctaagatttctcactgctttaaccttctgataatactctgtattatatattgtattctgtttcttacctttttcactcatatatatgtatgtatgtatgtatatgtgtgtgtgtatatatatgtgtatatatatatatacatatatatatatatatatatataatatagcgattacctggaaactgccaaattcaacaaattattcagaaaatcttctctgatcctggtagtttcttcaaagagatctgcagtatacctcccacctaggaataggctagctctagtgctgaagctcactattatgaaagcataattttgtgatataaatatttgtgttgaatgcaaagatactagaatgaatgagagcatatgcacctgagagaaaatgaatgtggcaggagaaataatgaaaatattttctattccgtagtgctttgggcctattgctctgaataattcatgcatttaaatttatcatttgttcattggatctatcacattggtcttattcatgcttaaagtgaaagtatgtgtttaactaatatggtatttctctagtctagcatttctcaaattatgattttagaacagtatttccacaagattcccagaaaggaattcactgggaacaacctagacttccatatatataaaaatgtatgatttaaatatagtaaatgtgcatgatggaatattatgcaaagggaagaataaacaggttagatctttgtacagcaacatggaaagatttcaaaaatataattttgagtgaaaaaggtaagaaacagaatacaatgtataacacagagtattatcagaagcttaaagtagtgagaaatcaatgttagaaggaaactttattcatacttcatcaagtctgaattaaaaggaatctgtagaaagagctaagtgtgttaaaatcagtgagataagagaattaggtcagtcgccaactactaagcatactcaacaacttttcagactattttgttcaccaacctatgcatggcaaatactttctttttccaaagagcaaagtgactttccccactctatattttgtcctttggaattttaaagaacagtcaagatctagaccacacagtgccacaacagtaccctcagcacgaagggaggggtgcccttctctttcttagtgtgtcctcaggcacatcacaaacacatttatatgagcactcactatgtagtggaccctgtttttagtgctgggaagatgacaagcaaagaagcaagttaaagtccctgctcttgatatgtttacatgcattcagggaattaatcattcaaactacttttctctgaaattaatcttttctagccatttctatccctctcaatagtaattcagctcatggtgtaaagcaatagtttctttatttaaaaaaagaggaaaataaaataactttcttttctgttaatatcttaaaattttgaaagtatcatttcttatacaccaacataggacatctaacttctgtgcactcctgaatttgttacaagtctcttaaattacataaaatctaaagctcttctatttcagctaatattcccagttgttacctttttacttattttcttccccgctcccatcatttttttcttttaaaaacagggtctcacctgtctttaaaaaaggacaggggtcttgctatgttgtccagcttatctcaaactcctggcctcaagcaattctcccacctccacatcagctttccaaaacactgggattacaggtgtaagccactgagccttgctgtttacttaactatcatttcttaagtactaagtatatgctgggtacattgttatgaactttacctctattatgtcgtttaatcattatagcagtgttattattcacagaacacagatgagaaaagtagaagagattgtttccatcaaaacccattctattgtatggcaatgctggtgccaacatccctgaaacctgtcatatcccagagcaaagataagctgtcttgtatcttatcagtggtttcactcttttgtgctgacttctaagctaaggatgagcttgagtaattcaagtgtctgtgctgcaaatatctcaaatgacaggccttaggtcaatatgttgttcttagtgagtttaatgaaaagaggcttctcttgttttgatctctgcatatgttatttccaaagtgaaaaatacaggggcaaagcatagattcactcagttcttgtgcctatttacattcctagacaggaaattaaagagtgtataacctcttctggtcaactttcctcttgtttttaacgtatgccttttccacctggtatatcaccatagcctatcgggctacccattctcagacagacacagagcattctatttttatacaggttcatctttaaactcattttctgatatttagtaataaacataatagagctggaaaaaaaaaaaaaacttctaacttccctgactcatttcagatggtatgcttacttgaggaggtttaattgagaaaaaaaatgacatattttctcatttactaaatgcttgaaaggctttgatttaataggtaagtccccacctcaggaaagctggttaggagaagctgcatggtaagaggaaaattcagcctttcaatttcaagtcaatgacaccagacagtctccagagaaatctctgacaatgcattcatcttgattacaattttaatactctttacctttcaattaaacctgcattttctaatcttgtgggccacttaattaatgaactgacaatggccttatttctgcagccatctatctgagtaagtcctgccttgaagaatcgtgagtgcaaaccagtttgagagagaagaggaaaaataaatggtgagttggaattcagcttcactaaacactgccaacaccctcaccgaccacaaaaaagcatcttttaagtttattcttcaaccatttgtgcaaatcaaaaatagcgctcaggaaagcatatggcatggaagcatgctgatttgaccatctagcatttcaattagacaaaattaactgcttcaaaatgctttttttataatgacttccttagtctaggcccctcatttactgtagtttggtgtttcctcctttgaactttaataattcttctagcaattctatttgtaatactcagtggaaagctttggattttaaatctatttttatttgcatataatttcacataaatttacatgtaaaaaaatatgtatgtttttccccaaaccacaggacatactttctagaaccgattaataacagaagtattacatttgagagatataaacaaagcaacaaaaagataatatatttctcaaattttatatctacacttagtatatttgctggtaaaaattcagaggagtctttagaaattcagtttggaaatcatttagtttgggaagaaaggcatatagaaattaatacgtaatcattatatcactatgtatatgcaatatttttattttattatgtaatcaaatgcagtgttaatgacctctgtttttataattgccttctggtctcacatgagcccagggaatgctgtcatccaaaattactgtgcaaaacagtaatgtctcacggtcagccctgggctagacagcttgaaggtagaatcgcctgcataactaatgtaatgtgacaggcacaactggactcagaattttcacaaaaatcattgggtaagatggctcaagttaaaagaaaactgggtttaaattccatgtgcattatattttgtgcccccttgaatttttatgtatctatattctaattagaaagctttttggtctttttcctaaaactgcataatagaagactatgttaacatatcatggtgacttgggggatgcaagcctatttaaaatccaacatgctacaaaagtcattcccttggtagatgtgtacttggatacttagtaacttttgttttcaaaatcttctaatcaaggtacttagaatctttcaaaaagtggatgtttgtggaaatcaaaattgtcaagcagtctcaggctgtctgtccatcaagccatgaatcattcactatgctcctactgaaacgtacctatcttatatcttattcccactctgctttgctttgtggacaccaatttctcaatgtatatagagagctgccccaggtattaggctttctttgacaatagcttgctagagatgagtcagcttgtttttaaaccctggagagccggtactacagattgtttttaaatcctggagaggtcactacagattggttgggaacgtatttggaggcaaggtagggttttctcagtatccccacaatggctgttctgctgcactgcattgcttctgtgggccctagtcacatttgtcttcttgggcccattcatctattaaaaaatatatataatttttaatatatataatatattatattaaatataatatataataaataatattaaatgtaataaataatatacataaatatatatatattaaaaaccatgcagtttttttctttaatggtaactgaaacgtaactcgagattcacctacccaaggctcattttactcattgccctttttctttggaaggcactaatactgaaactaattttatatcagggacaagaggattatcttcaagcataataataaaaaagagagagttctactatatcattagcaaactagcatggcagaagtgattgacattagtgtgatacagtaaaaatactcagcacatttttggagagaatatatcttactgtacccctctgttcctgtgttcctgcagtaattcttgctgatcaaaaatttacattacgactacctaagacacatcaagtgacattctataatgttaatgtatataagggtagagcctatgaggaaattctctagatatcataaaacagttcttaaaagctttcttaaacatgtctctggccaggcgtggtggctcacgcttgtaatcccagcactgtgggaggccaaggcgagcggattacctgagctcaggagttcgagaacagcctgggcaacacagtgaaaccctgtctccaataaaatacaaaaaaattaaaaatatccctcagtatctatggaattagaacatgttacattatttgaacatttgatgacaccatgtcatgtcagtgtgtcctttatcttctattatcgtctcctcatctctctgattgcatctattatcactaacccagggctcacacacctctcaagatgttttctggtgtctgaaatgcaatgatagtataaaacatatttgagaactttttaatgaacccttgcattgcttgttctgagatgctgttttgagaggagcccagctgcctacaagtctgaccagaatccagggttaaagcctgaagtctttcacagattccctgacccaggtgggaaggatgctccctattgaatgaagctcccacctcaccctttgggctcctgctctaagtttgagtggctgccttgttcccatatcctgtccctctgcataatattactagaatgagaaggagacaaacccaacggcttagaaccaagactgaagttactcactccaagtttccttttcctttgacttgctccatctccccttcatttttctccaatagaaaaaaataaaacaaaaccttgttctggtcttattgtatgaaagaagagagagggaggtcatcaggaagcaattctaacagaggaaccaacctacttcttcagccaattaatgctcttgtccttaattctgactcatctttatggaggagagggaaagaatcttcaatctctataaatgcccaaaagatatatttgcttatttgatgcttcatgcatttgtacatttattaaaactcgacattctaagtacattagtacaatcaccaggcccagtaagcattgtagttaaagcatgtcagggctgagtcattgccaaccaaaaactcttttggcaggaaaagccaattttcaacagctctgacagtgtaaagcaggaggcatgtttgacaagatgctgcatattaatttaaaagactttagcatctggttaggtaacacctgctgtggcaaacactcccagacacacaaaatagcattcgagctgaatatttaaatctcccaacatagctcaacaaagctctaactctaaacaaaacaaaacaaaacaaaatcacatctctagcaatcagttataattatataaccaaaaatatttgggctacaacattgtttgctgttcactgagctgaaatgctgtagtgggtgctataaaagttgtaaaatctattgaaacatattttcctgccttgaagaatttaactgtgtacaacatttaaaattgcacactgtagctcagaaaatagcactttgtgttataatatgttatatcaatatacagctaagaagtttatcactggggggtggggggtgaaagcattaaataacagagtaaaagaagcaaaccatgagagagaaatctggaaagactcttctagccactctctctgtgaaagtacatcccagcctaagaattgtagttgtctggcaatagaggcgtatgagagttctggaattgttaggacacactaacatgacacggtgtcatcaaatgttcaaataatgtaacatgctctaattccatagatactgagggatattttttaattactcaattttttatgtcatttactgtagagaaggagcttgcccttgtcagcctagtttggatactggctcacttgacaatgcatttctctctgcaaattttaaaaactgacactttgattatttctctatttactcgacaaaattttattggatgcctaatatgtaggagagcctgtgaaatttttcagacaatacaatgtgtacaatggtgaaaaagacatcgtaaatagaagtaagtgaacaataattacaatgaaatgtgataaacgctgtgatggggttatatccagggtgccccgcatgcacccctgtaggagggtatgtgcgtgaagggggcatctaagatgaaatgtgaaaaatgagtaagagccaggcaaaatgtatgttgaatgaaaattcttccagataaagggagcatcatgagcaactttctaagatccaaaagagcctaagcatactaaacctataaaattcttacagaaatacatagaggtaaatctttgcaatcttggattaggtaatggtttcttaaatgtgacgccaaaagctcatacaacacaagttaaaatagtccagactccatatgctatgactgaattgtgtcaccaaatgcatatgttgaagccctaatccccaacatggtggtatgtggagatgggaacgttgggaaatcattaggtttagatgaagtcatgagtgtagtgctctccagctgggattatttcccattttagaagaggaagggacaccagagctctctctctgctatgtgagggcacagcgagaaggcagccatctgcaagccagaacgaggtctcagcagaacccatccatgctgaaactctgatctcaggtttccagcctccagaactgcgaggaaatatatctttgttgattaagccatccagtctatggtattttgttatggaagccagagttaattaatataccataaagttaagatgtttacacttcgagtagtatcattaagaaagtgaaagacaatccacagaatgagacaaaatatgagcaaactatatatctgataaagggctggttgtcaaaatatataaataactattacaattctataataagaagacaaataaccaaatttatacatgaacagataatctgaatacacagctctctaaagataagtagccaaaaagcacatggaaagctgttccacatcattaatcgtcagagaaatgaaagtcaaaagcacagtgaaatacaatttcacataacctagaatggctataatcaaaaacacaaataagcattggcaaagatgcagaggagcctcatacactgctggtgggagtgtaatatggtgcagccactttgcaaaacagtttgtcagtttctcaagcggtaaaacatagagttatcgtatggtctagcaatttctctactaggtatatacccaagaaaattgaaaacatatgtccacacagaatcttgtacatgaatgttcatagcagtgttattcattatatctaaaaggtggaaacaatccaaatgttcaacagtggaggaatgaatttttaaaatgcatatacttttttgttgttttatttcatatcgttttattttctgtgataagaacatttaacatgatatctgacctcttaacagatttctaagtacacaatacctaaattgtaaaccaaaggcactatgttgatcagtacatgtctggaacaaactcatcttgcacaattgtaattttatacccattgaacaacagctacccacataccccttcccccatctgctggtaaccaatgttctgttgtctacttctatttctgtaactattttagatgccacatatgtgaggaatcatgcagtagttgtccttctgtaactgacttatttccctcagcacaatgtcttccaggtcctttcatgttgtcacaaatggtaggatttcattcttcatttttttgtctttcctttatttatttatttatttatttatttatttatttatttatttatttgagacagagtcgtgctctgtcttccaggctggaatgcagtggtatgatcacaactcacaacttactgcatcctctacctcctgagctcaaggggaatccttccacttcagcctccaaggtggctgggaccatagatacactccactactcaaaggtagttttatttttatttatttatttatttattttggtaaaaaagagatctccctatatttcccaggctggtctcgaactcctgggctcaagggatcctgctgcttcagcctcccaaagtgctgagatttcagccatgagccacagtgcctggcttgggtttcctttttttttttttcaagggtgaataattttctattgtttgaatatatcacactttctttatccattcatctattgatggacatttaggttgttttaatttcttggttattctgaaaaatgttacaaaggacctaggggtgcagatgtttcttcaagattctgattttaatatctttggttatatacccagaagtgggattgctggatcatatgctcatcttatttttaatttttttgtgaaacctccatactattttccatagtggctgtaccctattacatttccaccaacagtgaatatgggtttcaatttctccacaaccttgccagcatttgttttcttttgcttttcatttttgaaaatagccattctaacaggtactaggtgacataaggaaatttttgaggtgatgaacatgtttattacctgaattccattgtggtgattgtaacatgagtatatacatatgtccaacctcacaaaattgtatacattaattatatgaagagtttttttaaacaaatacacacaaggaaatattattcaacaataaaaagaaatgtagtatacatgctataatatggatgctccttgaaaaatatgctaagttaaagaagccagtcacaaaggaccatattgttgtatgatcctcttaatatttaatgtccagaataggcaaatatacagaaacagaaaatgaattagtggttacctagggctaggggagttggagagattggaggaggtgagagctaaggagctctggatttccttctggggtaacaaaaatattccaaaattaattgtgatgaggatgcacaattttgcgaatatactaaatgccaatgaattgcatttttaatggctgaataaaatggtatgtgttgttgcaataaagctgtttaaataacagtagttcagtttggatggaatggagggtaagctatgttagttattttggtctttggtaaaaggcaataatgggcaccatggaaggaatttaggcaggtgaatgacattattaactttatcttccttattattagtttagcaaccactcaaggaaatttaaaacactaaatttctggacttgccagactaagggccagactctggacctcaccaaattcatcaaggtaatgtaaccctgaaatattctttttagtaaccagtatgcttgtggacacttaattcttttaacatcaatagcatttattgattgttgccattggacccatccttatgaccatcttaacatctccttccccagcaaaaaaacaaaacaaaacagaacaaaaaaaactaaaaacaaataatgcttcacattaaaaatatgccattttctctcctgttcctaggggacttcccttgctatgagtatcttgctggtcagtagaagcagaaagaatctcagatgactctgctttcttgggaagcactttgtaaaatacaattttcaaaaagaaaaaatatataaaattactcacatattatcttaatctttgcaattattcataagcagtttgcaaagactcatagtaggaataactcttgaattctctctatcctgtagctatttactcatttatggaacaagccttgtaagtattgaattgctacagaaacatatatgtacataaaactgcatgtagggccgggtgcggtgactcacgcctgtaatcccagcactctggggggctgaggtgcgtggatcacctgctgtcaagagttccagaccagcctggccaacatggtgaaaccttgtctctaccaaaaatacaaaaattagctgggcatgatgtgggggcgcctgtaatctcagctactagggaggctgaggcacaagaatggcttgaacccgggaggcggaggttgcagtgagccgagattgagccattgcactctagtctgggcaacagagtgagactccacctcaaacaaacaaacaaaaaaattccatattggtagcaaaatatataactgggtatataacaaattgaatttttgctattttataccatcttcctacagcttcatcagataaaccacatgtgtgataacactctgtactccttcgcctgagacatgaaattatcatgacatttttcctgaagcagccgcataatattccttgatgctggactttaggcagcaactacttaataacccaaactggcacccaagatgaattttattggccatgctgttctggaattgtaaattttttacatctccttcaaaatataaagtatagatcatagtccaagttagaaaaatatcctaccaaaaattgtccaactgcagaaccatgactttgcttattatttacttatatcaataaattacattagaatgattgactgttgtccatgttatgcacagaaatcaacataagataatcaccttatttgactgcagggccatagcattccttactcatttttatttatgtaataaataatgttacctgggaaaatggaaaaacggctatgtgtcaaagtgtgtattcagatgttctttcttctcacatttttctttaacaatatatttcaagagaaagactatatttcaagtaagaactccaatctttttttaataggaaaaaatgtttaacaccaaggtaggaaaatattctcaacatttccttcgtgtagaattgtattctttatttttaaattttaattaactaatttgttttgagatacagtctcaccacttcgtcaagcaggctggagagcagtggtgctctctcggctcactgcaacctccacctcccggtttcaagcaattcttgtgcctcagcctccccagtagctggaattacaggcatctaccgccaagcacagctaatttttgtatttttagtagagacggggtcttgccatgttttttgggctgctctcaaactcctggcctcaagtgatccactggcctcagcctcccaaactgctgggattacaggcatgcaccaccacacccagctaatttttgtatttttagtagagatgaggtttcaccatgctggctccactggtcttgaacccctgacctcaagtgatccgcctgtgccagcctcccaaagtgctgagattacaggcatgagctattgagcctggccctcttgtggagtttaaaatttttcttttaaacaatcccaaatttgtaaatacatactagcaccagtatcattttgttataacttaactgctgtgaaatataattattactttttgactgtattctttaaaaatcctgtaatacacttcataagcaaaaattgttattatttctaaatgtttttccatgaattaaagaaggtttagccttcttctaatgaactataagtttgctaattttgccctattgttttgtatagatcactcttagaatcatttaggtgataaagtcactagcagatacaaaagagggactctgactgactgaaaaatctagatagatgttgaaaatgtgaattatttataatagaataatacacaacacaaaaataaaatggtattttaagattaatgagatttctaggtgaattatttccaattttaattattcatactactctttctttgatttttgttagtaatcttggatagtcaatcttcagatcccactaagacagaacactagaagctttaattctattctgtcatacaaacctctgtatctagatgataaactctgtgagaaccagaactaaaactttctggccttcgttattttgccagctccttacatagggcctgaaatagagactgtgtatttgttaaaggaccatggtaaaaggatcacatttagtaactaaagtttgatgcagattagtaagcatttttatttaagtaaaaataagaacaaaaaatttgttcctgataaacctattggtgaatgaatcttaaaacatggcatatatgtttcattattttaaaactgttattctgtaaacattttaaacttattttatataatgtgttttataattttaaaattcgagaatacaatttgctatttattatttctcctgattctagcacaaggaaacatagttcttcccgtgattttaaatattgacttgcaagctcatatttggttattttaatccgttgagatttcttctgtaatgtccacctgaaggcacttcagagagaatatatattttccttctgctaggcactatgaatcaaggactactttaagttgaaagggttaaaaatgtgaacgctgatctttttgttattgttgttgttttgagacgagtctccttctgtcgcccaggctggagtgtagtggcgcgatctcggctcactgcaagctccgcctcctgagttcatgccattctccttctcagcctccagagtagctgggactacaggtgcccgccaccaaggccggctaattctttgtatttttagtagagacggggtttcaccttgttagccaggatggtctcaatcacctgaccttgtgacgatcatttttaaggacagcaatgtggtaactttttattgtccctccaccttagctcaagcttatattaatggtcaaactgatgtctttttgttgatgataagtttcttctaggctagtctatgtctttcagagtgaagctcctcagaggctctggacttatgctgaagttttagtttgacctcctttcattcctcaagtttctagttcctggaatcagcaaatatctacagggtgctccagctttcagaatacactctgctggtttttaatgatttggtttttcatgaaagtgatgttgagagtttaaaagcatttgtgttgcatttagtctaggtttttgtagtgagaagtctttcagactttcctatttgccacacagtctaaagcagaagttgaatatgatgaaatatttatagatgttaagctccaatactgaatattaaaagcaattcaagccattgcagaatcatccctgaaaatttgtatttattttctctctgccagttacctagtttgtgagacacatgattaaatgtgacataaaaattaagttcataaagaaaaatacaataaatctatatttatatcacataaatatgaactgtaaaataattcagtcaactaaaacagattcacatttcaatagtgaaagtgctctctgttaagaagtttggtctgcattgtggaagacagtgtggcaattcctcaaagacctagaaccagaaataccatttgacccagcaatccaattactgggtatatacccaaaggaatataaaccattctattttaaagatacatgcacacaagtgttcattgcagcagtattcacaacagcaaagacatggaaccaactcaatgcctatcaatgatagactggataaagaaaatgtggtgcataaacaccatggaatagtatgcatccataaaaaggaacgagatcatgtcctttgcagggacatggatgaagctggaagccattatccacagcaagctaacccaggaacagaaaaccaaacactacatgttctcactgatatgtgggagctgaacaatgagaacacatggacacagggaggggaacacacactggagcctgtctgggtggtagcgggggaagggagagcatcaggaaaaatagctaatgtatgctgtgcttaatacttaggtgatgggttgatgggggcagctaaccaccacagcacacatttacctatgtaacaaacgtgcacatactgtacatgtaccctggaacttaaaataaaatttaaaaaaagaaaaaaaaggaaatttagtctgaagaagaaagacaaaacctcaggattgagagaaaaggaggagagagagctactttcaattatttgaaaaggctttcacctggaaagcctttgacaaagttcctttgacagagaatgattatgaagaagtcaggaaaacatatttttacaaaatgatatattccaccatttgttcattgaatattttgaaagtgatggccatgtgtgaaaatctgtgctggtcttgtgccggtcttcaaagggaatgcttccagcttttgcccattctgtatgatattggctgtgggtttgtcataaatcgcttgtattattttgagatccattccatcagtacttagtttattgagagtttttagtatgaaggaatgttgaattttatcgaaggccttttctgcttctattgagataatcatgtagtttttgtcattggttctgtttatgtgatgaattacatttattgatttgcatatgttgaaccagccttgcatcctaggggtgaagccgacttgatcgtggtggataagctttttgatatgctgctagattcagtttgccagtattttattgaggattttcgcattgatgttcatcaggaatattggcctgaaattttttttttttttaattgttggatctctgccaggttttggtatcaggatgatgctggcctcataaaatgagttagggaggagtccctctttttctattgtttggaatagtttcagaagggatggtaccagctcctctttgtacctctggtggaattcggctgtgaatccatcttgtcctgggctttttttggttggtaggctattaattactgcctcaatttcagatcttgttatatgtctattcagggattcgacttcttcttaggttagtcttcggagggtgtatatgtccaggaatttacccatttcttctagattttctagtttatttgcatagagatgtttatagtattctctgacggtagtttgtatttctgtgggatcagtactgatatctcctttatcattttttttattgtgtctatttgattcttctctcttttcttctttattagtctggctagcagtctatctattttgttaatcttttcaaaaaaccacattctggattcattgatttttttgaaggattttacgtctctatcccttcagatctgctctgatcttagttatttcttgtcttctgctaggttttgaatttgtttgatcctgcttctctggttcttttaattgtgattttaggttgttcattttagattttagatctttcctgctttctcctgtggacatttaatgctataaatttccctctaaacactgctttagctgtgtcccagatattctgctacattgtgtctttgttcttattggtttcaaagaacttatttatttctgccttaatttcattatttacctagtagtcattcaggagcaggttatccagtttccatgtagttgtgtggttttaagtcagtttcttaatcctgagttctaatttaattgcactgtggtctgagagacggtttgttatgatttcctttcttttgcattatctgaggagtgttttacttccaattatgtggtcaattttagaataagtgcgatgtggtgctgagaagaatgtatattctgttgattcggagtggagagttctgtggatgtctattgagtccacttggtccagagctgaattcgagtcctgaatatccttattaattttctgtctcattgagctatttaatattgacagtggggtgttaaggtctcccactattactgtgtgggagtctaagtctctttctaggtctctaagaacttgctgtataaatctgggtgctcctgtattgggtccatatatatttaggatagttagctctacttgttgcattgatccctttaccagtatgtaatggccttctttgtcttttttgatctttgttggtttaaagtctgttttatcagagaccaggattgcaacccctgcttttttgtttgtttgtttgtttccacttgcttggtaaatattcctccgtccctttattttcagcctatgtgtgtatttgcatgtgagatggttctcctgaatacagcacaccgataggtcttgactctttatccaatttgccagtctgtatcttttaactggggcatttagcctttacatttaaggttaatattttcacgtgtgaatttaatcttgtcattatgatgctagctggttattttgcccattagttgatgcagtttcttcatagagtcgatggtctttacaatttggtatgtttttgcagtggctgatactggtttttcctttccatatttagtgcttccttcaggagcgcttgtaaggcaggcctggtggtgacaaaatctctcagcatttgcttgtctgtaaaggattttatttttcctttgcttatgaagcttagtttgactgaatatgaaatctgggttgaaaattcttttctttaagaatgttgaatattggcctccactcttctgcagagagatccgtggttagtctgatggacttccctttgtgggtaacccgacatttttctctggctgcccttaacattttttctttcatttcaaccttggtgaatctgatgattatgtgtcttggggttgctcttctcgaggagtctctttgtgttgttctctgcatttcctgaatttgaatgtttggcctgtcttgctaggttggggaagttctcctggatagtatcctgacgagtattttccaacttagttccattctccccatcactttcaggtacaccaatcaaacgtaggtttggtcttttcacatagtcccatatttcttggaggctttgtttgttgcttttctttctttttttctctaatcttgtcttcacactttatttcattaagttaatcttcaatctctgatgtcctttcttccacttgatcgatttcactattgatacttgtgtatgcttcatgaagtactcgtgttgtgttttttagctccatcaggtcatttatgttcttctctaaactggtcgttttagttagcaattcctctaaccttttttcaaggttcttagcttccttgtatggggttggaacatgatgctttatctcagaggagtttgttattacccaccttctgaagcctacttctgtcaattcatcaaactcattatctgtccagttttattcccttgctggtaaggagctgtgatcctttggaggagaagagacatattggttttgggaatattcagtctttttgcacttttttcctcatcttcgtggatttatctacctttggtctttgatgttggtgaccttcggatggggtttctgtgtggatgtcctttttgttgatgttgatgctcttcctttgtatttgttagttttccttctaacagtcaggcccctctgctgcaggtctgcttgagtttgctagaagtccactccagaccctgtttgcctgggtatcaccagaggaggctgcagacagcaaagattgctgcctgttccttcatctggaagcttcctcccagaggggcacctaccagatgccagccagagctcagctgtatgaggtgtgtcctctcttaccactcctattcaacatagtattggaagttctggccacagcaatcaggaaagagaaagaaataaaaggtattcaaataggaagagaggaagtcaaattgtctctgtttgcagatgacataattgtatatttggaaaaccccacagtctcagcaaaaaaatctcccgaagctgataagcagcttcaacaaagtctcaggatacaaaaccaatgtgtaaaaatcacaagcattcctatacaccaataatagagaaacagagagccaaatcatgagtgaactaccattcacaattgctacaaagtgaataaaatacataggaatacaactcacaagggatgtgtaggacctcttcaactagaactacaaacaactgctcaaggaaataagagaggacacaaacaaatggagaaacattccaagctcatggataggaagaacgaatatcgtgaaaatggccatactgcccaaggtaatttatagattcaatgctattcccatcaaactaccattgactttcttcacagaattagaaaaaactactttaaatttcatatggaaccaataaagagcccgcatagccaagacaatactaaacaaaaagaacaaagctggacacatcatgctacctgactgcaaacgatgctacaaggctacagtaaccaaaacatcatggtactggtaccaaaaaaaatacatagaccaatggaacagaacagaagcctcagaatatgccacacatctaccactatctgatctttgacaaacctgacaaaaacaagcaatggggaaaggaaatccatacttcatcaatggtgctgggaaaactggctagccatatgcagaaaactgaaactggaccacttccttacaactcatacaaaaattaactcaaggtggtttaaagacttgaatgtaagacctaaaaccataaaaaccctagaagaataactaggtaataccattcaggacataggcatgggcaaagacttcatgactgaaacaccaaaagcaagggcaacaaaagccaaaattgataaatgggagctaattaaactaaagagcttctgcacagcaaaagaaactatcatcagagtgaaaaggaaacctacagaatgggagaaaatttttgcaatctatccatctgacaaagggctaatatccagaatctacaaagaacttaaacaaattaacaagaaagaaacaaccccatcaaaaagtgggcaaaggacatgaacagacacttctcaaaagaagacatttatgcggccaacaaacatgaaaaaaaaagctcatcatcactgttcattaaagaaatgcacattaaaaccacaatgagataccatctcatgccagttagaatggcaattattaaaaagtcaggaaacaacagatgctggagaggatgtggagaaataggaacgcttttacactgttgttgggattgtaagttagttcaaccattgtggaagacagtgtggcaattcctcaaggatctagaaccagaaatatcatttgatccagcaatcccattactgggtatatacccaaaggattataattcattctactataaagacacatgcacacatatgtttactgcagcactgttcacaatagcaaaggcttggaacccacccatatgtccatcagtgatagacggataaagaaaatgtggcacatatacaccatggaatactatgcagccataaaaacggatgagttcatgtcctttgcagggacatggatgaagctggaaaccatcattctcagctaaccaacacaggaacagaaaaccaaacactgcatgttctcactcataacggggagctgaacaatgagaacacatggacacagggaggggaacatcacacactggatcctgtcagccagtgggggataggggagggatagcattacgagaaatacctaatagctgtagctgatgggttgatgggtgtagcaaaccaccatggcacatgtgtacttatgtaacaaacctgcaggttctgcacatgtatcccagaacttatatatatatatatactgtgctgggatcacaaagaataaactgtgttccagtgctaaaattctgcttacagtttaagaagacacaatttcaggatatactatgatacatattatttgtgataaaaattgaattgtgttttataaatgtgagatagaataattctgccacaacagctgtgcatattaaaaagttatgtagaaccctacattaagcaattcatcattgctggcagaactgcaaaatggcacagtcactttgaaaaatagcgtagaatttatttgaaatgttagagttaccatataacctagcaattccacttctagttatacatacaaggtaaatgaaaacacatgtctataaaaaagcttttatatgcgtgttcatagtagcattattcataatagccaataaatgaaaacaacccaaatatctattaactaatgaatggataaataaaatttgtacagccatgcagtggaatattaattggcaatatgaagaaataaagtatttataagctataacaaagattaatcttgaaagcaaaagaccccatattgtaaaatttcagttacagtatatgaaatgtccagaacagcaaatccatagaggaagaaagtagcctggtagttgccagggccttggaggtggggcaagtggggaataattgctaatagatacagagaagagggtgatgcacatgatctaaagttagatggtggtgaaggttgctcaactctgtgaataagctaaaaaaaacactgaactatacactttaaaaggtgaattttatgctatttttttttcttaatacagttgttatgaaaaactgtaaggaaaaaactatctaaggtatttaaaaatcaaaatggaaaataactttcatagaaggttctatttctgaagtttaatattttcaattctataagatatatatttcaattttaatgaaatttctgctgtacacttgggaacttataacattataaatgtaatcatttcaaagtattttatagaatcacccttctcccccctcccttttttttgggtttggtgaccgataaaagtaaattatttcttgcccttgtgcagaagtttgaagtatccctcggggtaggaatcacttttaaaatgtcctactgtttcactgatggtgctgtattcttaaaggacactgacaaaaaaataatgtggcattacctgggcgaaggtcatttccttattaataattctacaatatcctggtactttcagagtttcatttttctgccctatgaaagaccaaataaaaagcctaaaatgctgacagaatagaagtcaaaaactcttgaggtggctgtaatggacaaataaaaaaaaatagtccacactattttgagtctggcactatgctagacactttggaagaaggggtggttttaaccacagtgatgctgattacctagtggggaaaacaaagcacgtaaatagttatatacaatgagacagaggctagtgatgaagatgtgtgcaaagtgttctaggaacactctggaggaggtgggattaatggtgactgtgggaggcagaaataccctcaaagatattaatattttcatgttgtacaataatattcaaaatttttccaggcttcatttgccataatgaatttatacaattaaaattcacattctgtaatttaagtatactcccatgaattcacataatagcactattcattagagtactacggaaatgaattaccattaatattgagaatatacatgctaggccagacccttattctagcaagagaagcatttgaccaaacttgatctcagcttttaaatctctactttggcataatttaaaacttcatatgttaaatatctttcattaaaataaaaatagcattgctaattttaaattcccatatttctattaaggctataagttgtgatgattttcatataactaattttggagatgaaatttaactacatgtatcaaaatgttttaaaatgttttctttctttgaatcagtaattcaaagaaagtgattcagtaagtgatatgataaaattaacaatataatatatagctacaatataattatttcaaggatatttagagacataagaaaatgcttattttatatagtaggtgaaaattataggctaaaaactactttaaaattaatgattcaaattatttttaaggccaaaaggaaatcactagcttgagctatatttcaaaaagccagcctagtaaatgagtatagggattatgaagtttttgcttgtcttcaaatttctaattcaaagtgatacttccataaatgtgaacccaatgcattatctagtcaatatatgcacttttaagaagacatctcattttattttagttgttctcttatttatatcgtttttgtacaggttatgtttttcttttcatcatcatttagtctttttttaactccttaatacactttatataattattcttacatattacatactcaataaatatatattttttaaaaatccttaacctataagttagttgcacctgtgtcacttccaatatatttttcctctagtgctaagaaataaaagagtactttccccaaataactcactcagatatacaactctcacctcaaatctgtcaccccttttgtgaatgaaaaatatttattttaaaactctgtgctctattaacttcagcctagatctaaatgttgtgtgctagaacacaaatgaatcacaagttcacatgaaaatttgttttaataaaggtatttcaaattttgtgcaagaaatgtataacacaagtcacaaaatagtaaacaaatcacttaaaatataagtttctatgagacgataaaatgtaaatttttgccattattgattgcaaaatatgaaagtctgaaactgcaaataatttgacaccctttatttaaggaacattgaatgttaaatgtataataatataagcgacataatttttggaactaaatgacttggcaagttccattaaaacagactaagtaccccatctgcaattaaatttattaaattataacacagataattccagcatatatgaggtcattctgaaagaacattcctattttgactttacttttcatttagctcattgtacacaatctctgatatattatcatacatttttagcgttataaattaatttttaaatgaaatgtaacacataggattaatagtaaatataatttcactatatttcaagcactgttctaggcacttaatatgtatcagcttattgactataaacaataaccatatggtgttgctaccatgatgatcccattttacatgtagggaaatagtggcacaaagagtttaagtgattttctcagtgccttacatgccttactgtcttatgtggcagaattagtactcgaacccagctagctggtaacaaaagttcagtttaatcactaagactgtacttctactttcattttattattataacatgaacattgcaacataaactaatatgccatgcagaaaactttcaggatattaacacatataaaacatttaaaaacatagtatttctagaaattatattattgatagaattttcaggtacaaattgccttaggaaaaaattctatttatgataaacatatgccaatttttttaactgcagatttttagtgatagatctattcaataaatttgcacaaagattttcaaatttagatgctggatatttaaatcagcttgtcattacatcctaaaactaataagtatgccatgctttatccatgtaactcatatcatcaacagtaggacatcagccacacaacttcagtttagaaaagtagtactcatatccactcttggctgacagtaatcattaaaataataatagatgataacattttttagtccacctcaagaaataatttttatataactgtcaactccaattttttgatgaggaaataaaaatgaaactaaaagaaaaatataagatcttaattgaacctgaaaacatatgccaatcaactccatccccttcttatagtcaaataataaaccatataaagccttggtaccagatttcttttaaaaatacattaatccctttgtttactcaatgcatatttacattttgcaaaacacggtgtgatttctgtccttagaaagtttcccttaggaaagaaaaacacgtgatcatgcatagcacagtgtgttaagctttggagcatctggaacctcaatttgccttgactggactggcctagaatatccactggagtgagttggttatctgtctatttacatgagggagaaaggtgacccctggaaagacgaagtagcaaggaggttaaagtctccagctctcgaagcaactgcttgttatttgaattccagctccatcttttttagctgtgtgttcttgggaaatttagtttaccttttttgtgttttatcttattaatctgtaaaacacggataacagaaacaagcaaagtcttactgggttgttgtgagacttaactaagttattcaggttaaatgcttagacaagtatgagcacttggtaagtgttaacaatgaattactattattattattattattaattactggaacaaactcaaagcttgtatttttaagggtgggagggccttgtcactggcgattctaggagtaagctgtatgtctccaagtcctgccaatctataggtaccgatattgccacatagcagtggcaataatcagcttccatggctgatatctcacacccatgctttcagaattctatcaggcccactcttaggattctttcacagtcaattccagttatttctttaaggcaagaaacaaacagtgtaggcataatatcatgaaaatgacagatgtttaatggccattgtgatatctgaaaaagctgacaaaactatatggaaagaataattaatataaatgaccatagaaggcaaaagaaatatatcatatttaaaggtaatctgaaatgtgtgtgaggacaatgaggcccataatctgattttatgtttaacatctgcatttccatttaattttgtattcattatcacttttaaagtattgatttaaaaagccatgtaatatagttagttagtggatacattagttgtggccgataattcctttatttaaaccagagaaagtagttttcctatgtaacattactatacataacagttagggaggtttgatggtctatatttcattgtctgttcctgttattttattattccagtttcttgttatatttgcctttggagaatagaatcagacaaacatgaaacctttgtcatatacagaataggaccataataaagccagaatgaactccgatttttattgacaagtgagtaaagtgtactacgttctcatctgtttcctctctctaccaccacaattcttttcacctgacattttgccatttttgggaggttttcaaggatcatatcctatgcctccctgctctgtcataacaggggatttcactgaagttacccccaacacacacacaaacacacccacagagagacaaaggacaatacaaagctatctccctctctttctgtcaccatatccattatcatggcacctgatactatctgagtgaattctgtcactcactcaaaagcccacgggccttacagcctactcttaagacactgattttactaattttgcattgtttcttctgtttaaggtgctcttccttgccctgtctatttggaaaactcttcttcattctttagggctttgatgtcacatcccctattctaggaagcctatgatcttcagacaaaatttggaaacctctcctcaggtttcccattgatgagaatatatatttatggggctataattttttgtacagttgtctagttcccacacgagaacacatgactctgaagggatggatggtcctttcattttaaccttctcacaacaatgtttctgaaaagggcagggtcttaatgtgttagaatgaataagctacctaatggaatatatgtatacaattaggcacagcgcaatgattctatgactgcaggttagccacataaacaagtatctgtcctatttcgacaaattaggccagatcaccaatgcccaacttttcttggaccagatataccatttaccatattctcaatatgtgctgacttggtaacattgagagatacaaaaataataaactacagtaattggaattattaatgactcaggtatttcattaattttaggcaaagtatccttaaagcattggaaagagtttaaaatttagttccctagttgctcagtattctaatatctatttctgtatctatatatacatctaataatatatatgggtgtatatatattattaataggtaaaatattcataatagatcattattttttaagtatttcacaaaatgctttggaaggaaccgtaaaactcaagatgcattccctatgatcaaggacattacttttagctttctttatttgaatgtttgcatttgcacatgtttcaatgcacctgttgaaagcaaccaaaataacacagagaaaaatcattagacagttttgattatgaactgggagaaaaagaatgtagtttaaaaaattaaccttttccctacttttctcttagttaccatactccactgccacacagtacagaaaagaaaaaataaatctatctttgagaaatgtttcattttcacttgaaatgatgcaattagtcactgctccatatatttgtgtttgaaacgtttctatcaagtataatcttagccagagcaccctatagtgtacaagctatacatgaatagtgaaagtattgtatttgttatttgaaatgtgtcgatgcagcacacttaattcaaaacatttatgagtggaggttgacaagtctgtccttctaactcttatggcataacttactatttatatgctacctgtatttcaagatccattctgtgttctaacactatagagaaggccaattgaatattccctcagatagaaatgaaagttctctctctgtccatctatctatttttctatctctttttcttattattacaatctttcttttgtatgtatccacttaacccattgtaacattttccccattataagacctagcattcctcctcttattaagaataaacaccttagcagtattggctacatggctgatgttgaattaagcgaattaagttgttggaaacacacaattcaaatttactatgtttgtgaatccaaagataggtttactcgtggagttttaggagttataaggtcagcctttggaaaattctgaattcgttttttaattatttcctgcgaatattgctttgtaggatatttctagaaacgcaacccactgaaaatagccaatctaaacattacaatctcagcataaacatttgcctcagtggaagtccttaattaccaaatggagagaaatgcatgcaggctgtcagcatcatgtttctccttggtagtgtctctcaccattttgccaccacgaatgtttctaaatggccaacatactacttcttctcatttgaatgtttatgtttgagaaaatgcaaaaataagagcactaagtgcaaacagaggtttgctgaagtttgtgtatttagctcctatggcgttctggatgccagattcacattcattagacataaattgatgttaagcagccttgactgcaggaggaaaagcaacaacaaaaatctcttcatacctctaagactttcagtcagattcttttcttacagaaccccattctgccattccagcacactgttttctgttcagtcttatcagtcttttcctgctttattcttgttttttgactgctgtttatgccacttaggcatttgcttatactggtccccatagattttcctcctgtttaacatcacaatggactcaactttctttgaagcatacctcgtctatggaagcaaatgacatcctaatttgttaactctaaggcattacagaactttattccttcaaggcctctaactttacttttggccttatcttctgccatgtcccatctgaacacaatgctgctttcacctgttcctttatactctccaggaggactgtgcaattgttttccttctgcctgaaatactctgttctatgtcatcttctgagataaggcttcccttttcacccactctacagtaggtttctgcaactcatttttaccaattatgatctctctctcctctcatgttttaagacagttaccttttaatgtttctggaattactttttttgtttttttgctttgtctccactgtattgaaataattgccaatccaggtttcttactttcaaaccttcttatatttaattcattttacaggtaggttattacttatcacaaatccttgtttggacattttatttcctcatctccatttatttcctcattctccccaaaaaaagtcaccccaccatttgataaatccctcatgtttagaggataaaatgaattgtctttatttattgctagagagtgaatgtgaaccctcaaaattcatttgttgaagccctaagcccgatttgatgggaatttgaggtggggcctttgggaggtaattactgttagataaatccatgagggtggagccctcatgatgaaaagaggagacatgagatattgcgctctctctctgtgccacgtgaggatacaataggaagcagactctcaccagacactggatccaccagtgccttgatcttgaacttctcaacctccagaattgtgagaaataaatagctgtttaagccactcggtccatggtatttttgtcctagtatcctaaattgtcgaagacagcactttatcaaggtcatcatgtactagtctttacctatagccctaaaccaaaatgtctaatacttctctaaaaggaacactctgcttcagggaagaaagaatgtttacaacatttctgctgttcaatttagcctcacatcatttctcttgcctggaacattatcttattcacccttcaatgtttctaaatcctatatacttaatttaaggcctagttcaagttgtagtacttcattgaatacttctccaattgataatctttcaatttttattcataattacaagatcgaggcagaaagagttttgtgtgcctgactttgtagacttagtaaaaatagcttcaccatttttttttaggaaataaaagcataatgtaagtactacacggcttatgtttgatataataacatctgcacaaaaaaacccacaaaaagtctcaattactctttttttttcaaaagtttatcacattccttcatgcatttactaattcaaacacatttataggtttccttgaagaggtccaggcattctgccagaaaatgggattatagtagcagactaaatttagtcaaaacagatcaaactccttgcccctagggagcttacatccttgcagggatgatagtggggttggagaggaagacattaaagaagacagacaaatacagagtgtgttacatggtggtaggtgctatagagtaaaataaaacggggaggggtggagctgcaatctagatagagatggcagaaaacacttaggaggagtgtggcatttgagcaaaggcctaaagacagcaagggagtaagacatgtgagtagataaggggtagttggaatatttcagagatgacagagtacttgaagcagaaggagccatgaagaggagaccacatctcagaggtaacttaggactcaagtatgcaggactctatgggctattatgagaacttggcttttgggaagcaaatggaagatttagagcaaaaattgacatggtcagatttctgtataaatgtaatcctttcagctgctatttgaggaacagacttaggtgaggcaaaagaggaagtaggaaaatcaatgagaggactattgaaagaatctggaaaaagataaaggtgacttgaacctaagtgttagctatggaagtgattgaagtagatagattatgcatatgttttcaagataatgtcagcaggttgaacaattatatgtgggtgagagataaagaggaaagtcagagatgatggaagatgactcagagtttttgccaaagcagctggaacataagaagagagattggaaaaattatgagaaaaggtttggaatgggaaagggaattaggaatcagtttttgatgcgttaaattgagatgtcaattagacaactaagttaagatacacatttttggtgtctggagtttgggagaagggtccaagttggagacgctaatatagaagtcatcatttataaaaaggtacttaaatctctaattcagcccaaattgctaaaggtatgagatagacttaatacacagagaagaggttcaaggactgagtcttggtacacttctcagtgttcagatgctgggaagacaagaagagagctaatgaaagatactgagagagtggctattacagggatgggaaacaccagagaagtgtgttactgggagcctggaacatgttacaaggaggaagttactaactctgagaaatagccctgaggacttaaaatctgtcaccagatttggcaacacagaaatcactgatgttgttaatattgtcaggttcactgaagagatagggggcaacagcctgggaagatacagaagagaaaaattggagataatgggcattcaaaactttttgaatcactttgctgtaaaggaactgatagaaatcaggatggaaggtaactagtagcacagatggaattgagtgtgtgtttgtgtgtgtgtgtgtgtgtgtgtctatatatatatatatatatatatatatatatatacacattggaaaaaataacagcattttgaacatagaaacatagatgaaggcaggtggggagatatgatgttcagagatgctgttttctcagagaaagaagcagagtcaataagaaaataaacatgaaaaagttattattagaaatttcagaaaaagcaaagttgaaaaagtgtcatttaggttagacctaaaaccataaaaaccctagaagaaaacctaggcattaccattcaggacaggcatgggcaaggacttcatgtctaaaacaccaaaagcaatggcaacaaaagacaaaattgacaaatgggatctaattaaactaaagagtttctgcacagcaaaagaaactaccatcagagtgaacaggcaacctacaaaatgggaaaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagtcaaaaaacacatgaaaaaatgctcaccatcactggccatcagagaaatgcaaatcaaaaccacaatgagatatcatctcacaccagttagaatggcaatcattaaaaagtcaggaaacaacaggtgctggtgaggaagtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatttatgtttattgcagcattattcacaatagcaaagacttggaaccaacccaaatgtccaacaacaatatactggattaagaaaatgtggcacatatacaccatggaatactatgcagccataaaaaaggatgagtccatgtcctttgtagggacatggatgaaattggaaatcatcattctcagtaaactatcacaaggacaaaaaaccaaacaccgcatgttctcactcataggtgggaattgaacaatgagaacacatagacacaggaaggggaacatcacaccctggggactgttgtggggtggggggaggggggagggatagcattaggagatatacctaatgctaaatgatgagttatgggtgcagcacaccagcatggcacatgtatacatatgtaactaacctgcacattgtgcacatgtaccctaaaacttaaagtataataataataaaattttaaaaaaaagaaaaagtgtcgtttaggacatcagtcttcaaacatgtttgctcaatcatcccctaacagaaatttagcaactgtgcctcctcacacatctataaattaacatctaaaatttgttattctatgtttacctgaatgccaagtatggaatttctgatataatgtaaattttggcatatatcaaattgaatcataacatttttgctattctaccctcaccattttacatgaataaaaaaaacataaattcttctttaaaatagaaaatttatatttttttattttgcctaaattgtagttcctttttttataacacagaaaatatttttaaacttaaagccacttactgatcacctaacataattctctgcaataaatacacttaaatactttgattttaaaatgtgtagggctaggtatggtggctcatgcctgtaatgccagcactttgggagactcaggcagaaggattgcttgagcccaggaattcaagatcagcctgggcaacatagtgaaaccccatctctacacaaaatacaaatacaaataaaaattaactaggcatgatggtgagcatctgtagtcccagctactcaggaacctgaggcaggagaatcacttgggccccagggtttgagcctacagtgggctataattgtgccactgcactttagcctgggcaacacagtaagatcctgtttccaaaacaaaacaaaacaaaagtataatattataaggctccaattttaaaatgttcttttgtgtttgaattctcataaattattattaattgaaaatgttaaaaacacatattataaagtttaatgtttaaatatgaaagacaggaagtaaattttattggcaatatatagtataatgacaaagataagaagtgatattatgacttaattgagaactacttcacagatgacaatgcagtgttttgttgtattgtttggagacccaggagtttttataacttagagcaatgcacaataaaagaatttgggatgaatgaaagtgatgcatctcctccctcctccgcttctctcttttatttgaaggagataagcattttaaaatggatatgagaaaggtgaatcaactggattcttcaataggcaaatcatttttaggaaaggagctcttagaagttttaaattatccacaagcaatgtgtgatccgtgatttaattttggagtgaattaacaaaaaactataaagaagaagaatatttttggagacaattgcagaaaattgccaatatattagataatgctattatatcatgtgaaatttcttgggtgtaataatggtattggggttataataggagaaagtcctcatgagactttctgaagtcactgaagagagacactgaagactttaggagtgatagatcatattttctgctttgtagtatcaaatatgtcagcaaaatgtgttgaggaaagaaatagatgaggtaaatgtggcaaaacaatcataaatccacgtgaatgaaaggaatcaataacaatactttctgcatactctgtcagctttaatatacaagatcagagagtccaatgtttctaggctctaaccctctgggatagaatgggaaaattcaacatgtagaaataaaactgaaggaatatgctgagtaaatgtatagcatgggaggtcaatgttgttacatttatatgagtaaaaccagaagaatggtttaatatgctaaaaatgggagccaactttgaggcataaaaataaatctgagaagttggatatcctatgccacagaccacagtctactcttcttgagtatgacatgccccagagcaaataaagcagacacgagaggctctaaaatggctttagccctactgaagctccatctacctggaggaagggtttacaatttttttaagtcaacaatcagtaataaaaagttgtcataattaaaattcccaaataataaaggtcaacatatatgtcctaactcatgcttggttcttcatgcatatgagctgcttgccagcagtgccacctccctagagacaaccaaatgtttaactcaccaatgacaagtgtgacttcagaaataatcctcttactgatttttatttgtgataaattaaaatgataatagaagcaattgcaccaagcccacattttcagatcattttatgattatttgtggctcacgagatgcttctaaatttctaactgagaccagtgtcttccttttttatctttccaagattatttgtaaattactcctttctattaattgtctcttcattagggcaaagttttcttatacacttttggtatatgagttaacataggaacacataatagagacagaagtagaaaaagggtctcctgccttccccatgttagtctttaagtgacatccctatttcattgatgtcttttttttttttttttttttttttttggggcagagttttgctcttattgcccaggctggagtgcaatggtgcgatctcggctcactgccactgcagcctcccaggttcaagcgattctcctgtctcagcctcctgagtagctggcattacaggcacacgccaccacgtccagctaattttgtatttttagtagagacagggtttctccatgttgatcaggctggtctcgaactcctgacctcaggtgatctgcctgcctctgcctcccaaaatgctgggattacaggcatgagccaccacacctgaccctcatagttgtcttttttgatgttctgaaatataacctaagttctagttctaaagagtttccttcaccttccatgagcactgctcagtttccttttccataatttttcctttcccaggcctttcaattaaattggtttggaaaagacacagacaaggaggagggcacagtatcccaaatgctgataacaaaccaaaaaccttaagggctgctgttctgcaaatttacagagttggcatggtgcaagaaagcaagctgtagtctgtcacagatttttttctcaaatttagtttgaaataattttagatgtataaaagagttacaaagatactacaaagagttctcatatactctttactcagcttcacctactgtttgcatcacacataatcatggtacatctatcaaataaattaaaattaatgaaaaactacagactgtcttcagatttttcaatttctactaatattactctgttccaggatccaattcaggatacagatgaaatgttgtatttcatcaggtctccttagtctcatctaatttgtgacaatttctcagtctttccttgtctttcatgatcttcacaggtttgaagagtactggtcacataatctgtaaaatgtccctcagtttggatttttctggtattttttcatgattactcatgattacactgtgaatttttggaagagcagcacagagaggatgtgtccttcttattgtatcctttcagggaatacagccatggggattttatttaacttattaatttatttattcattatttatttatttatttattgagacggagtctcactctgtcacccaggcttgagtgcagtggcgtgatctcggctcactgcaacctccacctcccaggttcaagtgattctcttgcctcagcctcccaagtagctgggattacaggcacacaccaccatgcttggataatttttgtatattttgtagagacggggtttcactatgttggccaggctagtctcgaactactgaccttgtgatccccctgccttggcctcccaaattgctgggattagagacgtgagccaccgtgcccggcatcatggggattgtaaaatgcatgtttcccattgagaaagtgaggtaaagaaaagaactgtgcatcaagcaatagaaaaaaaatcaatattctgtttttactggcacttttggcctgctggccataagccaatactataaactagcaggtagggtgctgcaagaatgtcaatacttctgccacattaatctttgcaggcttgccgcccctgcagttaactcatggagcatcctttgccaggacatacatctgcctctgtaccatgcccctgtaatgtgtcttcaaagggtgcaccattccacatctgttctctatcttttatgaccaaccactacaaaaactagagagaatccccaactgtttgttttctttcgttccagttaagaaaattgatgataatctcaaaaaaggggctattaactcttattatctctttcattttatcttcttcctctcttttaccctacatctgagcagggggccatggttagaagcaatgccttcaggaagtacgcactctttcccaaattaattctcatcatggaggtataggatcagctaataataattatatttttgaggaacagagaaagaggacaaaggggagaggagtcaccacttataatccctaccaggatagctttgtactgtgctaaacactttttgtcagatcccatttaaatctgagatgcctataaggtaagtatcattttctctatttgactgatgagaagagtggacttcagtagaatttaaaaaattcttcaaggttagctggttagtaaatgagtagagaccacaggtcatagtattttctctctccctcacctggaagaataaatcattcataccacctcagtatgggttaaagccagacatcttgtcagtgcttcctaaaaaaaaaagaaagaaagaaaagaaagaaattgtttttcatatgagattctgtgtctgggtccctgatgatttcctatgcctaagtatctacttgataatctctccaaaacgccactcttccaacactctgtgttgctattttcagtcctctccaggaactcttaaactaaaggacatgacccccatgcactgacaactacttcagccacctcaactctgaccagtccctcaaagcaggaagccatctgttgttattttcaccactaacaaatattcacggcctcatgttttcccggcacatagtgaacacgcacttatcttccccctttgaaactaggtgtggccatattcaaatcaaaatcctgccctttggtagttataagacacacaaaaaaactgaggcaggtattagagttagaattctagtctctctggcccaaactctgacctcataaccactgcaagataccctccctatcctatagagcctagtactacactaccccctcccaactttagcctccacatatagtaaagtgcttggaacacaaaaaacacttcataaattgtgctgaatgaaatcatttccatgagtgtttatggattttgagttcatttgtaccttttacctaaaattctagccactttaatttggagagtttccagagcaaagggcacagatcccaggcataacaacgctttgcgtatacagcaaccaatatcttgtcaacccaagaaagttcctccattgatacctagtagaaatagcccagtttttaaagtcctcaaaactgtaacaaattacttgtttttaaaatttaacttaaattaatacaatcagatttttgtgttatttgggtattagagtatgttaaagcacatatatcccagagacatagagtttccgtttcaaaaagtcatgcattcatgtgtgctaatgacaatcctatcctgacccgctatgtgacttgtatctctaaaccataggctttcctgaattttatctgttaatttaaccctgatttctcagcagcagcttctctttgtaaatagacttgcctcttctgtgtctgacctctgctcctcataatcagattaactcagataaagctgcttcagggaagaggtcaaaaccgttgccaaaaatagtagttgccctacttcagtctattttcaacagagtagccaggagatcctgttcacaccaaagtccaatcagccctactgttagcactctgctcacaagcctccagtggcttccgacctcactcacagtaaaagccaagtcatcctttagcctatgatgtcctacatgatttgaattcccttccattgatttttgtcactgatttttaaaaatccaaattcattctcatacagctgaattgtcctctttgctttaagtatgccaggattatttctacctcagggcctttgcacttgatattcccttcaccttttccaagatagttattccctcacctcagtcaagcctttatttagatgcccccttctcatcaaggcattctctgatctccttatttaaatgtatgacaccccttctttgctttacatttaatcagaacatgtatcactatctagcatataatacatttgcttgacctcttttgtttactgtctatgcctcctgaatactgtgtaagctccatgatacaggcacttttctctatttcgagcactgttgtattacagagccttaaaagtacctggcacttactagattaccaaaacacatttatcacacgactgaaaaagtaaatgaatagacacatcattattgatttttgcaaatgtttgaggcatgtattattattacccaataatgctagccagctaatacagctaattttatgtggtcatatttactaaaactttacacttttgttagaggtttatcattagtatttttattttcaaatgaagttttaaaaagaatatgctaaaggcagtattcttttcaaggtgaaagttggctcttaggcatatgtaatgctcctaacactgctattgtcaatttgttgctaagaaagatcaaaggagaaattgaaagccaaggatgcatagagctaggagatattaatgtggctttgaagaggaatatatccgagccctggcggtgggagagtttcataaaatagggcattttctctcagaaaaagggacgtgcagttttcggaacacttctctgttttccagtggaacaccatattttcacagaaaccatgccctgacctgatttataattttgagaaaatagttcaaatgcccttttctcattatgagaagatcatactgctgccaccacaagcatttcaccactgataattttaatactgactctcagagaaccaagtaagtagttgaacttaattccccagaaattattttgcaagaaaatttaccagcagttgctgcctacataaaaacgatatggaactgcaaacttgccatttaagaatcagccttttccctaaaacaaaggaaaattggttatagattaagaaacatttgtgcaatgtagaatcagttttcagttctggctgcatgtttacctgggaacttttgaaaatattagtatgtggtatttcatgtctatacttctcccacttccaaagatattctaatttagtgagtcttggtaggtcctagtaatcactatttttgacaagttcatccaaacgatttaatgtgcaactaactttaagggaaacatgtagtgggagaaaatgtatacaggcatatctgcctaatactcttcattgatgattcattcgttcatcctaaattacatcaagtacccactatgtgctaggaactgtgctaggggaaaaaggtgatggggtttagactgtagtctagaaaaaataacattgagcagaagagcagaaagtactactcaaatgttaataccactgctacattaatctcaacaacacactattgataatttctttccttttatcctcactcaagttaatctaatttatttgtaatcatttatctaaataatatctaagatctagtataactagtcatctataatctaatgcaacttgtaccactccactgcttccctgtttggaatgcctcctctaggacaaaacacaccctccatcaaaagccgtatgtctatggaaattttaagagagacagaggaagagaaagagaattcaacttcacttcaaaaccagacaaaaactctccacttcaaaaccttgcatatggattcttttctctagactaaacattcccacttcccataaataacacttctttctctctgatgagtcctttctgcctctccctcccactgccactgccctggtctggagttcctccgatgaggactgtggtaacaaccttctaactgatttttttaaatttttttatttttatttttatttttccttttagaagcttcaccctccaaatagtccttcactattccaagaatatctctgatatccagatctgctcatccacgctgtccaaaaaaacaaaacaaaaaacaaacaaacaaaaactctgtcaaatttccaccatccacatgataaagaccaaatggttttcccactgaccacatcataagaccaagtggtttagcatgacacacacagtcttctagaacttgactctggtcaaattctccagtgcagctctagctagccaagtctagatatacaggattactcatccttttgttattttgctaaaaaaaaaaaaaaagtttcattccatgaggaaataaaagaaaaaaaaaactttttagtcatttatgtaaatttttataaacttatagataaactgtgaattaaaatctagttttgtacagtaattaattatctctggtccctaataagttgagcacattgcttatttttctctagttataaattttatatttaaaaattgacctaaaagcctaaatagccatgtaaatgcatatgtataaacaaggcaaagctattttaagcagaatctacaatgtatgaaaaactggggcaaactaagtaatgcttagtcttaagactcattaaaaacaaaattctttttgttactgtagcatttaaaaaaatacaatttttaattgtatttgagcaaatacaattaagtacaattaaataaatttaatttgagcaaaacaatatatttaaaataagatgattaaagttagacagtgatatattggagacattattatttgttttgagatacttttatgtgcagctaatgagaaataattaaattataaagtaattataaataaattaggtatttcccatatatttaaaagtcttaatcaatgcaaaattctcttcctcataaattcttgaagctcagagataatggaactatggaaagaacaggcaatctatagaatgggataaaatttttgcaatctatccatctgacaaacggctaatatctagaatctacaaggaacttaaacaaatttacgagaaaaatcaaacaaccccatcaaaaagtgggcgaaagatatgaacagacacttctcaaaagaagatatttatatggccaacaagcatatgaaaaaaaagcttatcactggtcattagagaaatgcaaatcaaaaccacaatgagacaccatctcacaccagttagaatggcgatcattaaaaagtcaggaaacaacagatgctggagaggacatggagaaataggaatgcttttacactgttggtgggagtgtaaactagttcaaccattgtggaagacagtgtggtcattcctcaaggatctagaaataaaaataccatttgacccagcaatctcattactgggtatatactcaaagaattataaatcattctactataaggacacatgtacagctatgtttattgcaacactattctcaatagcaaagaattggaaccaacccaaatgcccatcagtgatagactggataaagaaaatgtggcacatatataccatggaatactatgcagccataaaaaaggatgagttcatatcctttgcagggacatggatgaagccggaaaccatcattctcagcaaactaacacaggaacagaaaaccaaacaccacatgttctcactcataagtgggagttgaacaatgagaacacatggacacaaggaggggaacatcacacaccgggccctgtcagggggtggggtgctaggggagggatagcattaggagaaatacctaatgtagataacgggttgatgcatgtagcagtggtacattcccacttccaaatatattctgatttagtgagtctttgtacgtcccagtaatcagtatttttgacaagttcctccgaatgatttaatgtgcaactaggtttaagagaaacatgcagcaaaccaccatggcacatgtatacctatgtaacaaacctgcacattctgcacatgtatcccagaacttaaagtataattaaaaaaaaaaaaaagaaagaaaagggaagaaagggccaaactactcaaaagaatgctgaaaataagaggttcagttgaatatgttgaaagtaatggtagaggggctgttaatgcttcatcttggcaaagacatagaaaatcttggtgattaatcaaaaggtcagaatccgttactctatttcctttccaagtgttttccccaggatggtttttgtttggtgttttattgagctcttgcttcctctgcaagtgagcctaatctatatgcagctctggagcaatgtctagcaattgattgttattttctggactctggctgcaggcttgtccatgaaagttggaaggtctaccacaaaattgcaagtggaggctcagtgctgaccccttctttttcctccacctctgttccacacaatgagttccctcttgtacatgtgtatgccctgagccacatgtaccagcttctcaactacaagcagtctccttttggctctatggtcctaaggatacatatgtcagagatgaggtttgcagacaaaggaggaggcccattcagtccttagaaataggctcagagcattggattagggattttcagggttcctggtacatgcagatggtgtagaagaggtaatgggatactgaattggatctagattcttggcctcaggaacatctgttctagtggtaaggaatgagaccaaaagaagaccagagcagggctgaagcacagagcatccgacagggttgcctcgattttctcacgtccctgatgtacagtaagcatttagtaccaataagtcatttagcagctgctgtatcatgaaaatgtttccatgctggtggaaggaaccagaatgaggatgtcagaagttatctgcaaagttacattaggcttatacaatattttttgtactcatatttctacaaagacctcagttataacttttattatttgcttatgcctatcattccattagaatacttcttttctttcttgtctgcctgaaaattttgcaagttttctttaaaagcccaggtcaaacttatactctgtatgaaactttccccaatcttccatcagcagaattaacttatgtttagatagcactttatacataactctaacttaacactgccacacagcattacatttaggtatatgtattttctctattagaatataaattcactgaacacatgatatttgctcattctttctttaccccaaaccaaatacagtatttggtatatacaaaggatacaactaacttttgatgaattgaattaaacacatatgttaagtttcctattcctacactgttttgtttatctttttcttgaaactaacttttgtcaagatcttttgtggaaaatgtgacagaatattctaggtattatgtaaccaggatggtctaaagtaggcaaattatctttattgattcagccaatcatttggaaacctttatttctgcaaagggccagatagtaaataatttaggcttttctgactatacagtctctttcctgccactcaactctgatgttatagcacaaaagcaacacagataatatgtatacagcaggcatggctgtgttccagtaaaactttatttacaaaaacaggtagcaggccagatgtggccctgatctataccagcacttcttaaacatggttacacaagagaataagtcctaatgctttaaagcatccaattacacactaacttccctcatacacatacagaatggtgatagttatgtactatcttaagagaattgagaaaatagttattcaaatagtatttttttttctatggttcagatgagcaatgctggctgacagaaatgcttatctagacactagacttccattcatagataagcctaagactatatgatatttttaacacaagctatcattggttcatattgattttctttccagacaaatccgcttaggtcttttatacttcagttgttttattatatctaaatggaaactgcatatttatcattattaattcttttcttgttggttttataaagaaaatctcccatttcttccataataaagcagtatttttttcaatctatatcttatgagcttgaaattgtatatatacaactaaaatccagaacataattattattaaaatgtctgagaaattgtttttaattgagttttatatgtacctcctaagtgactttttgtatccaatactccatccaagctctgtagatgttatcaaggcccaaaacttgaactctcaattagctcctctcttttattttttattcagtttgttagaaaagtttgttggatttatttttccaaacacatccagcatataaccactagcaaccatgctggtctgagtcatctttatctttcctctcaattactgtagtaacctaactgatctttgcttctgtccctgtctcctttagtctacgctaggcatactgctagaggagtccttttaaaacataaaacatatttgtctctcctttgttcaaaacccaaagagtaatcagttttagatggagaaaaatttatgagaaacgggagagacctgtccaatgtcacatagactggtaggtctgggcactagagcacaaacatctatcattgaatctgaaaccctatcacataaccaaaagtttctaaatgtaaattcatgtgctatttgttttcttagtattagacatttaaaaaaaataataccaaagagtatctactcctacttctgacataaataagtgctaagttccttagatctcaattctagtagtcacattgtattaaacttcagggtggggcattaactttattataggtacgcaatatataaatatatgtatgcttcttcatctctgaaataaagtttatagtataaatactatattcctcgtgtattatctgcaaggatcaaatgagataacatttatggtaagagctttgtggggccgggcacggtgggtcacgcctgtaatcccagcactttgggaggccgaggtgggtggatcacctgaggtcgggaggtcgagaccagcctgaccaacatagagaaaccccgtttctaccaaaaatacaaaattagcctggtatggtggcacatgcttgtaatcccagctattcgggaggctgaggcaggagaatcacttgaacccaggaggcggaagttgtggtgagccaagatcatgccattgcactccagcctggacaacaagagcaaaattccacctcaaaaaaaaaaaaaaaaaaaaaaaagctttgtaaaacttaaagaattataaatagcaagagtttactttctttttttttctctctttttaaaatttatttattattattatactttaagttttagggtacatgtgcacaatgtgcaggttagttacatatgtatacatgtgccttgctggtgcgctgcatccactaactcatcatctagcattaggtatatctcccgatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttacacatgcacacgtatgtttattgtggcattattcacaatagcaaagacttggaaccaacccaaatgtccaacaacgatagactggattaagaaaatgtggcacatatacaccatggactactatgcagccataaaaaatgatgagttcatgtcctttgtagggacatggatgaaactggaaatcatcattctcagtaaactatcgcaagagtttactttcacaggtatttaaagaatagaaataacgttacttcattgggatccaaaccaaagcagaaccttttgtccaattattatcagtgagatgtttgtttagatgtgtagatggtgaaactctagattatgccccttctcagtggctcacagacttccaaatattacacagaaattagaaaatggtaagagaaagaaggttttccattttagccatcatcttgatgacaaaagaccttcaaattttattattgaaagattcctatttcatcctcctctaacttttggactaaaagttgagaccagggtgaaataccaggtatagagcccaagtgaacaagcttttatttgcaggcatttatatagggtcttttctctgtcccaaggagattaggggccttggtgcccttgaaatctctgtcttcttcacccatattttcttgcttcaggaaaatacttcgaggtcttgcttctgaacctgctcactccacctaaccttttttttttttttgctcttgattcctgacttcctctgtggactcaaactatataaagtctgtccccatctcaaagttgtggatcacctctactcacttctacaaccatatatgctttctgtggacctagaacaggttggaattctgggaatctagcttgaacaagaaaggaacttggacgtcatctttaaagaaaatgttctcctttttccctgaatacaaaggactcagcatcattttggtgagaactcaaccttgcctttcttcatcagaagtaaaaagtgaatgtttttgaaagttcagaaccattctatgctatctgttagatgttaaaggcaactggaatttagaagaggagaaaagaacacacaccaaagataaaagcaacctcaccactccaactgcttaatttcctatgcttcacgttttggtttcttcagttggcaggttccaaaagttatctttacacatattcaaaatgtcaattgtatttcagaatccaaaaaattaatattttccaaacagctattatatatatttattatatatcaatattttccaagcagctattatatatatttccttaataacatatatacaaataaacagatgaggcaggcagatgcatacaaatgtgtgtgtttctgtatgtgtgtgtgagctccaatcacacttcccacaggaaccatacatttctcatgagctcctgtaatttgaactttaccaaacttgtcttcatactaacttttccaattaatcacatagaaactcaaactcgttttacatttgaatctggtaattgtgtaatctttatcagcagagcaaaaagctgaaataaattttaaaacaggtatatacaatatcatatctagaatgtattaattacttaggtatgagacactattcaaagctctttacagattttatttctttaattctaaagacaacatcatgagataggttctatgattgtaccaattttagcaacaacaaaggagatatggaaagtcacaaatgtgtgtggcaggcatagcaggaatttaaacagatgataaccctgagttaagaataacccgtggaatttctgatttgtgggtggaagaagaattctcactcttaactgttttttaaaaaattaatatagtgatgtactagttttgtatagtcatcataaaagaaaaaaatcttcaaagaaattgctattacaaacaaaatattcatgactaacaagcataaaaataaggccatgtctgaaatcatgttcacccacatgaaacattaaactcagaatcagccagggaggctgatgtgcaactaattagaaaacattctaattagttttctttatagttttccttgtttttcatctttatcctttccttaatcttcaaatggcagctgggtagatgtggtgaagttacatacacaacaataatttaccaggaaaaggaaagccatgttcaataagattttcattgcaagatacataacaaaaaaatctgttaattttcaagcaaagcaatgaaagctgaacactccctagcatacagagatgattctgaaaaatattgggtcaattttgtgaccatttttgacccatatctgggcattttccaatagtgtcaagagacatcatttacatttgaaaatgcgtatacaaaggaaaaaagaaacctctcaccactgccaacagacactttgtgatgggtgtgtcaattagcacaaacttttggaaaattattaagaaaataatacatcttcaaggaaaacattataagaaaataattagaaatgaacatcaagatttataaacaataatatccataggtaaaattgattaaaatgtaatttataatcatgcaaatttggataacataggaaaatatttcaaataatagtacatttttaaaaaggactgtacaggattatatctaccagtagatttcaaatacacaaaaatatattcaaagttgcatcaagctatttcctctatactgtaggttctgtgaggggaaaaacgaaaaacaaccctgatgtttactttcatacctttggcatctacatcagtatatggaacataatcaatgctcggtacaaaaaagaaagttaaatgatgaatgaatacatgtatttcccttcatatatattcaatatatgcctggtaagcagtcctttaagaacccaacatttccaagtcctgagctgattgtctaactgaatagaccaaacatttctacaggaagcagacagtgtctattcaaagaaagagtcctttcttctactcttagttttgctaaattgggcagtagaatgtttctgtttgttaatttgaaaaaaaaaaagataatagtctaacaactttttaggtttcttgtgcagtttatgtgacacaaggcatgaaaaacatttagcatataaacacatagcactaaataaatcagaggtgcagttactccagtaaacggaatctctcaaggcctatagagatgtattgtgtgattttctttttctgcctgcttttaagtttttttctgtagtgtccgtcaatgtcagcatgttagctaacaatgtgtttaatacttagcagatgctgtcttatcatcccttacttaaagtcccttaacggctccctaatgccttcattacaaaatctaaacacctcatgctgacacaaaacatacctgatgtcctggtcggcctctggctctcccttcccatctcccactgctatctcttatgtacctgcagccaaaacaaattacttacattctctgagcattctaccttctaaactttgtgatgctggacccagcctaaaatggaatttttctttaatctaaattctaatcttcctttaaagttaactcattagtttttattgcacttaaaaataattttagcttttctcaaaaatgtttaatttctaaactttttattgcttatttttatttcaaaatatttggggttcaggtggtttttggttacatggatgagttctctggtggtgatttctgagattttggtgcacctgtcattcgagcaatatactgtatactcaatatgtagtcttttttccctcactcccctcccattcttccccacaagtcccaaaagttcattacctcattcttatgcttttacagcctcatagcttagcttccacttataaataaatgagaacaaaatattgtatttggttttccattcctgatttacttcacttagaataatcaccttcagcttcatccaaattgtagcaaaagacattattttgttcctttttatgcctgagtagtattccatggtgttaagtaaaaagcttctgaacagaaaaataaataatcagcagagtaaacagacaacccactgggtaggagaaaatatttacaaactacgcatctgacaaaggaataatatccagaattgacacagaactcaaccaaatcagcaaggaaaataataataatcccatcaaaaagtgggcaaaggacatgaatagacaattttcaatagaagatatacaaatggccaacaaacatggaaaaatgctcaacatcactaattatcagggaaacgcaaagttaaaccacaatgagataccaacttattcttgcagggatgtacataatttaaaaagtcaaaaaacaatatatgttggcatggatgtggtgaaaagggaacacttttacactgctggtgggaatgtaaactagtacaaccactatggaaaacagtatggaaattccacagaaaactaaaagtagaactaccatttgatccagcaaccccactactgggtatctacccaaaggaaaataagtcattatacgaaaaagaaacatgcacctgcaagtttacagcagcaaaattcacaattgcaaagatatggaaccaacctaagttcccatcaacccagtggttaactttttattttgaaaggattttagatttatagaagagctataaagatagtacacagagttcacatgtacctttcatcctctttcctctaatgttgacatcttatggtatgttcaccatactaagaaattaatatttgtgtaacagtttacttttatttttaaaaatgattttatgtagttttaaaaatctatgccacttgaaattggtcaacaatatataataaagatagaacaatcaggcatacataggtgggtaacctttctctgaagatcattgtcataagaatgttttctctatattttccattagcaaattatgaagtgaatccagatttgtcatctatgacatttaaatggcaataaattagcagcctgatttataaatgattttcctctcagtgccagaattaaactgcattgctctacaaaaatgaacaagcaaagaaaccacaaagtcatattcaagtatttgttttttatctttttgtttacccatatgattatttcttgaattaatactacatgagcagattgatttggaattgttacaacagacaaaaaatcttttatctctgcctcactagaacttccagaatttaattaaaatttattcattgattctgccctcttctatcccagtcaagttccccccctgaacaaatacagtatatagggtcagtgcaatgagcagaattgctcagaaaatgtcctctctcctattaaccttacccacatgtgaacatctactgatgttagcatttaaaacaccttatctttcttttattctaaaagaaaattaatttaagtaataagtaaaattcagaattaaggtcttcactgttacattctatcatagtgcaattcacatattaagttgctaaataatgacaacacctgtaacttttcttctgtaatcatctgagcaaatgaattaactgtaagttaagttactttattttgacacttctaagagtgctttttttaaaattaggattttcatacatgtaactttaggacatttttggaggtatgcactgtcttatactgtatccacatgcaagtaaactcacttactaaggctgaaattagaaataaaacagtttaaggaaatttggtatgcttaaatcatgcaattctgatacaactaaatgatactttttttgacacatatgaccattcaaaataattacttttatacaatgataaagttgatgtctgttttaaaaattaaatatactaaattatcctgcatgggctacctttattccttgtttaaatccactgtgctttccttgatacaagattggtagaaataaattaactcatttattattctatgacattttatcatttaagctgtcacttatgcttttattatagagaagaatctctggtggattcttagagactttcttcttatccacttttttgcattccttaagtgttgttttctgctattatattcaatctttaagatcatatacagctaaaataaatttaatgagagagaaagtatgtgtttctattactggcattgccgtgaattttatatcactggtttgctttggtatttttacactgaaaaatgaagatacataaaatcatcataataaaaaacaaactgccaattaaaattatactttatttataatgaacagtatttgagaggtgctgaagtaactaatgctaattcaagtaatggggggtacaaggttacccctttctttcctaccagctacatgtaccaaagagtaaatcaaaagaaacctttcctgtaggatagaaagcgtgctgtgtttctgaaatcttgaagattacccaacatagatgtaaacacactctggtaaatgcaaataacatacaaatctaaaagcatattatttatattgataaatatgctgtgtttacacaaattaataaaaatgtaaatagcaaaaattctaaagattttgctacaattattttagctttatcatcaatttctctttctgacttgggtttggatttagctgctcttcaactactctgatggccagtctaggctactgaagactatcacttgctttattcatcagcttagatgcttatactacaccttctcagtgagtgtcatctggatgttttaaagtcaactcaaattcaatgtcttcaaaacttacctcccccacattttctctttttgaatattgtttgataaacactggattatttaacaattctatttttcaaatcagaaatctgggagtcattctacattcatttttctcatgagtacatccagtatatcaccaaagcctaaaacttctaccccaaatagatttctagagtctcactcttttctctcttttctcacatttgatcatctcttaccaaaactctttcttgaatttccactataccagcacatcatatacttggaaagaccttaaactcccagcatgccaaatttttttttttgtatctcatggtttaaatggttttaaagatattatattttttccacatggattgtgggaattaaggaaaagatgttctccaaatttataattcttatatagcttttctatttggggaagagtagaagagtggaaaagcatattggatttgtttcagatagattagttttatcatttctaagttcaaataatgtctttatgcttgtttaaagttggccaagttattgtaactaccaggagatagattctacttatttgtaagaggaggataattcttcctgaaagagttcttgttgagattaaatcagatgtaatatataatgttcctgtcttcatttatcaactcttctatccacttagctttcagttaccagacatttccaattataatttgatatataaaataaaatttcactttgttgttatgggttgagttgtgtcctctgccaaatatgtcgaagtcctaaccctagtactttaaagtttgaacctatttggaaatagggtctttgcagacgttaaaaataagtgatttggttgggtcctaacccaatatgactgtgtccttataagcaggagaaatttggacagagacaaacacatacacaggaagacaatatgaagacacagggagaggtcatctacaacacaaggaatctgaggcaatcaaaagttcaaagaatggaccagattcttgcaaagagccttcagaaggaactaaccctgcaaacaccttgattttagacttttagcatccagactgtgagataacaaatttctgttgtgtaagccacagtggtacattcttatggcagcctcagccaactaataaaattgttttattatgttttatataaatgtgcccattcttatgttaacttttttggaaggttaactaaggaaagatctgaaccagaaacacagataacttgtcatatcacttagtgaagtaccccaggaaactaggcaattcatgaaagatgttgataatcttagacatgaaaccaagaggaaaatatgtttaatgaattgctctcgcattctgcagaaccaaagagaaggcttcatgattaaaagacaagtaaaataaaatatgcagcatttttccttaaccccacattgtagcttttttttttttttttttggctgttttgcattgttcagagctctagtagaagacaacagaatccactcaaactagtgggaaatttgtcacacatgttaaatgtcttaccgaatcactggtagggatgattaaatagactttaagccaaacatttagtaactaatcctaaagctacccggcagaacaaggatccaggagaattactgtctcttccaaagttaggaagtcaccagcttcagttctccaccactactgcaacgatgaggaaggatatgtagctgtagcagctccagaaacccagcatgtcttctacagcctgcaccagtgaaaatcattccacacacttctcaagatcctcaaagttgctgacgaggtgccgagacctcggctaatgctgccaagaaacactccacatgcctttgactgtgcttgttggcagatagaacaggagcgactgaaatacggctatctgagaaaggttaagattgactgaacctccatcacattgagaacactagttgcaagagaatcttgaagatgtagattgtagctttccatattctgcaattcttcaaggaccattaaaaggagattggtatggtgttgagcaccaagccactatactcaccaaataacacagaaacgttggttagttatgaaactctcttagttacctgatgcagcctcgactttaggaattcttactattcattaccacatacaagctattagcctttctctttcctgaaaacatacagttttgaggctgctactctcaggtgacactgcctgctacctttccttgtaataatttacaaatgccccagattggcctgtcgtggggtggggggagggataccattaggagatacacctaatgtaaatgatgagttaatgggtgcagcacaccaacatggcacatgtatacatatgcaacaaacttgcacgttgtgcacatgtaccctagaacttaaagtataataaaacaaacaaacaaaaaacaaaacatacacacaaaaaatgccccagatttacttccttaaagattttaacacctggatcatggccaatttcactattccagtcaaaattcttgatgatccaataccaacatggaaggatattgaccatctcttttacaatgacttgatcctgaatcatatctcagccatctactttcaaggtcatatctatgtcctgctaataacaacaagtacaccccaattccataatctcaaccttaaacatctcattctctatctactagttttctctatttccaatgcttttactccctcaaatagccaagattcagtaattcttcaaagctaggagtaccaaatccactgcagatcactcctccacgctttctcatgttctcacctccctagctattcatcttagatagtacaacccatcatggtaagcactttcttactgacaccttcacctttctaagcatttagctattcatcttagatagtacaacccatcatggtaagcactttcttactgacaccttcacctttctaagcatttctttctcttccacagaactccctacaaactttccctgccttatcattttttataatatctatctatctattaatagttgcctcttttcctacttggccataatttccacaagggcaaagactcttctgtttattgctattgtctcagatggtgaaactgtggctagtatgtaataagagctcaataaatatttactgagtaaattaatgacataatattttaggttaactagaatattgtccgtcaggttaaagctgctcaaatattttactgaataaatgagtcatatagaataaaccctaagataaaacaaacctttaaagcctatttgatctactcattgaaggtagaatgaaaaatcaattgtgtaaagccaatgatatacaaaataaacaaatgtattctattctttttgtcatataacatactttgaaacttttcttccctttttaaaaacttttcctcctaaatctcctaccttttaaatggaaattacctcaattaaagcaacaatatgattttcaaagattaaaaatatatgagataactaattgaataaactcttacattggtccattaaaataactataggttatattaatattgtgctggaactgattatcttcaaattgattctattctcctcaatctgtctttaaggaaggatattaaaagacttgaaaatacttaaagactaattttaatgctgtctttcagcagtcacaatgtagttcccaaattattaattacatcaggtaaatcaaccatgacaagctattaataggaaatggagaagaaaattacattagtaaaaactatttaaactgattatctaattatagagagacccacattacataagcatgcaataggacagcctataggggtacagttagtcgcaggtctgtatctttgactgtttacagtgatgtcgcttccgctactataatgaaccattaagtgacctacaatatatcaaatggcatggaatcgtgtacttaaagaaatgtctcaagaccttgtttaactaacatgctcctaaaaccttcacagcatttagctatagaagcaaacaacacaaattgctattcagaacttataataacgaagaaagattaattttaaaatggacttttcagtttatatacagtcccccgttatccatggaggaatacattccaagatccccagtaaatgtctgaaaacaggtagtaccaaattttatatatgtctttccctgtatatatgtacatgtaataaagtttaatttgtaaattagacacagtaggagattaacaaaaataaaataggacaattataacaacatactctaataaaagttatgtggatgtggtctctctctcaaaaattatcttactgcactgttttcacacttctccttgtgatgatgtgagatgatataatgtctatgtgataagatggaatgaggtaaaagatgtaggcatttaacactgggttacttggcccttctgacaatatgtcagaagaaggatcatctgctttaggtgattctggatcactgatctatcatgatgttgatggctggatgtcaggagtagatgatgttgatgcctaacgcgcaggtagtgcagacagcatggatatgctggatatggggaggattcatgtctcaggcagaacgaagcaggttggcatgagatttcatcacactactctgaatggtgggtagcaacttaaaacttataaactgtttatttctggaattttccatttaatatttttgagccgtacaactgaccttaggtaaccgaaaccacaatactgaactgaaagtgaaactatgaatatgtggggactactgtacttgtaactcacaaagtatgcaataaacacttgttctttccttccttcactttgattctttcttcttttcttcttcgtttcttcttttgacatatattacttgtcacctactacatgtcaggtgctttgacatgtctggcagaatagtacataacaagacagacaaggtgactgagatctgaaggataggaagtagtcagttaagacaacagctgagaggaagagggtcaggaggtggtgaccacccttcctgagagcatccccacacacttctgttggtaagaaatgcatggtatattctaggagccagggtgctgaacacagaatcagtgacagtgcatgtgtcaagaggagagagagagtaagtaggcaggatttataccatgcagtgcctggtagcccaggaagagggtttgttcctattagaactgcaatgggaaatcattatagcagatttttttagggggggtgaggaagggaggtgtcatatgatataaacattgtaaaacataatagcagaaatgtctatttatatgttgctctattttgtatatagtgctagggaatcatataattccaaaaattatgccatgtttttacaaaagtgaggtcctaaatattcacaaaagaatgactagactataactcaatgattagagtcaatggaatacaatgcattcttgactgtttctagaaatttcaggaatcacgagaaaaaaaaaaaaagtgcggtgtaaagatcgctaccaaaagatcaaggtgagttttgagccttctgcatgccctctttaacagcccctcacaaatgcagtttaaaatagtaactgtcgtgagtgataacttgacgtatttatcatctaattgagctggtgatggtttattctgatatttactaaacacttattctttggaaacgattcatctgcaatgtatcatccacagtggtaagtacagtgtacatatgcagtaagtgcaatatactaacattttcttatttgagaacaattttgaaaagtaatgtcatccaaaggaacagtgtttgaagtattcatagccttttgttaaaatcgttgcccagcactttgggacgccgaggcgggcagatcacgaggtcaggagatcgagaccatcctggctaacaaggatctctaataaaatacaaaaaaaaaaaaaaaaaaaatagccaggcatggtggcgggcgcctgtagtcccagctactccggaggctgaggcaggagaatggcgtgaacacgggaggcggagcttgcagtgagctgagatcgcgccgctgcactccagcctgggcgacagagcaactccatctcacaaaaaaaaaaaaaaaaattattgcacattttttgtaaaaatctatgatcttgtattatgaaactaaattgcatccaggactgctcaattttgtttataaagtttacattgtagattgttacataaaggattaatttttgcaattgttctttttccaaccaaacatgatcataaaatgcatttacctattggaataaagatgaatcaaataaaatatttgaaataagtcattgtacatatacttgttccataatagctttttgaaagtattaaatctatagatgtgaaagaagcaaaaatataaaaaatctgaaactggacaacaaacattcattatgcaagatatttaaagctagctattgaattgcttcaaaataatttgttgtaggctactgttttcttcttgattccactgcctacaccttaacagggaataaataaatactctcctatgtgtacaaacaccttctttttagaaatattaaccatctactgtggattttatagatacactacaatataaggaaagttggatgcaactacatatgtcttgcatgatcagaaaaatatgatatattaaaagaatattctttctgaagattcactctctgaaaaaaaaagttctaaaagggcttatacagagcgatttaaatacaaaaatttgaatcaatcagcactacatctctgtaagtatacaataggaaaatttctgaatgagaaattacacatgctttctgtcatcaggctcctgctagctcagtgctataattcatcctacactgctgcaaatatatctttataaaaattacagcactactactaatattttgtgcttcatttcaccaaattttaacctaatcacttccctgccgtccaaatttttcctcagaagcccttttccatgacaaataactcttatctaccttgattcttcacagaacggtttttctccagcttgctttgactgcaaaaactttatttagagtgcatcactgtcctatgatcctcactcacagagacaatattgtgtattggttaaggtagtggtagcttctgtaacaaataaatcctgaaatctcaatagaggtttttctaattagtggactgggggaattttctccccacattcactcaaggacccaggctgatggaggttctgccatctttaacatgctgcttctagtttgctcaaaggatcaacactcatctatcagaggattacatgagattgtttttttggccaggccagaaacctatgtatgctaatcttgccactatttcattggcgataaatctgtcatgtggctgctcctgacagaaagggaggatgggatatacattatagccaagtgcccagcaagaaagaagaagagttttgctaaatagctaaatagtctctcacagtcccacagacttcacatatactaggcacaggagtttgttagcatttttctagttagtaaatagttccttattcctaggacacttgtacaaactacatcttccttagaattgaccaccccctatattcttatccctgtgagatgttttaatcttcacatggttgacccattccaaaacgtatcttcctaattaaaaacacaaaagtatttcaacataaatgttctttactgtctacctcttctgctagtcatattcaaggacatgcatgcacctcacttagcacatttttgtcattagaacacttgaattattattaattattgaatactccatcctttttttcatctacatgcctctgggaaatattatttcattaaataatagaaccctctaataaaatcttcactaaactacccttctcattcctgggggtggtatctgtacactgtgctgccaaaaaaacctagagcttacctctacaatgtgaggaacgcttagaacacgaaaattttctactaacttaacaagacctaagactaaacttttccacccatacttcttgctaaactcaaattaacccaccaatagctgctaaaccttggtcacagtcttgctttttttacatctactaccatggttaatgaaacatcagtttgcccataccttccaaaaatataaacaatgaaaaattcttagaacaaaactgaacctttagaactttggaccatctaattacctagatgcctttccctcctttatctgtcttacaaaagttctcttattttccactaccatacttacatgttacacattgtatgatgcctctgctgcccccagcaaagctgtgggagtgactacctccatcttgttttcaaaggaagtcatgaagaacatcagtgcccaggaagagaactgccatgagggtggggtcacttcagacagtccccactgagtcaatgcccagtggagccatagggttggttctaccctcaagaccttagactggtagagcaaccagagttctattccagcacagaagagctctggtgtgggccgcacccagcaaaaccaagcagggatgcctggagccctggagcccatttgcccagtaaagctgagaagatggagcctctaccccactgtgtccacaaggagacctctgccccagtgggcctcaagggcagacaactgagtcaaagaagattcttccacaacatttatgttttggacttgttcaggacctatcatttatttcttctttcctatttctttattttccagtgggaatgtctttccttgcctgtcccaccattatattttggaagcacataatttgttttatttcactggttcacaactggacaaaaatttgcctcagaatgaattgtatcttgagtctcatccatatctgatttagataatatttagatgagatgtgaactttagacttctaagttgatattagaacaagttaatacttttggggtaattgaaatgaatgcattttacatttgagaaggacatgcctttttgggggatggggcagaatgaaatggtctaaatatatccccttaaaattcatatgttcaaaccctaacctccaaggtgatggcattaagaaatgaagcctttgtgaggtgatgagctgatgagggcaaatccttcatgaatgagattagtgtccttattaaagagtctgaaactcctcaccaattaaagctgccatatgaagttacagtgaaaagacaactatctatgaaacagaaactgagtccttactagacactgaatttgagggtgccttgatcttggattttcaagcatccaaactgtgagaaataaatttctgctgtctataagttacccagttcatggtattttgttataacaactcaaaaggattaagacacattccttaataattctctacccctttagatagagtcaatttggctcctgtgatggatagatcctatggacaaggtcaagacactggtattttttcctctggtgttcactttctatacattccctcttatgttacagaacttgtgatttgcccctcaccaaggtgaagaggtgaaaagatttttgcacatgtaatgaaggtcccaaatcacttgcctttgggttaatcaaaaggaatattattctagatgaggttgactaaaccaggtaaaagctcttttgaaaaaagatatgaagcaccctgcaggtaagggaaatattcctgctgaacttgaaggaaagtgtaggtaacccctaagagctgagggtctcagtactacaatcacagggcctaaattctagcagccaccctgtgagcttggaagagggctctgagctccagttgaggactcaaatctggcctctgaaactttgagcagaagactcacctagattgtgtctagatccctgaaccaaggaaactgtgataatgtgtgctgtcttaagttgctaaatgtgtggtgatttatttccaagcactggaaattaatgcagaacccttatatatgttctccttatattgtttactaactccattacaacactggacatgaaaaactgttgctcatcagtgactttcttcccagtgagattccaaattccacaaaggcaagaaccatatctcatttataaaattcagtaatcagaacatattttatttttggctagaataatatagatacacaacaaaattcttagaaattttcccactattctagtctaagtaatctagtcattggttaaaaaaaaatataaaattagaaaatcaaaaactccttattaaaaatccaggtctcaggtctcaatagcagacattgatgaatccttttttcctttccaagtacttagatattagactaggtatttagccttttacatgcacccctgtagtttaaggaaagccaattaatctcctaccttcagataactcttttagcttgagacagcattttttattcccctaatctcaaatgtcagcatagggatgtgatttcagtgaacctcttacttggaatgccagaaacagagtggtctttttcctgatagttgagaataagggtgcatgtggccctgattgctaatgcaggccaatttgtggctgtgagcttttgcctgtttggggatggaaataatatcatgaactgaagagcagggaaacacaatcaattgtgtttaatgacatgattgaagacctgtaccaccattgctgaatcctgccttatttctggatttgagtcaccagtaaatctctttactgtttaaagccagtattagctgggattctgttgctttaacatatagtcctaaatgaggccatttctaaaactatattatcaaagaatcactaggattggtataaagcaaacatttggtcattcaactaattatttacaggatgtcaaatagctgaatggacaactttgttaatacatcctcatattttatgattgtggaaatagaacactatgactttttagattaatgttgatttgtaaagatagaagcaacaaatttttaaaatatttaacatttttgcttagtatttatctctagctcctcaatacccagtggttctgagtaggtttagtttgcatatcattgatatctattttaattggtagatacagtcactcatatattagaattctcataacagatttgtacctatgcttctagctgaaggtatgacctaaaagttaaaatacagaattattctctgggagaatttaaattagcctttgatcagaacaaatagggtcacataataccaataccaagatggtgggaacttcacataattgtaaagtggtgatggcaaggaggattaattttgcaaaatccatgccaatgatacaataaaaatattcgtgtcttaatttagtcattttctttgccttcaagaattcagctaatcaatattttattttaataggtgtcagcactgtaaaagtaagacacagaaacagaccaagaaaccagcattgggcatctgatgcatcattacttttctttctttcctgaaccattcccaccatgccacaatttcaatcatcctaagaaaacatattattaatactctcatcttccattttctaacactaggtatttactcctactatatacaccccggggagctccattttatgcttctgtttagagtaaaattctttgaagaagttgtctcttcattgtattgacttccacttttcttagtctctttcaaagccttctgactaatcttagcaaggtccacatgaacacatcctcccctccccctactcaaatatatgcatagttccttctttacttccttttttgagttttatgtccaaatggaaccttctcaggcaagcctttcctcataccttcggtgttccctgctttatttttttctttagtgcttaatgcttatttaattacaatttattatatatttctgatggactgaattcttatgttccacccaaattcgtatgttggaactctatcacctaatgtgatggtattaggaggtggagtctttggaaggtaattagaattagatgatgtcatgagggtttagtgaccttacaggagtcctaagagagcctgcttcctgcttccatcatataaggacacaaggcaccacctatgaatgaaaatctgctgggctttcaccagacaccaaatctgctgacactttgatcttggacttcctagcttccagaattgtgagaaataaacttctgttgtttataagctactcggtttatggtattttgttgtagcagcctgaacgaactaagacaacatttataatcaccaccaatcactcctactagaatgtaagttccatgaaagagggttttttatttattctattaacctcattatttcagttcctagaatagtacctaccccttagcagatattcagtatttttttgaatgaatgagagagtgccattgatcaagtgagcaaaaattagggcagtcaccaacaatagacagaggatctgagggtacatcttgaagcagacagatcaattaagagaaatcaagaactcagatagtgatatgggtaacaagaattcagaagcgcaacaaaatgattaggtaaaatgcacagaattccatgttccagaatagaattaggtaaagtgtcagctttctactgaagaaaatatccgtacgcactttatatagtctagagactgaatttatttcaaacctggctgatttataagtggaatcaggcaaatataactaacttctaggtatgaggggaaataaaacaagttcctgacaacagaattggctttctattcaaattattgagtacatgtgttcatccctaagcagcaatgctttataattgtctatgaccacaaaatataatttaagttcacgaatttataaatatatttactaataaatacacagaaaaataacaccaatattagaaacaatctacaaatgtgttgtgaaaagcatttccatagcaacatcagaataattatcgctataatcagcagtagagaaaatgtgctaaagccaagctttatttttctcagaatcatgggactgcagtgctcacccacacaaccgaatcagcagcatgaaaaacaacagaaaattatattttatgtataaaagagtaattgagcactctacaattatatagaaatcaatgagtacaaaaaatagattaacagctatgaaaagagacaattatgacatttttagtgtcagtaaaatgtatcatattctaatatgagattatttttctaaaattaatgcactgtagctggagacccaattttagaagaagaaatgaaaactcatatcaaacatcttaatttgtaactcattaatgcaactagcatgacttcatctggaatcaagaaaggcacagtctctcagagtcaatgtgtcagagaaaagataaaactgacaaccctcaagagaattattcttattttaatggactacattaaacaaagaaaatactacaaaatatgtacttttctgtgttacataaagatataagccatgaagtataaaaacaaagtcatcatagatttctatagtcaatcaaaaagacacctgagtctatttgctaatattttatttactttttcagcatcaagtgataaagtaatgtcttaattttcttgaatttatatttttctgctattttcaatcttctatgagagaagaaaaacccaatccaatagtccaccaggaagaaataacctcccaaggagaatataagctgtatatttattccaagtaaatagagagagagagacacacacacacacacaaagagtggcgggggggcagtggaaagagagagagagagagagagagagattcatataccaggattgctccaggcactaaaaatacaaaggcaagcaaggccattttttgttcaatgtcagctgaatgcctttaaaaattgtaatttttcaatgggggttggctaactccagctcctccggttaaatacagctgactacttgttgcatggtccaggtgctaaatatgttttttacacttttaaattgtccagttggaggagaacaacacacacaggggctactggagggtagagggtgagaggtgagagaggataaagaaaaataactaatgggtactaggcttaataccttggtggtggaacaatctgtacaaaaaaaaccatggcacaagtttacctgtgtaacaaacctgcacatgtacccctgaacttaaaataaaagttttttaaaaaaatgatgtagaccaacacatacaatgctataaactaaaataagaagaaaaagaactttcaaagattatatgacatgaaaattatatcaaattcaactttcagcatccataaagatgttttattggaacacagccatgaccacccattccttcatgcattgtctgtcactgcctttgagccacaagagcagaggtgggtagctgacacagactctatgacctcccaaagctcaaaatatcaactgtctggctctttacagaaaattttgctaactactattgggttaagcaaagctttgacagatattcagaatacaaatgaacacaattttagtatcctgaaaatttggagcttcaagataggaagaaatttaaaaagaaggcagaattctgtcagaaggtgaatagaacttaaatactctctcctaagagccaaagaaatgcaagatccaatctaatgatgtaatagcctaggtcaggaatgtaagctttgtgaacagacctggagtttgtgaactgcaagatgcagtagagcaacttttaaaaaaattgttcaagtttattattttaaaagagggcgaagtgtggcaactggaatgaacagaaaaaccactcggaatgtccacagctattcaactcctgctcagccacaatctctagttgaaaagtcagcacatcagctgaagagggtacagtctccttagtagtacacagtaaatagtaagcctggataagcccagagaaaattgaggaggataaaaaagagaaaaaaaaaaacacattatataatatatgtgtttaaaaagaaatctctacatatttggaatattatgtatttgcaatgttttagacattctgtccttattagagatagaagtcaggctcgtgattgaaatttaaaatgatttagaattgtgactttaggcagaaatcttactatgtttgtatgcagtatttacataattaagaaaactcagatttcaatatattaagttatctgatttcccttttaattatctaagttgtttgacagacaacatcataataaattttttaatgtactcttaaacttttataaattcaagatgcaggaagtttcaattctttggtctgagttacaaaaataatttcaatgcaataacttgaattactttgcaaccagtttacttattcccagcgaatagaagccatgccagtaaatcaaattggcataaatagtacaaaatttattcatccaaaaataccaattaagtagttagttgtaatttgtctagaattcaatgtggcactacatattcgagatgaatgataatatccctgcccttcagaaaactaaagaatggtggaagagacagataattaaatcactagggtagaagtatgataatagtataaatggagtgtaccatgaaatcacacatgcagaaaaaaggaaacaaaacccaacatcaagagatcacagaggactttctgggtgaattaaagcttacgtggaatgctgaataaaaatgaagaatcccctaggctataaatagatcacatttagtcaacttacaaaggacaaaacaaaacaatcatgaggaagagaatgatgataattaataacgaataagtgataaggatgattgagatattggcatatgaggatatagcaagatacgagatagaacggaagacagggtctactgtaccaggaacattgtagaatatttaaaggatagattttcttctaaaggtaatgaggaggttttaaagattattttatttctttaaacaagagagcaacacaggtaaggtacccttgactggagaaggactggaggcaaagagatgaactcaaaggctttaataataatggtactggtaagaaataatgaggacagtagaatctgaaaatgagaaattcaaagagcaaggtttattaaatcacttgtggaaataattttgaattaatttgatattaattagaaaataagtataatggacacatttcttgataaatgagctgctcaattcctaaaaggtcagcatgatctcaatgcaatccatggctgcaaccccaaaccacaacctctggccacagttacttgaatcaaaaattgtctttggaaataaaagcagccgtgacatttgttatacagaaaacttttcactttggtggcctggctttaacagatgagcaaatccagtcaaattagagatttaaagattcccactagcaagctgtagactttgcagctggaagattatatacccttgggttgtggggtggacattttcagatttgtgcaagctgatgactaagtctatttgtagaaataggaggatagggcagagcagagagaaaaaaagaaagtgagatgaaaatcatatagtccctgagagactatcagagcagctcagctcccaaaatcttgccagttgccatgaggtcaagtagtcctttcactaccatccttggattttgtgaggcccttcaaagctttacaatttactgtctgttcttgatctagtttacatgggttccattgctcgcaaacaaaaggctctgggtagaaaatgcaaagaaccactaatgatatagataaaatactatacagttagaaatcttttactctacctacaaaagaaattttttagcttctccttgaatattttcagtgaccacatgcataactgtttctgattacaatctatcccatttgcagaatttagatatttgcagccaattctttttattatgattaaatttatcctgattcccattttatttttaaagcaagagctatgactcttatttgtttctttgttttcctcatgccataacctccttctcttaagcagagtgcctaaaaatgtttttaaaattattatttgcatttcccctctcaacatattaactgaagcagtttttcactgatagaataaaatcccctttatctcaaccaagaaggcatcttcatttaacaaatatcatttaatttttttttgttagtaatgtgtttcttatgtatttggtttttggccaaaatgcagctgacagtgcaactttgtatcataatgttggtgaggggcacttaactttctgagtaaagttttagagctcagtttcatatccagtgttaccaatatcttggtagaagaaagggatttaataaaatgaaatgtttaaccatgatggaaagggcattggataaaatgttcaaaatgcatttaggtattgaagtatataatggttacaaatgacatcacaacgttttaatataaaaggatgacatcacaatattttagtataaaaggatattctataaaggtactcacattctccaaagcttacttacgattgtataatttatcaaatttatgcatatatttttaaatagtttgtatattcaatgcctttcttatcctattctttaggcctaggttatttaaaaaagtacaacctagaagatctcaaatttatgccaaattaagtgctggtagattacactgagttacagactttctgcagtgattttccacaacttgaaattttccacctttgaaaattcgtgaattttggggggcagaaactgaatttggatgcaaaaattgctctgaataagaaatagttttatagttatgaatatgtgaacaatgaattagaacttatcaatgttataccaaaactcctctttgattgtaacggtttctaaattcacaaatctatctatctatctatctatctatctatctatctatctatctatatatctatctatctacatatatatatacacatttgtgtatatacaaatgtgtgtatatatatgataatttgtgaattatcaggatatatatatatttcctgaagtcactgtatcatcctagtaaatttgcacaataatatcatatttgtctttaaattatcactcccttgctagtttttttaccaaaataaaaaaacgaatgggtaaagaatatgtgacatatatacacaatagaatacaatttggccataaaaacatgaaatcctgtcatttacagcaacatggatggatatgtaggtcattaggttaagtgaaataagcaaggcacagaaagacaaatattgcatgttctcactcatatgtgtgagctaaaattttcctttcatggaggttgagagtagaatggtagttaccagaggctgggaagggtgtgtgtgtaaaaagagggagataaagagaggttgattaatgggtacaaacatagaggtagatagaaggaataagttctaaaagtccatagcagagtggggtgactattactatagtaaacaaaaatttatcatatatttcaaaatgttaacaactagaagagaggacttaaaacgttcccaccacataaaattgagaaattttcagggtgatggatatcctaaatgccctgattttattattacatgttctatgcatgtaacaaaatatcacaggtactccataaagatgtacaaatattatgtatcaggaaaaaatattttgaaactctattaatgcattttccctcttggaaattatactggtttctttttacttttcattcttttaaaaaagactataagggaccctaagcactaataatttactgttaaactttgagtttcaaatttaactcaaaaattcatagcaaggcactctttcaagagggagaaaaagaacttttctagaaacaacccaagcacacttgatatacatcaagaaccaaagctgagaagacagttcatgaagtcagaagtgagagcagataaagtaattgccacacaagaactctttcagaagtagaggagggaagcaagaagatgagaaaaaagagagtagtgctgatatgcaaatggcttgctccccagtcagtgttgaaattctagggagggagaagatggagtagtttgaaagattcaggttgattggagaaatggataattagggggaggtttcctgcttcccccagtacagtcccggcaagttctaacgtcttcagagaagttcccattttagcaggtgttatggccaccatgcaacaagaagatttcaaatatgtgaacaataaatttgaacttattgttatagcaaagatcttcttggattataatggtatatacatatatatgtctccatataggcaaaattgcctatattgggtgaaatgttgcctagttgagtagacatgagagcagcctcagatggtctggtacactacagcttggagtatgaaatgtgtagttgaaattttaagggcaatggacagcagagcatgcacaagaagttctgagaatgctggtggatttcaagaggactggattcaggaaaagagggttccggagtttgggaactcttgattattggcaaaggccagatctatagtcaccagcactggatttcagaacaacacttgaaagacaagatggtacccaccatatctcagtggacactaggtcatgatgctcaatatcctgaaaggcagaatctcactgtagcaggtgccatgagatcaggttgagacacctaaaatgaagaacatctaactcaataacacaaaaatacatacatttctctgtccttctagatactaccttggcaagggaggaaggaaaaaagttcctaaaacagaaccaccccacagcaaacacacacatacacacacacacacaaaactagtgagagtgtttcaaactaaaagagactgagatctcttttatgacacgtgttactttatatgaggaaatgaaagttcaggagcaagaagatattcatcatagaaaacaggaaaatttacaggaatgtattttcttttatttttagaaattgcatgaaaatttcacttgttataactataacttggcaaactccttcattcatgctgcctttgtggtaactgtatatatctaccttttctaaataaaaccagaatataacacaaggtaacatctaggaagaaagcattagcaaaccgtgctattagccacttcattaaatcaggcaggtcataaaaaacaagcaaagccacattttcaaatttgttcctcagattcattttcacacatcatcaaatctaagtcttcagtgaatatatgagtgttataaatatagtcagcatctcagcctgcaaagaatacactatgagaattaattaccaaagcacttaaaattcatcaaaatcacaacaaagctgacaactattatttacttccatatcagatcagttgaagattaatgtgaaacaagataaatgtatcatctgttctgaactacctacacagtaatcatctctggctcagtataatttccaaatttcactctaacatactcataaatacttaatattacatatagcctgtattttatctgaaacttttatggtgctttaccataaaaataatcgctttcaattatattttccaagccattcaaatgccacactaagaaatatcaacaaccttattttagataccaacgaaagacaagtattgtttccccaaatatctttattacagaaaattaaaaaaagaaaacttttccttaaagttccaaaattttaaattttatattgaaaaaaatcaatttattcaatttcccaaagggaaaccaaaaaaagtgaacagcaaattgactattgaagattaaccaattagtaataaatatatttattgagtttattgcagattattcaattaatatatacatgctatatatatatagcatgtaatatacatatatacacaaatatatatacataaacatatatatatatatatatatatagttttgaagaaaaatataaaataacttctccattagaaaattatctctgagatgtggtaaggagaagaggaaatgaagaattttttttttttaggttaacatgacatagctagaaaaacacgctatatttcaaatatagcagttaagactgatgggaaagtaaacattttttaaaattcatgataagttccccaccggttattgacaggtttatggttttacgttagtaaatattgatttattaagtatatactctttatagaatacaatacagccctaaagtctgagtggaaagcagaaggagaattacaaaagaaatgaaaaataagcatcttccaatgaagcacttaattatgtatgtatgttgtaggcaaaatgaaaaatttaatatggaacacttgtagagaaaccaggcaacagaagataattctttgatgtgtttaaagtttaaaaaaattctgctgggacaattatgtagtatatgaatttcagtatttagacatttgacttttcccattatctcacaaatcctccccactggcaatggagacaccatctccttatttcaacacttataagtaaaaaagagacataaataaaagaggagaaagagttaagggaggaagtgaacaaaaagaaagtatggccctaattataatcaaaggcatccaaaaaatacagaactgaaaaatcaattattccttactgtgtgcctttgccatgcaatgccaaataaaagaactgagtgtacttggattccctcttgcccttcacaccaatgttttgtggaccacttactcatctaacctaatacctgagatgcctcccttataactcttggtaaacttagatgttctctacagaccacgtattctaatgtcaacatgcctcaattagagtgcatatcaagacgtattttaagaatcccttcttcctattagactgttaatgagttcttcgttttaccaatttttccagggcctgacaccatgcctggcctgccccatgtctgacctctgcaaatgttcaatctgaacaaaagatgagctctaagggagaagagaactggctggctaaaaggaatctcaagatgtaacattttcttactgaatattccctagatcagtgccttccccgcaatcttttggggttaaatatttgattttgttcaggacactaacagtggatcaatctctcaaacgtagactcacattatccatgtttgcaatctgataataagcaaaagtcccaagaaatgaatagcaaacctcacagtatagtaggtgagagcacaattcttggattgaattgaatcaaatgttacccccactaggctgtaatgttagaaagttattatatcccaatgaacttgtttcctcccttgcaaaataagcataaaaatagtcacctcaatagttggttgtgaagattaaaaatgataaggtatggtgaatacatagcataattactgcatattgataataaagaacaaatgttgatattatcatgacaatattaaagaaaagaagttgtagatcttgatgatcaatccattcctccattacatgcatgttcatgggtgtcagacagtattcttaatacatggatatattattatataaaacataatggagtttaggttctagtgcagatagaaataaacaataaaaatacacaataaatatgttttatgtaacagagagaagatatatgctttggaaaatataatagaggatgttcgggaagattggaaatgctgaggatgagggaaggggtattgccattttaagttgggaagtcccagtaggtatcatagagaagatgctatttcaacaaagacttgaaagaagtgaacatgtggatatcaggagtaaaagtattttattatagaaaacagcaaatacaagggccctcaggtgtaatgtactgtctgttttgtggaacaggatgggggctggtgcagacaacatggagtgaactagggaaaacatagtatgaggtgaagtcagagcatgagtcgtgtccatgggtcattctaagaatgttggcttccatctggagtaagacaggtagtctggagggttctgagggcaataataacaaaaactgagttttagcatcactttggctgctgtgttgagaacagaccatagagcgaccagggtagaagtatggtttaggatatgtagttagaggactattgtaataatccagatgaaagatgatgctcagaccagggtggcagcaatagaggtggcgaaatgtggtcagatttctgtatgggttgtattgtgtgaaagagagaactcaaggatgatttcaagattttatactaatccactggaattgaattgttatcagttaagatggggaagactctgcggggagcagttgagagatgaagtccaagagttctgctttaagatacgtcaactgagatgcctattagaaatagaaatggagaggttgggtagacatttgcatatatgtgtctgaaggtcaggggagaaatctgggcaggaaatatacatttgagagccttggcctacaaaatgatatttaaagtcacgaggttgggtgacatttgatgagatcaccaaataaccaaggtctgcatttgcagtattccagtcttaggatgtctggagaggaaaagaagctagcaatgaaatttgagaagaaacaagcgatgtaggagtaaaacttgatgtggttttcccacaattagcatcaatagcatcataacagaccttgctagaaatgcaaacctcttaccccacccatgccataacgaatcagtggggcccagcaatttgtgttttagtaacttccaggtgattcttatgcatgctaaagtttaagaaccactgctgtagaggggcagtagaatttggggtaaaaattatgaattttaattaatctccttaaatgttaatacagtgtcactgaacctctttgaggaataactcaactagatacagaacgaagcagtccctcattgagctcaaactcaagcactccacctttagatgctaccacacttagattaatgttttcacacactctatatttcttattttctcattttccattgctgttaggtgtgattgcttagaataagttttattccctcaatttgatttcactaagttcaatttctttccattaaatctgattaaagaaactcaaatttaactaaggttttaaacatccaggcattattagcattccagaagaggggtttgtttatctgcaagaattcccacaatgtggaaaaacagagagagagaggagacagagagagagagaaagagaaagagagagaccaatagatatttgtgtttatagccaatttcaggcagattctgtacttctcaccaactcctgttctcttgccctatcaaagcaaacaaaccaaaataaaatgacagttaacaaggtaataaaaacaccaaaccagggaataaagaagtaaaccttttaaagtcttctttaatatttaaatagaaatatttatcataagacttagcaattaagaatggaaagagctatgttttatatcaattcaacaactgatttggggaaagtgatttaacctctcagagtttctgcatgtttaacgatacaaatgtgtacagaaagtaaatattccctgtaaacttaccacaaaggctgggcttggtctcttatatgggaaaatgctttgtcagctgaagaactaagcagagattaaattgatgttaaaataaatttttaaaatgtatctttcattaagggaagaaactttaggacagggagaatttatcaattttaaattttaaataaatgtagctctttaggagtttaaaaaatatttcaagggaagattgcatatatatagtcttgatatacattgttggcattgttttattgatacaaatggagtattcaaaacaaaaattcatatacttaaataattaagtatctatactcaaatattattgcagtttagaattctaagctattttggcctatttaaatgaaaataacatagagaagagtagaaaataaaatgacataccctatatctatcattaagatttaagaagtattttcctactgctatattatatttagatctctctttaggaagacaaatatgtcacaaaaacaattaaagttggtgcctccgcattccatttctctttatctctttccccaggggtgcctgctatcctgaaactggaatctattattcccatgcaaattcttgcacattatatacataggtagatactcataaacaacatatattatcattatgtatttaaacatttgcataaacaacttactttttaaacataacattaagttttaaaatttatcagtgttgatacatgttgttaaatagtcttctattataagaataaaactatttaggctgctacacagaatcagttaggctgtttccacatttttccccatattataaacagttcattggcaggcattttctttttttaatgagtgctattcaaatgaattcagctgtgggaaattgtttgtggctcattcacatctgacaattctgttcatgggctcctcctcaacagctgtccctactaatgcaagataattttatgtaaaattaatgtttccataagaaggcctcatgagaggagttgtcttctgtggtaggaagtcaagaaccaaaggaaaactataaactcaaagaagaaatatgcaacaaagtaaatcagttttggtgatttcccaggtgattttacaggttctatgccaatttggaaaatgcgttctcttcttttgttgaaaaataaaaaaatacttgtgaaaaaattgttactgctcaacaaatagttctctttcattatattaattagacaaattatgtctttaaagcaataaaaaaaaccctgctaatagttccttgaatatttggcatttttgtgatcagactgctggactaaaaagacttttatttcttgagttgtcttcctcaggagttgacttgttccaggctacaagtgaacaattctgaaaccactatacatgtatgatggaattgggtaattaagtaaatggtgactgatgctgggagccaggcttctcatattggagttggaagttacagacaagcaagctttgaagactagaatgattggtatattactggattagggttagaaacatcaggatgaactcatgttcagtttaatatagatgtagatggataccgcagtgagctgattggtgacttccaaaaaaaaaaaaatgtatctgttctaatccctggaacttacgaacattaccttatatggcaaaatatgtgatttaactaagaattttgagaagagtttattctggtgtacttgggtgggccttacatgcactcacatgtatcctttaagacagggcaagagagagctttgggacagatgagcaggcaatgagaccatgcaagctgagactggggtgagtgcagataccatggaatgcctaaagccacaggaggctgaaagaggcaaggactatattctcctctaggagccttgggaaaggagcatggctctgccagcacctcactttaggacttctggcttccagtctgtgacagaataaatttatatcgttttaagccactgattttgtggtaatttgttaccacagggcagacacaggaaacaaataaaatagatacgtagaagtttttataaatatgtgcatatacaagggttagaatgcacatatgtttactttgctccatctgctgagtgatcctagaagtaatgggaccccagtaacaaagataatgctgactaatataaccttaaagtttccctcagctggactaaattttaacagactttttcctgactctaggctcctgacctcttttctaaagcttttaccttagaaaatttgtgaatataaatatttctatgttcctttgagatataaatcttttaaacagcctctagccagctttatagccaggaatgtctttttcaggaatctggaagccattcttttgcaatgtaatcataaaatagtttcctcatctcccaggctctgggagaatgagcccccaacttcctagggcatgatggttcaagctataaaactaccttcagtcatgaagatcagagaaagtttacttttccattggataaggaaaattagaaaacaaaagtggcctaggattcccctatcccagctcttaaaatttcttccgccatttgttttaaggagaattaagctcagattaacttgtggcctctctccatgtctgcagttgccttgaatgaatcttccttttactgcttttactgtttaaatttgccaggcacagttttggctttgacaatacctagagcctagctgttggtttctaacaccattctccaataaaagaagttaaagatccacggagaaatagctgattctaggactgggttgggaaatatacaagacaagcctggaacattttgtagtgccagaagtgctaaaaacaacagcaacatagcaataaataaaccacacaccaacacacacataaacacacacaaaaaatgatggggtctgtcaaaaggacagcagtgaatagagctcctaatgaccaaagtgtgcaaattttgagcaacaaaaaaggcagaaataaagtagtattgtattacaacttaaaggataaaacaaatatccatgaatccataatcacataaataaatgatgatataagtaaataaatgtgaagaatatagaaatcttacaaaggtttgcagaattcaaaataatttatatggatactcttccttaagtaggtggagcataactccctactctttaaaggtggactgtcaatagtgactttctttcaaagacaaatggaagtggaatgagttcacagagtatggacgtgggcaggaaaaaaataactttatagtgaagaaacccgacaaacaattcctcagccaggtgatcaagattaaaatcaacagtgatatgtaatattgacagtatgtactcttcatatgatgtgatgttaatggcactttacctctgtggtcttcttccccaaacccataactctaatctgatcataagaaaaatatcagacaaatacaagttcagggatattcttcccaacacgtgactagtatacttcaaaactgtcaaggtcatcaaaaacaagcaaagtctgagaaacagccaagataaatattatgtggtatcctggaagagatctttgaacacaaaaaggaccttaggaaagagccaaagagatacgaataaagcttagactttagttaataaaaatatatcaacattgcttcattagttctgaccaatgtaccataccaatgtaagatgttaataacaggggagacttggtgagggtatatgctttctgtgctatcttcacaatttttctgtaaccctaaaagtattcttataaaagcttattaaaaaatagatctttatttttgagttgattttctcagcagataaagaaataaggtccaggtttcctacaagaatgttcattatcttccccagaactgatggttataatccccaagatgagaatgtgctcaggcagcatggtcttaatggagtgatagtgtacctcatgcccagtctccagagcagtttttatgcaaatgactattgccattaggatgaagaggagctgttctagctaatggggcagcccaacatacttccggcatagcttttgaatgtctctttgaacattcactttgtttataattatctgactgtacctaatttgattctacatgaaaatttatataattatgtaattattccattttaatgtaagactgaaacagactgttaccactattcttgagattccacagagaactgcatgcttttgctattaaaagaccactgttgaagtatttgaatattatctcttaggaactgatgaaatatagaggtttcaagcatttccatcagcacacaattattcacaacaaccttctagatgcttattttctatcttttcctatacaagctgcttccaaatcaccgtcattactactgaagaattcaaagtcctgagctcaaaagcaatcagaacccataaggtagcataattaatagtacaaaatttcagttaaatgcttaaatcatagcaaactacaaataatataacaccaaatagaatattattgtctcaatgaggtaatgactcatcaactaaaaccacctaagatagaactttttggtatctgctttctattggtacaacactttcattcttaatgtttcttatggcttcacaggttttagaaataaaacaatacattttcagccttccacagtaatcaacactttcaaaaactgagatacacatatgcatgctacactaacttacaatatacaagtatttggttatatattaactctcaaagaacacaactgtttactattccctttccacaattgttaacaggatgcactttctttaaatataaagtgaagaaaaatcagaaattttgcaaccaatattttccttcagttttctactttatcatcttctgataccaccataccctgaggcagttgttgttctcgggtcagagtttgacctgggcctcctctaagcagtaggatgattattccatgtgctagagtacaatggaggataagatggggggcgggtgccacatgtctaaaaagagtgctgctgatatactgctgccaaacaaatacccaatattcctccagttcccacaccagtccagaatcctggtccagaattttcatatgcttgtcctgcaaaaggacagtcaaaaatagaagttgcaccatggctagaattctgcagtcctgtgaatgcagaataaagactggcatcaggggtcctgctcagttggtgaatttctgacaacggtgggaaatgcacaatactcagaatatggtggcatagaatattgaccattgcttaggaacagtctataaactacaaggtagaagcaccacagtggtaatcaatccactgatgccacaggaatctgcagagtaccactaataaaaattatctgagaggccaggcgccatggctcatgcctgtaatcccagaactttgggaggccgaggcaggcggatcaccttaggtcagaagttcgagaccagcatggccaacatggtgaaacctgtctctaccaaaaatacaaaaattagccagaggtggtggcatgtgcctgtaatcccagctactcgggaggtcgaggcaggagaatcacttgaacctgggaggcagaggttgcagtgattcaagatcacgccactgcactccagcctgggcaacagagtgagactgtgtctcaaaaaaaaaaaaaaaaaaaaaaaattcatccgagaaagaggtaaagctgtggtgttttccagattctgaatttcttcaggccaagttccaagaccatacaacctaagttatattccaagccacaggaacctctttgtacacacaggtgttcaggggattcatagcatttacagcttaccactgtttttttctaaatttgtgtgcaatatctaaatcactctcacattcccatggggtctttccagcccagtgtagagcttgcaattactagaggcaaatgcaggctgtggtagtgcatgcttctgtgcagttacgccaggagctccagtaaaaggaaagtcacttctacactgttttaacatacatgaatttccccgccgtagaattaccatgtacatctaggataaatttattttatttaaaaacatttcggaaagtcccactaccaatcgcccaatttgtcaatataatataccccatctatcacacccacagagatcttaggtataagtaaaagcatctaatgaattcactatgcttggtcatgcctgaacatttacatattaaaatatgtgctatttattatgcattgactttctcttacctctttttttttttaacatttcagagaaactgggctttttaaaaatatttcttctttagatagatcatgttttttatgtgtttagatttaggaagtaaaagagcattggcttagaaagcaatggatttatggtaagtcgcagcagttgggcccagaaagtgtgaggaccactggtccagagaacttctgattctctacctgtcttcttctctaatagggaaagagttagcaggacgtcacttctcagttcctaatcatgccctaagcctggcagtgagaagcgtggcagatgctaggggtgggcgtactggaagggaaaagaaaataatattttccagtgcctagattttggtgttggcaggaaaattatttgcccgtgacaaactgcatttatcttttatggaaactgtgctcaatttatgaactacactcactttaaattaactagaaaccaaagttatattgtgtaaatttcagttgaattccaattttactaaccaaaactcctgttggttaattatacattttacataatattgaattcagataacaaaagtcgagcctcaatctctcaatctaaaacaaaattcagcacacttcactgtagggtaacaactgttaacttattgactaacttttttttctttccttttttttttctttttgagacagagttttgctcttgttgcccaggctggagtgcaatggcatgatctccactcaccgcaacctctgcctccctggttcaagcgattctcctgcctcaggttcctgagtagctgggattacaggcatgcgccactacacctgcctaattttgtatttttcgtggagacggggtttctccatgttggccaggctggtctcgaacttactgactaagttttaaatgaatcagtgctacatttaatttgaagaagtaacaaagagttagagaaaaaacaaagataactggggaattgggtgcaagtccaccataatctgttgacactctataaaaattccatgtgagtaatattttaaccagaaaaataggaataatgactgttctctagagcaaccataaccagtacctagaaaatatgtaataaacaaggaaatggactagaacactaatgtggttttctggcaaagaactatccttacttaaaaataatgagaagaatattcaaatacttactttcctttaaataatgaaaactttaattcatgactcccatagctgttgttaggatttatgagtgaagtcactaaactaacattcattgagcacatgctaggtactatagcaagtgctttgtatattgcatttcaatcagctttccaaataatggtatgaggttattgctactatatatcgtaatttccaagccaaaacttagaaaagatcagtaatttttccaaagtctatataatcaagaaacaccagagtaggagatagatcccaagattcgttgactccaaaggctatttttctaaactctaagctctatttactgcctatatagtaagaggggattagcagcaacattggaatttacacagggaaatacacggggaatgttcgatcatctaaggccttccaataatttttcttttttccaaaagaaagcaagagcaagtttattttctgttttaattaatatttcaaaaaaagccatcaagaagtctgcttgtttgaatttctaagttttcacatcaagattctgatttttaggtttgtccaaagctggagaataataaagtttgatatattcaaaacaatgttttcctttatatgtttttctagagatgggagtctcaatatgttacctagactgcacttaaactcctgtgctcaagcaatcctctcacctaagtctctcaagtaggtggaactatagacatgcaccatcccacctggcttaaattgggatatattaatgttagtcaatggttcatccataaatgaattttcaaaagcctcatttataatatttaaagcttgtatgtaaaaatgcacgtagccttcagaatttgacatatttcccaaattcaatgtagtgccagatgataaaaaaatccaaaagaatgcaacacaataagtatgttgaataaatgttaagcaaattttattttgcatttaaaaacatattctttttgcccatttggaatagacatcatgattttaaacaaagaaactgcaggtacttactatggaactatacaactaaatatgcaaagacaatatttgtgttatttcaaagctttcattggtaagctttttattagcaaaaatataaggaagcttagtttcctgcaagagaaataaatagtaaaaattaatgtctctgagccatagcttgcctccacacaagtagtgaatcatttctcccatctgtcccaacctgaatatatcccttagagatatctgcctttctgggaagagcgttggcatgtatatttattattactttcatttatatacagttctagctttgctgctatcttcctagagccttcagttcttctgtgatgttgagtaagagttatatgttttactggaaagatatcagtcactattattcataattagaaataaaatctttgaattgattagaagataattaatgtatattctaagaaaaaaatctacttttaagatacataatgatacacattagagacaccacaagaatggatagaacttttggtttctctaaaaatatgacctagatgtcaactagagtcttcctcattttgatagttaaataatactaactgctgtccccatatcatggcctatgggaagtctaatgcattcctctttgatgcttttaagtatacaggagttttcattcttgcaacaacctggtcgctccaatgttcttatctcactaaatccttgaatatgtcccattccattagacactctcaaaacatcactcacataaggcttttgtgtgcttatgaggtaagaaacaataatcatagatcaaatagtaatatgcataaacaatagcaatcagaatataaggcattcttattttaagattttcttttttagccatgttttctactcactggcaggtcattttgctgtctggctggtcattttcctgctggggtctctattctctctccacatccatatatcccaattaacatattatatgaagctatttttttaatctctatttcccctcgcttgactaaaccatccccaaataatttttatcttagcaaaaacaaaaacaaaaaactaagatttttaaggtatattccaaggcaaagatagctttctttctgaaaggaccctttaaatatcctattacaaaaacagtttagtctaaatattgtctttaatctcaaataaattgacgaattacttagcaggaggcactagagacttagagtaaatgacaaaaatctctgccctttcgaaactctgtctacctgggaaaatgtacaaatgaagaaggttacagacaatgcactaagtgttataatagagttgtatgggtttaaggagcagggaaaatctggggattagaggtctaggggctcacagattcacatagaaggaaacatctgagctaagactttcagaatgaataagaatttgctaggcacttgggaaattaaggcattccagatccagggaaaacatttgtcaaggcataacgataatttatttgaaaaaatagtaattggatatctttgacagggtatgtatagaagcgatgtgatccaattagacagaaggtaggggatttaagtgatatattttgaaggtctaagtaagacaggctgtggaagtaaacagtagaggatctgaaacagatttcctgttgggagtttggtttcaaggaactcaggtttctggctgaggcatctctgcagaacagcattaaaatatccaatggtgatttttagtttgacatttgatttatgctgatattgatgtgcataggggatgttgaggttagttctttagtagaactaatcaaaataaactcaaggtgccattaaaacagcaaaggcaaatatgtcaataaagatacaaggggaaatcatttaagggggaagaccagtggactaacgactgaactctggggggaaaatctatatttaatggctaaaaagaggaagaatctgagatgggaagaggtctcagaaggaaattggaagaaccaggtgatagcgctttcttagaatcctaatgaaagaattcaagaaggagggagttatcaatggtgataaatggtgcattatgatgcattgagatcaaataagagagtaaaaaatagttattgaatttggcaagtagaagaacagaaaagatagagaaagcaactttattggcatgactaggataaacacattacagtgagtggaaaatgatcaggctagaaatgtacgctcagaatttggtgttgctgccaacacatcaaggtcagacagcaggacttacttagcatgtagcagatgttcaataaagtttatggtataaatgaatgaaaagatgaatggcaaatgaaattctggggtgagccatatccaaaatgaaacatggactatatgttttactatcaggtgctgcattattaaatttagttaatttcattattttaccatactatcattttgaaaggaagctattctgtcattagaaagtacagtccaccttccatgtccaaacagataaaaaatattcaggaaaaaacaattaaaaataacaataaaacaatttaaaatacaaataaaaacaaagtgactatttacaaagcactcacattgcatgatttacatagtattcgcattgtattagatattataagcaatctagagatgatctaaagtatagtgaaggataagcatccatggattttggtttctgaggggtgaaataaaccccccatggatagcaaaggacaacagtaatctattcttgaaatcttatgtttttatagttacttatttgtgtactatcatatttacttctgagtgtgtgaaactgttattttagaagtgatttttgtattgtatatataaagtcttttcaaataagcatatttatgtatccttttacgacctccttaattacaatctctgttttattcactcattctcaaaaagaacaaggaaacaaggtgatactgtggaatcttattttttattagataactacaactggattaattactttaatttctctcttattcaagatgcttttaaattaaatgcctatactgaggcctagatgaatattctgaacacaaaaattctaagaaattatttcagtataaccaatttaaagaacttaattatttaacttacacaattttaatagataaaattaataattaatttaaaaacaatgtttatataatttcaataatatttatcactattatagtaaccaaaataatactatataataaccaaaattattgaactttagaaataaatggcaaaactactttataaggttaatcagaacctcagaaattatggattgaagaatcaacactattaaatatgtaagcatagaactctatgcaggaggagaaagtaagaaaaccttctggttaagtaaattatttcatattacattgtgtccccttctaagtgtaaactgcactgtgtaatatacacattttttttttcttgaacagacttagtcataacagttaattacagagacaggtatttactttgtaaatatagatgcaactaaattgaaagtattattctggaaccaatgtataggtttctgacttgccaaacatgttacaattgaaatgtcaagaaacagtaccttctagtatctaagttatcaatcatgatgactatatcaataaaaacttattatatgtttgaacaatataatgaaaaatatgaatcttttgttatttaatgtttggtggtttaaatatcaaaaattcatgtgtgtagctttccaaaatgataataattcaaataaacaactcagttcaattaatactctaaattcaatttttgactaaattttacataagtgaaaaagtagtttcctatttagaagatatgatcccattcacgctaaacagtaaagtagctttagtcatttttgatgatgtaggttacccagagaaactatattacagatctatgccacctacactcagtccatcgacaacgaaacaagtagttgtaatgtagcctattaaaaatcaaatgagtaattcacattttttccatataataaatagtaactgagtcctctgccattcactttgctcatcactgaggacacagaaatcaaagaccgatttttttttccccctaatgaaagagccacagttcatgtacagagtgtggtatgacaggaacacatggatacatgaaattccagagaagaagcattaatctcacgggctgagaggccagagaaggtatcttaggcgagctgtaatctgagctaaggtttgaagaatgaataggatttagccagataaataagggaaataaattgaagcattctaagcaaaggaaataaaaataggaaaaaaaaccaagaagcattagaatgtaactaactcaggaatacattaataattaaaactgtgcctgtaatattaatggtggtaaattgtatttttcaaagatggataccagaaaatatcctatctttgcatactcttttgaacgttagcttgtcctactcccatcaagatgaagactggacttcatttctttgaatcttagcaggccctgtgagcactttaacccatagcatgtggcagaagttggtagcataaaagacacaagcatagcacttcaattacctaacaacttctaccttctgcttcttgtagccctaatcctggacctcatgtaagaagttcaggaaccacaagactctgcggaagagaggagccatagaggagcactgagctgctagacatgtgagtgaagaaaccatccttgcttgacaccagcccatcaaagactttgcatgatgctagtcccatctgctttccaattggaactgcattgagagactttgggtgagaattatccaatcaactccctggtcagaaaaaatagtgataaggtggtgttttaagcctccatgttttggagtttttgtcaataacagtaaataactgagatataaagtgtctgttttgatggtgatgatggagtaggtggtaagagctggataagtgacttggaaccagattaagaatggttttcatggcatttaagattttggttttagttttaagggcaatgctatggcaaaaagaaattaattgatttaatacaacttttttttgctagaaatggggatttgatccaatttatactaaatatcacaatataaattaaaagaggtgagcactagaatgaggagactcagttgaagggtgcttcagtaattgaagtaaaaatgataagtctgaactaaaatggcaacagtaggaagaaggggatacaagtgatgtcaagatttacctaggagataaaatttgtaggacttgatcagttgtataggagagatataattttaggtacttaattagtaaaaagtgatggcaactcaaattttcctaagccaaagtgggatatgttttcaggataatggtgcttctcttggaactcaaagactgggatgtgtctgggtctcagggacaactggaactgggaaccgaaatgtcactttccactttttaactctgctcctacctaaatctttattttctttctctgtaccatggcttcttccaattttcttattataatggaggaacacatggcctccaaattgaccaagatttacatctaatagttttaagatccaacaaaatctactatctctttctcagatccaggaacaaaatgttcaagaaatcttctgatcagatatttgaaaagaattgattttaatttgctcatgtcctcaaagcaacaaggggagtttgaggtgtagtgaatagtttcttagaagaacaacgattgtattccaattaagggaacataattcttgatcttagatcaggtggacatttatagttctgggatttgaaatataaatgttttctgaactaaaaacgtatacagttatttcagcacaagaactgaaggctgttcagaaatgtataccaaagtttttcttgttcagtaccatgtgagatcatttcaaactctcagtaacagagatgagtcaaccttctaataagtattggtcttctctttctctaaagatagacatttttgggggaataggatctcagagtacagtttgtgatcaaatctcaaaaaagtttattgcatttacaacagcatttttcaaagagaacacctctaaatacgacacacagttttgtggtcacacgaatcctcaaagtgctatattttatgtctgccttcaaggtattcactatatagatgagaagattaaaagctctaagaaatctgtaaacacacacatgcttctaaaactagtattttctaatgtatttgacaacctttttaatagtctttctaatatcccatattatatgttgtaggaaattcatataaagtaatattgatttagatatctaagtccatgatttcaaaatggaaagtttttgtcccaatttaagacatatggtatgtaatatagcataagatataataatgtgtataaaacgtcttcactgatactcttagtcaaatgacattttattgatataactttaattaatgaatgatgttggcacattaatccttttctgtttcccagtagatattatgctttattattctgcaattcttgaaattgataatttataaatcttaacaggcacaattttcaaacagtgacagactttcatgaggagaaaagaaatatttagtcataggtttgtttaaattaatattttcaccatttgggatgacaaagcacaaaaaattacaatttctttttatagaggataagaataaaattagagcacaaatctgtaagtcagtaaattaatagagttgagatttttaaaacatctagtattttaatgcaatgaagagaagaaaacatacagaatcccacaactcatgtctgcagatcaataaaaaggtacagacttgatacatattactgctatgcttcttctgggtacttaaatatggctctaacaaaatataataggccactgtcaaattcagtgttttctgaaccttgtcgcccatcaggataattcagagtttttaaaaatagagacccttggggtttcatcctctaaattaagtgttagttgggatggaactaagaaatgtttatgtttaaaagcatctctggtgattctgacatcactggtctgtaactagccatgatatgtgggaaacactggactgggtgttcctggatcatttggctactatttccaaatactgtaaatactgtgtgttatattatatattccaacttttcaattatctttacttattcatcaaaatgaaatgttattaattagaccaatactttgaagtgatggtagcctaataatattccttgataaatgcacggtggtcattttaccaaaattaatcagatgaatacataaaagtttatggctgtcaattgaataatacttcttatcatgaataatgcaaatgggtttattggggtcctaacattttaaactacatacatgtcaaacttaattaactctgctttcataaccacctacagaatgtcttacccttttttcatgcacattagaagatgcaaaactctgaactgttttccacaaactaacataacatatattgataggacttaataggctatcttacaagtgaaggctaattgctaaaggtgagattaggtaagttgaaaagtggtgctggacatcaaacaagtgggaaaatttgtgcaagtttttaatcaatattttgataggttattatagttcaatatatctaccccctacattaacttccgtggttgtggagtattaaaaaaaaaatcaagcaaaactttatcagtgataatcaaccaatttaagagagaaattccacatatggcctaaaacctgggggctacccattgttgggatccttattactgaaattcaccatcaatctaatagaagctaaaatataagatgtacatgaggactgcacatctttcactttttgcacttatttgcatttttaatcagcaagaatgttgaaaattaatttttatttcaataaaaattcaatattagtttcaataaaagtcaagctgttaatttcttaactgctgaaaatattttttaaaatatttgtagaagtgatctaagttatcttgatgactggcatttttttttccctcaatgagaccatcagcagtaaaaggaggaattaaacaggaagtatttatcaggtctcattcttatatgcttttactgaagtgtatttctctccctgatcaatagctatgcattagagaggacagatatagatcttatatctacacacacacacacacacacacgtatacatatacataaaaatacagatattatacgtatgtataggtataataatataaagagtaatttctaaataaatatttgtctagaaatttgactgaactctgtgggtggagggacaagatcttttattcatcatgatattcccaaatcccagtttctgatagagtaaagactccccaaatccccatatcttaaatggatatttatatcctttctatagaggcatccaatttcaaacttactttggttaaaatccctgcatattttctttcccattgaccaaagtggagaagtatctttaaaactggtcaaccctagcaagctatttaatagctacagtgaatgctttcttactcaaagatctcatcattaaagctatcaattgttccaggaatcagcattatttcagcagttttcaccagctatctttaaaactagtctttgtataggtgaataggtatagaaatttcctttctctataatttaagctaattcataaaaatacactaagctaggtcattactcagagttaaatactttcagattataactgagccttctcaaattaaatggcatttagctcactaaatgtgtaatttacttaaaagtattaatagtcttgagagaattagtgcttatgctaaaatataattacaaactctctggccataaattatttttctaataccatctgagactcagaaaatgtgtgtaaaggcatgccatggcctaatctgggtagcacaattataggggattatctctggaattggtggtcctgtctcaaatctaccattataatagggaaagtaatgtttaaacagtttttgcattattcttgttattcttaagatactccatttatactcaaatcaccctaaaaagataagaatctatcaagtttatgaaataaaactttctgaattcccaggttgtggctcatttctcaaaggggatgtagatgactcattctgcctagtgtataaataatatcattgcataatgcccaattcttctagcaactaagttgaaatatatagagaatcatattcatgcttttccacattttctttgtacttctcaagttgtggagcttggacgtaagccagtacttagaatgaatggaagattgatcagtagttactgtgatctacatttctttatcctagggcaactatattttcatacacattacaatttgatacaagcttgctgacaataattagaaaattcaggcaatcaaaatacaaataaatcaataatagttacactacctggagagaacattcccgtgctttcacatggaatataggatggccctcgcacattggtggtagtggagacagcccatcccagtgtgatcacagagctgtagaacaatgcacatcaaagaagccaggacagcagaaggagttaacagtctctcaaaggatttgtttaggaggacttccaagatatctacagggacttgaaaaatacttgaagaggtggctatgtatttctgatcctgtaatggcaggtgtgggcagagctggtgaaaaagggattactactttctaatttccactctggctggagtggcctggggaagcacacactataatatatgttacgaatatgtgtgtttttccattctatatcacacaatggcattagtgtcatttctagaagagtgtattgtgtattcaaaaggccaaaatatagtcccttctaaactagaacaagtataatacttattctgataagttcttgaattacaatatatggctacttggctagcttaatctattttcttaaattcatttcagagttaatagccctgaaaattaagaaatctttgaaccatttgaaaaagacatactttgtgcaatagctgaaacaattttaaaacacacagagaaaatactacccttcatttatttaaaggagttaagaattgcttcaaggtactctaactgatagaaaatgtgggtaatatcagctaatcatatttcaacaataagagggttaaaggaccttgatgctcattattaaaaaggaatgtgggtgtggtagaaacagcgtgtgcatttgcacgtgtggatgcatgtgcatgcacgtgcatgtgtgtgtgtgcacatataatagttagcaaggatattataggacaataaaacatgacacaatattgtcattccagagttgttgtgtgttatgggtccttcaaaggactcaaattttattttgttgtattctattgggagaaaaataatttttattccaaagctaagttaatgttttcatgttgcataatcaaaatgatgactttgatctaatgagattttataagcacattaaaaattatacccttataattataaacgtaccattagaagactctttttcttagaaactccgttataaacttaagaatgggttcaattgctattgtgtcaaggatttctcaaaaacatcaaaaggaaaacttttttatatttaggtgagatcttgtaaacctctttgaaattataaatgcaagatacttattaagtgattttacatttcatttatttttcttacccaatgctttttacatgatgcttagttgtttttttttttgttgttgtttttttgcaatcttctgtctcatttcccccaacccaaataatttgacacacatcgtttcaaataaattaacatcctatctcagtggactcctttggccaaaatagaaagttcaaatcctaatttgtgggctgacacatgtggcctcctctatccaagatataacacgttattacactttgcactaacagacactgaagagctatgagccttctttcttattcttgtcttttaaactgaggtttgaattgacgtatacctgtgatcctgaataatacaggtactgtagactggaatgtaaaagagacaaaagtaaggtccaaatggtacagatactagaggtagtgtggtaaaggtgtttaaaatattatcaaaagtacgggcatgtctttaaaaaaacagaattgtggtggggggtatgtgtgtgtgtgtctgtgtgtatgtgtgtgtgtgagagagagagagagctagagagagagacagagagaacaggcaaaggagagaaagaacaaatcctaatttagctttagatgtagaactatatgtgaaaggtggaaggtaatcatatgtcattagttttacattcttacatgacctcaccatctgattgtttttatagaaatactagcagagtcatatgtgttttaaaaaagaactaggagaattcattaggatgacttacttctttcataaataaaaactggattgacttatttaataaatgtcctgtaagagcctatgtgtcaggcagaaaaccagactctctctcagagaatacttcttcagatcttaaaattttggtctaaatattttaactgagcttaaatgtgttcaaaaatttgcctttactgcctttcaacatcatgtaaccctagatttataaacacagaaaagcatggaatagaagaaaaaggtcgtatttggaatcgcagagatgtaagtctatttctcagctctagtacaggtgcctctgattctattaagatgggaataagttattaatgaacatacaagcttaaatttataaaatttagagaaataaatctatctgaaaacagctgataatttttaatctattgaaacttctgatcagggaagaatagatatcaacaaatcaccttttatgcaaaagactttctgcccacgttttaaatcaatgagctttgttcctaaatgaaaaactaattgtgtatgtatgtgtgtgtgtatttatatataatcttagctattttatgcaatgatttacataactcactaagtttaaaagtgtaatggcattccaaattttttcctatgattcatttaagataacagcatctatttctattgtagtttacatgagaagaaagaaagacccaggctgtgtatatgatatgagatggcaaagagcaaacttcatgaacagaatatgctgtctcctatgttccacctttcccttatgatattgcagcaaatttaatctcactagtttcagacataacatttcaattagcatagctaataatttagaaaaacaattttggaggctttttaatatgataggcaactatgatagtataagtaagaattagacacagttcatgcttcaaaaacttacaatctctcatgtgaagcaaatagaaatacagtaatgaattaatgaggtaagtgtagagattgtgatgtgccagggtaatacaggagggagtccccccccaaaaaaaacgttaagcaaatctgttggtatgttagaaaaactcctgtccaaagggctcatatagctatcttcctattacttcccctctctctgataaataaattttatattctctggagtgctgtctggggtaattttacaaatcactttttttaaattatagcatagggttcagatggaattagtaacagacgcaagctgccaacttcggtttcttatgtgaaagccacttgttctcaaagggtctccactttctaggcttgcttggtttttgttttctgagtctggttcaaactttaccatatgttcttaaaaaaattaactgcttaagagttgatttatcttgtctgcattgaatagcttattatctttaaccatgcatctacctggagtattcttttgatgaagttttaccaaacaaaattctaactagactttcttttaaccttaacaaatacttcatgttcacatttatgttttgctaatgtcagaaaacaggtatcatcaaagataaaaatcatttaataagttaatattgacagtacttcttttattctaaagttttgttgtctcttaaaaagataggcctttatgtttttcagatctagttttataggtctgtaacagattgtctgttgctaagcattccagaaaaagaaatgtaacttagagggtacaaaaagaaaattataaaatccagtgaaagaaacataaaaattgaatacatctaaaagtagtaagttataagaagaataaattatgctactttaagccaagggttaattgtcttgatgttctttgaatataaaattataattatagccaaaaataattaggccagtacataaaatgaaaataattctgaaaatggtaccctattatatttactgccaagtgtttatttttattctacagatagtcacagagaaaacactattaggggaaaacattgaaaacttatatagttagaactgaagatgataggtaaataagtttcactgaggaatatttcaagaacatgtaggcattttgtaagagagtatgttgaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaaaaaaaaaaaaaaagagagagtatgttgaatgtacaataactacttacagtgaatatttccaataggataatataacattcattctttcaggatattaggcaaggaaagatattcttgcaagtcattgccaatgtcaatagacaacgaacattgtctaaacagagatgtcatggccctcattttttgtctttctttttgaggagtgaatgtctccatcttgtcctcttttctatatatatgttcttcttgtttttaaattatctttcctaagaaacttcactacatattcctgcccaagtatatcagtttgtctatgtcattgcttctgtcttttatctcctctggtttgtgactccactacttagtctgggtccccctttcttctggcatctccactagatcctgagcctgaacttcaaacattatacactattgacagcacttaaggatttactaacacgtgcttttcatacatgtacaacctctgttctactgtcttagatttctcttttccacaattacccttcttaaagaggtagtccaacttcactgtttccacttgcttttcaagtggaaaagcttgtggaacttgcttgtggaaaaacgtgtttactccatactcattgcaatctggtttcctttttagtgaattaaatccaaaatcctcttcttagttcacatctaatcttttaaatatatgacataatatgtgacataatatgactcaagaacaacccctctactcagcatggaggtctgttgagaaaacagactacagctcaccagaagaaatcaacacacgctgttaaaatcagctaattgaactgctttactctaaatataaatgacttaaatcttagcatctatgatgatacactagtcagtcgttattcattaatttgtgtatttaaaagatataaagccattatcatgcagcaggcatcattacagatgctaagttataaagctgagaatcatatggtcccagcatttgtgaggggaaaaagtacacaaataattgtaataaaatgtgttatgctataatagagatatttgccattgcagtatggtatcatagaagatgagtcacttacaaaaaacctttaatacatatcattgtgtccaagtatataaaaacaataaaaaagtattcaacataaatctttttatttaaaagggaataaaaaattggcttctaaagatttttgtgtgaatgacatcaaacatcacacactcattttgcaaaatagacataagtatgaaaaacaattattttgaatgtattattaattctgataaacattgtacatagaaatcattcatcttcattgaacattcatgacattgatcattcaaatagcacttcaaaagcagagcatttgaaatgagaaaatttacagaactatagatttttcaagctgaaggaaagaaacttagagactatttggtccacactcatcattttacaaagaaggaattgatgctctgggagacacttgcacacaaattctctgaagcataactgaaatagaagcgagcctgctctactgctagtgacctttctaccaaaatgcaaactgaccaaaataggttgtctgtacagtgaactgctattaaggatggagttcttttgttggttttgaggtttccggagttggctgcttaatatgattaggcccaaaaatgctaaggactctacttccaatagtatgtagaacactgatagtccttggtgtgaactgtttagagagttatgcaaaataaatgcatttaacattcctgattcactgcttgtgagaggcaagcagtttactgaccctatacctaatacctttgaccatatgcggagaaccaaggaacataatgaagctggttggttgtttctaagttcagtggacaaagtgatgaaagaaaatgatgtactcagggatgctaactcccggcttcaaaagcagatactgagcctcaaatctgctaagactgccctgagtgagagtcttatcctctctgtagagaaagagttgaaattgtggaaaaacagacacaagctcttatcatacaagtggctgacctgcaaggaaaggtgcatgcacaacctcaccagctgtctactgttaaagtgagggcattgattggaaaagaataggaccctgcaactcggaatggggatgtgtgggaggaccctgataaagctggagatactgagtttataaactctgatgaaccttttttgccagaagaaacagcttacccatccccagtagtggtaacatcccctccccgatccatgctgccatcagcctctccacctttgtctgaggagataaaccctgtgctgcctgaggcaacagtgatgacctcccctgaggcagttgccaggcaagataatgttgattctcctcaggagccacccccaacactcctgtttgcttctagacctataactagactggcctagcctcccagcctacatctttctcccgtgctggatgcttcctgccctcgaatatcagactccaagttcttcagttttgggactcggactggctctccttgttcctcagcctgcagatggcctattgtgggaccttgtgatcatgtgagttaataataaactcctgtctatctatctacctatctatctgtctatcatctacctaattcgttctgtccctctacagaacactaactaatacaactgcatacactcctttctgaaagtatttacaatagcctgagaaaaatattttaatgaggactgtgtgtgttttgccaccacttcattttctccaattataaaattatagaccaactcctaaacacagtgttaaactcccaggaatcctcaaatagatattacttaacataactgagattgtgttgccctaagaaattaataaggaaatcaaatgcctagaaacagctttcatatcttataaaaattacaagctctgccccccaaaaatgtcatgggtaatgccacaaatattttctttatctgtcatctgatcacttcattttaggacaaatctataactatttactttcctttgtaataattacttgccagaggcagaccagaatttgatgtattcaaacctgtcacatatgtatatttacagggaaagcacatcttctctgtgggagagaattaggttttaaagttagttcataaggcaaaagtcaatgtattcaaaaccaccctggatggtccctcagggaagcaccagtctgaagatcaaatactgagtcccactatgctcactccaggcatttttcttcagagttagaatatatcactcctcctaggcaagaggacccagtaaatgacctgccctgccataagggctttgtcttatgaaaagtacatgtacgttttggccgggcacggtggctcatgcctgtaatcccagcactttgggaggctgaggcaggtagagcatgaggtcaagagatcgagaccatcctggccaacatggtaaaaccccatctgtactaagaaaatacaaaaatcagctaggcttggtggtgggtgcctgtagtcccagatactcgggaggttgaggcagaagaatcacttgaagccgggaggcggaggttgcagtgggccaagattgtgccactacactccagcctagcagcctggtgacacagtgagactccaactcaaaaaaaaaaaaaaaaaaaaaagaaaagaaaagaaaaaaagaaaagtacatgtactttttaatgtatgaaaagtgtctttatcaactaggattacattcagcattagagagtgctcacttcaagagaaggacacatttttcaagtttccgtattcacattctcttagggggatatacactcattgcaatggattcctgtaagatttcagtggttatttgtgtcccatatttttgttgttgtagaacatgtgtgactgtatttatacaagatacatgtgcaactgatgccattccacttactacatacactttctcatatatctatgtttatacactgacatagatgtatatcagtactcaactgtacatacgtgtgtactgtaagaaatgttttatggtataagtttgtttcaggaaacaactgcatgttgtaagaataaaattataatagtaatgcagtttataaaatatgtaattgttgtataataatttgtctgatctttttccctccctgggagaaactttctttttcttgagactgagtggcgctctgtcgcccaggctagagtgcagtggcgcaatctcggctcactgcaagctctgcctcccgggattcacgccattttcctgcctcggcctcccgagtagctgggaccacaggcacccaccaccatgcctggctaatttcttttgtatttttagtagagatggggtttcaccgtgttagccaggatggtctcgatctcctgacctcgtgatccacctgcctcggcttcccaaagtgctgggattacaggcgtgatccactgcgcccggccaggagagactttctagacccttataattgataggagtgtttttattattaatacctgattttgtgctaataaaatgacttatgctgggcctttagatagttttagaataagagatggtcatgtcaaaaatatgaagcatgtgattagtggatttggggctttgatccatgtaatatttgactaaactcctgactccagtgagaggaggggtctacagattgagtccaatcacttggccaatgattcacctaatcatacctgcatgataaaactccagtgaaaactttggacacctgaagtgaacttcctggttgatgatatgcactgatgtgctgggagtgtgatacatcctgataacaaagaagcttcaaatttgggaccctcccattccagggcttatgtgtctcttcatttggctggtcctgatttgtgtcctttctactgaaactgtaattgaaaatatagcactttcctgaattctatgagttgttctagtgaattattgaacctcggtggaaaatgtaaaccttcacatttatagacacttgatcagaaatgtaggtggcctggcaacctcagagctttcaactggtgtttgaagtgagcatagtcttgtggatgcctgtgtccttaacctgtaaagtctgcactaattccaggtagtgatagaattgcattgcagtaatcatgttcctaatctgactaacactaggtttaaatgaacagattaagttgtttgtttaatatgcaattcatgtaaacttcctcaagaagctgtacccactagggggtggataaaacattaatttaatccaatctgataatttaaacagtttcttgagataaaggacttccatatctcctgctctggctactctctgagatgacagtgcagggtacaggtcatatataaactcatgaaaaaggacaagagtcagaggcctagaatgtgctatcttttgcctcttctgtcaccaaggcactgtcccttgtttgtctgatggtgggtctcctttcttgtattcaaacatttgtctggggttaatataacttgggatctctgttgaagcctggtcgccattgccagttagactttccttagctaagcccctagctctatagagcttcctgaatgggtggccggccctccacctttactgctgggttaagttgctttttcccatggctggcccaattgcaggccttcaggcactcaaatctgcagctttcagcgtgtcctctcagggagatttgatctgagaactcataagtctttccatcctacaggggatacaagggagtgtcttgtctcatatacagaacaagaatgcatgatgagaaaccatccctccaccttgatatgcctttctttttatcaaatacgtcttacatcagcttcatgcctggccttccttttcttccattccccatcttgatggagaggaatagactctctaccctattctctacagcgttactcagtgtcagaggtcaaaaactacatggtataatggggaaattaaaacaattcagattaatttcttcaaaatggtatcttttgttaaataaagataaatattcatatttatatatttaaagaattaaaacatgtatgtggccaaaatagaaaatcactgttttgataaaaatatattagatattgttctacttttcttcataatggtattcaaataggacagctaaagacaaaacagtatttaaactatttaatttagttatcaacatgcattcattttgaatcatgatttttaaataatattgctgaaaatttaaagtagtgtggttggtgagaatcatagcttctttctatgtgttcatatttcattgaataatagagttgctttttttatctttaacaaataaaaacatgatcaatacctagcattagatttcttacaatttgaagaaactttataccatattggttctgctgtacaaatgagagataaaattgctattttaagatgagaattgtacgtaacttttatcttccctaacaaaaagtaatgtgcatttactccacaacgatttgaaagtgtgaataaaaagtgaaataatctaaactccgactactccaacaaaaaagcctttagcttccaatacgtaaaatcactgaatcctatggttcagagaaacaaaactagttgctaatatctttccaggtatacttgcagatttttcaaaatgcattcattgaaaaacatttataacaataatattacactgtagaggaatattgtgtcctatattttaaatttaacaccaaataataaacaaaattagaatattaaacaagtttggaacattgtcattgtggaattaggaaagaactatataataataccaatagcttctacttactggcacttaatcaatacaaggatactgcaaagagctttatttatatatgctaaaattttatttaatacacaaaatataggaagtaagtgctattattgttccttttactgatttttttatagataggttagaaatgattatgtcaaccatccaaggttacaaagctggtaataggcagtgagggcatttgaactctaaactatccacaatttaaaccccaagtttgataactgagagaatgagccatacctataagctctttctccctgtttccaaatctagacacaggctagccagttatcctgaattatttcaaaacccagcaaagcaagtgttcactcttttcccttccccttattttccaacctatgctcattactacttcctatttctcaaatatatgatggctaaccatatggttaacatcatatatattatcttgggaatcaaagatgatgtattgaaagataagttttcactaaacccagtgataatagaacaagagatgctgttttttgacttgacaattacatttaatattgatttgtatgttttcctcaaatgttgataatatttttttcaaaattcattggccccatttattcctttgaaaaatccacactaaagtttttttctcctcccccttcacttattgccagactaaatttagagaaagacaagtgctgtgttgccaaatcgtgaaatgtgtttgggcgaggtgatgagagttggtttgtgagcagtaagggctgctgctatttttgccaagagaagtataatatacatgactctttaaaaattatctattgtgtgtcttttaagcaatcttggttttaaaatctattgtgggtcttttatgcaatcttggttttaaaaattgaagcattctttaacattcatcagttgtgaaaatttttcttaaaaagggggaatttatctcattcctttaaaaaataattttataattacataaaaatataatattttataatatataaaatatatcaattaatataatttataggtaaaaatttatgtattaatttcaaaatagtaactgtaatgtggattataaaaacagtttcaccatgtctaccaggagatatcatcccatcatagaaagccggttcgaaactaactgaagatatgatctcttactggtttatattcttctaaagttttgactggctagattcattgaaatctagattcacaaggtattttcatttatatggtcatatttaattgcatcccctagtaaaaaaaatcatctagaatatttattctattcattatggtgtaacaacttgcatttgatttttttcatactgagaatttttttccctactctactgtgctatgattacatgaaatagctatgataccagcatttatagaatctaattagagtatgcctatgtggagaatgattccaggattgaaaatttcttgcgtaaaatgctttaaaatattcttccaaatcaactctgattttgaatttaattgtggtggcccattactgcttttaacatttctggactacattcttggcattaaacttgtcttgggagtggaaggaagaaggaaaaaatatcccagtaactagtaaacaaaaacaggcagaatattagaaggaaaatattcatattcatcctaccacctctccctgctgccatttgacctagctaccagcaacgtaaccgagcagcttatttgaagagtctattatactggttcaaggactgggaagcagactccttgggttgaaatcccagctcttcacttacaagttgtgccatcttaagcaagttactcatctggaagtagtttaacaagcaaataacctagcatgctggattataataaaggtcaactggttaatatgcatgggtaaaccacttaggacagaacacacagggtacacaaaatatatgtgtttctaaagtaaaataatctcattccttgtgatttataaccttgaaataattatatccatttaataatctactcattcacatattcagaaaacatttacagagtactataactgtttttcactttttttctgggcctagaataattttgtccaatgtgacaagcaacaatttttgtcgacacattgtaggtattaagaattgaataaaagagaaatccagtgtattccatctacttctttcatatactgaagtggcattccaaatgaaatgttgtctaattccgtatctgagccaaagtggtaaacccaatgctggatcatgtagtcttaatatgcaagagcactgaagagagaacctgttttagggtatcccccaggacataacagatatgcagatctgtctgatcaccttgtcactctgctacagccatgctggtctccttgctttgttaggacatgtcaaacaatcttccacctcaggagattcatatttgctgctccttgtctagagcactccacttctcctaatctccctacttctatccctgctctgacacacaatctgcttgacccatgtcctcatctccttcaggtctcaactcaaaagtcaagttctcagtaagccttccttggaccaccctttaaaaaatagcaacttctcccatatactcagcatttttgtcctgctttgttttcctctttatcactatcatcttgtaatataataaatatgtgtttccttaagtattgttttcattttacatgtaaagacatatttattttctttatgtatcctttcccatacagtgtaagctcaattagaacagtcactctatttgtatactcaatgccaaaaacagtgcctaccacatatcacatgtccaaatgtttaataaactttagaataaatgtagttactttatctatttgcctgtgtcttgggctatttgctttcttttgtgcaaactaaatagaacctgcagcaacctggagttatgcccaatgagcactacaaattagtggtagttctctagtagcaatgggacatcctggtgctcagatctgttttttaaacaccttttcccattaaaaggaactgagatcctttgaagaactggctgatttcaggtctaaagaaggcgagcctgagatagttgtgtgtttgtgtgtgtgtgtgttcagaaaatacgcatacaaagactaatggaagtatgtcaaaggacatatggatcaacttgaaggagctttcactggcaaaatttgggatgacttgtgtactaaaaagaagtgagtgtaatttattttaatgcaacaaagaaagaaaaacacacaagtgtattaatattgagagagagagagagagagactgagactcatttgcaacactggaactaatacagcttcattggtttcagagaagacaataataagttaattaaatgacatgtccaaaatgtcaaatatgacttcagattttcagagcgtgttgcagattaattggcagaaacagcatgtgtgtactttctataagctctcaacatgaagggtggaggccacagacttaacagaagagggagcaccacacaaaacagtagcatatcttattctgtatttttttaaattaatgataccctacagagtgggtacatagctgtcattcacattctctgcagcggtgagaaaatagtcaatttcttgctaacaacaacacaaaagtggtttatacttagagcttagatcgccattctggaatgctaaccatctatgttgaaaaaaatgtttatagacatccattcttctgcttctcaaaccacatttggtattagcaggagtacattctcaaagaaggaactgcagaatcagtaactaggttccataggcagtctctatttctaggttatttccggtaaatgtgaatctccacactcagatttcagtgctttcatcttgtgattctgatatttggtttaaccaccacaatcatgaagcacgcctctatctccccaactatgaatgtatactcccccaaagagaacagcatgtctttaatcactgatgccaggggcttcaaaattgttaattaaaatgctcctgtagaacagcagttaatcctagtcctcaatgatattaaattatctttaaaatatttattgtggttaaagaagcttttatcgactccaaggtcctactgtggtcagtagttctttgtaacctaaaaacagcctaatatcataattgaaagaaaaaagaaacaatttgtaaactgctctatgctggaaacactcaaagttggatttgaatcattgactttcaccctgttattagagttttacttaatatgtccagatctgagatcataattttggcttacaactagacagatggtactcaattacacatttaatgctacattttctaatgtaacaatacaaaaatagttatcaggggctgcatatccattttctgtagacacccaggagaaataactttcacatttcctcttttatcatctacttctgtgcagccagaaggttgcatgccactccttaccatctgtcaatgtattgcttgctaatatatttttctttaatcagagaattgatgggacattctggataagattctatttaatagcaaaagatgatcattttttaaagaattagattatacttgagtactaaaattacatgaaacattattgacattctccttaatatttcagatggctcatcagttttgatattccttgtattttttttaaagaaagagcttacaaaaatcccataaaatagaaaatgatcagaatcagaagaggtgatccttatttctatgccactatgttcaccatccctggtgtaaaagattgcatccttctattaagaccaattgaatgcaataaaaaattgcaaaacctactaagtacctttttagtcatatctccagaataccccatgacttttcagttcccatgaataacacaggtgtaaataaaattttgcctgtagttaccatggtgtttttataaatgttttattattattgggaaaaaaaaaacaccactcttctgatagggcttgcatgcaattagtcacgtgtatttatagaaacaaagtcctaatttaactgatacttttatggttcaccttactcttacagatgcaaagtttaattgtttgctgctgtatgcctttgtgttaccaagggttagataacatgtaaccaaaaagactttgatttttctcctcttttcatggaattgtattaaaactaatttgaatgctaaataaattgatgtctctcttggttctgaaaactggcagaatattttctgtgaagcaaaagaacacacactcacacctctgcaatttatgtagaggatggttatataatcatttcacacagatgaactctaaaatttaaaatgaaatatttgtgagaccactgacttttaaatcacctaagaatgttacatttctatcttgttgttgatttgtaaatgcacgtttaatcattacttttcaatatccccttatccacaatggaaatagtttctgaaagtgaagatatatgtatttaagatatctggaaactatagatggtgaatgtaatcgttccaccaaatgattctcaccactcctctcatcagttaggttttatgacaaagcagatagttacaaattcattactactgctgaacagccaaccaatgcaagcatagtgctgtataataatttttattcaaagtgtttcatgagaaatttaaagtctcaattaagcttatgagtcttagattataaatattggcaatgtgatcacaccatatttaacaggtatttatgaaacatttattttgtcatcagcactatgatagacatcggtgatataaaggtgaacagaaagatatatgggctctgctctctggaaagttccattcaaaaagagaaaaaacaatatatataaatgtataattatatactgagataacctgtatgaaagaaaaaatatggggttataaacctataaaacagaggaacatgatcatatctatttggtcaggaaaggctgttatattagctatgatgagattcagttgcatatgtaagtatcacgaaataagagtgacagaaatgagaaagaagtttactactcttttataaaaaagactactgaatataggtgttccaaggtcatgcacagaagctgcaagttgacaaaggtccatactccttctcttttgtttctgccattttaagcatgtgcttccactttataaacaaagatggctggttgagccccagcaatcaggtttgcattccagttagcaagtagaaggaaagctttatgcaacctgttcccttacattagcaggtgaacacttagtcatacagccaaccatagccatcccatttcacgtgaccacaccagcttcccttcagttttaagttcccttacaattgaagggaagctggtgtggtcatgtgaaatgtgcctgattaagaatggggtgtccttcaataaagcagaagaaaagaatggatatttggaggcaggtagcagtacctatcatagatgtcttgagaaaatgactttggatctgagatttgaaggataaagagatgttagccagatggagtgaggaagggaagactgaaaagcagtccagacacatggctgcaccagcctcacttgcaactgaacttgaacttcctgtatccagcagtctttatgtgggaaacaaaacttctttcagtcaatgccattttgtgatttttaacatatgtgattgaacttaatcctaccaaataaaacaaccgttgctgaccctttagataaggcctacttattctatttttactgtttttctgggtctcatgcatgactaatggtttttgttttgttttgtttattaataatagcaggtttactcttaccatgagtttatgatagcatctaatatcacaaacccaaaagtaaataaatctctatcaaggctatataaatgtctttagaatgcatacaaattttataagtagcttcttgaagtatttcttattgctgaactataccaaagattttgaaaacttttagataatcacgtcatattttaggaaattggaaagcattttaaaacaagttattcaactagtatgatttcatctgaaaatattccctgtattttttttggagggagggattggtaatttattcaaaataatttcaaatgctgttaatccattcatttgtttttgacacatccagactcagcatgaatttttttataatacagctgaagatactagaatttcacatacatataatatttcaagtataaattaattgagctgtagagataagaaaataaatgtttatctaattttgttactcaggataataaagtgctttactaaacaggctattttcctttgtagatttacttaataggaattcaaattctttcaacagaaaatgtttccaaaacagacaaacattagaatatcttgtctttcataaaataattatcccaaataatgagcttagtaaaattaacattcctctgcttagaggaaaaccagacattatagtaaaatatttcacttttaagaagagcttttaaaaagtttattcttttattgttttcctccacattttctctttggattggttccctcctgtatgaaaggttcctatcctgtgcacagtattagcaagtagatataaccgtcaaacatatttttcctactaagaagaagccattggcaaatgccagagagcattcattaaaccaccataataggaaatataaccatatgagtgagttgttcaaaacaattcaaagaagaggaggttggacacctgttgacaaacaacatagaagtatataatgtaaactttttagaaaagattttcagcaagaaagtttcattaaattgattgaatgtgaaagatattgatgccttaaaattagagtatttatgacaataaagtatttaggtaaagtgaggtgcaaagataaattgggtggagaggaagagcaggttggtttagctagaaaggccgtgttagcagtaatgaaatatagatgaacataattggttactgtgaacttgtttagtgacaacaaagctgactttcaactttggcagttgtatcagttaactattgttttataagaaattatcccaaaatttagtggcttatggcagtgattatatttagcctgtttttctggttcaggatttggggatggcttagttgagtggtccaaccttgggatctctcatgaggtttcagccagtggtcagcttgagaagtgtcatctggaatctttctattacgagaagatccacttctttcattctgtgaatgaaaaaagtgtttcattcacaggaccagcaatttagtgctggctatgggctggaggccttagtgactttctatgtgggcatctctacagggctgtgtaagtgtctttaagcatggtagctggtttgtgagcaatcaagagaggtaggtagaagctgaaatgccttcatgatctcatttcagaaggcacacactgtcacttgcaccatataatattcacacaaggtgacctctaatttaatgaagaaggggtctacacaaaggcagacatatcaggaagtgagggtgtttgggggttgtccttgaggttatcaaccaaattaggtattattattatcatcatcatcaccatcaccataatgatgaacattagaatatcttgtctttcataaaaaattatcccaactaaccagcttactaaaattaacacccctctgcttagaaagaaactgtaagttatagtaaaatatctcacttttaaaaagaacttttaatgagtttattttatttttatttaaaaagtttcatgacgaggatgatgatcaacatttttattatagaaaggctaatacttagtagcttacatcatttctaatctttataaaatttctttatatcatttccaatctttataacaattctgtgagataggttttattattttcattttatagtgagagcgtagttaaataacttgcccaaagtcacatggttagtaaatggtagcatatctgtccatctgattcaaatctcacattcttttagccatatcatgatgcctctcaggaaatattgtctgctctgggctgattttgctagatatcataaatgcctgtatagtgattgatacacctcttaaatgaagcacaaagtacaggagaaggagacactaatcaacatcaataattcaggtactttaaagtattgtttcccataatagttaaaatacatttaaaaataatgctcattttacaatattagaataagattgccaattttcttctaagtgaagctaaattgaaaaaaatcatgagacaagttattagtgaatatttagctggtcataagcaagtgctttctttacgacttttctaatattacattttttgtatcaatttgtaatttcgaacttttataaaagcaaaagtgacactcataataggccttattattgagatgtagctaaaggtaaaaagataatgaccaaatccactaggagggattgtgtactcgaggaatagcaaccacataatacccctctagtaatgaacattaattgttttaatcaagctctaatttgaaatcagaattttaaaaaactaatcacatttattgtagtggataatttaaagcttttgtttcattttaaacagattctcagtgacagataaatcattatttaggaagagacgaatatcattcctgacatggcaatatattaagtctaagtctggaaattcctggacaaacatatgccctaaaggaggtataagctaaaggtcattattacagagggctgttccacaatttaattagcttattttcatgtgaaaaaagtagtttggtatcctcacaatgcatacatcaattggagttacaaattggcttacgaaggaaataattaaatgacttcatcacacaaatcaaagcacatctttctaaaatataattatttataactgaaggaaggctctgtgaatatttaaccttccattcaccattcttcacatagacggtaccgtttgtagtgctaaaaatactccatctcttatacactattttccaatttgtgatatttttgcataggcatcacctcagattcagattaaaaatgctaattcattttctcctacatattttctgcatcatctctggaggtagtcttggtagtctgcattttggataattatgcattctgaagttcgagaatcactgtaacaattccaaggatcttttactctgatccaagagagagaagagataaaataaaatgcagccaataaaatctgaaactcacaggcaatttctagagagaatttgaattgacagtaacaattaattatattattaaggaacaaagtatttcatttaaatatttgatactttgtaatgatattaataaaatagtactgtaagtacacctgttttgcattcgtgcatgtcaagcctcatgatgggttctttacatatgcagtatctcagttcaccttgatgacaatcccttgaggttggtattcctatctgccccattttacagatgtaaaaagtgaagttagaaagattaaatcccttgtccagaaggtggtaaagaatgattaacactcagctctgtatgacttcaaatgctataaggattccatactaataactttagggaaaacggtttgctattaaaagaaaattgaagctgatttgaatagcacggtatggttgaacatcaaacagattgaaatggaatatctatattttatatggtatttatataaagtacaggtagcctgatattaaatacacattaaatataaataaatatattttaaattttaaaatattttaaaacttttatgttaaaatgcttacaataataaattatttccctcacttataacttctctctaccaaataaacaaaaacatcaacaactacacacatgcataaatgataattatatcctgttagatacttcatattctatagaaacgatgtcaactttaatgaatatatcgccaacataaagcttggtacaacatgtgctttgtgccctttgagataattacatatatcctttatatatttagacatttattgaacacccacaatttgttcacctaaaaaagtgtatttttttccttaaggaactcacagaatcatgggaaaacagatatgcataattaaatcagatatgtggtaattattataattgaggtaagcgcaacattatatgcaatctcaacaagagtaatggtgaacctaaattgagggactgtgacacattcatatattgcaccggactctgaagaaacagtgagattttagcacacagaagtagaaaatggggaaaggatggcacagaaagaaagtgttagaagaagtgaggactgtacagatgtcatagacacttttttttttttttttggtcttaaaggaaatctaaaatctccttgagcacaatctgtggtgtaccttgttatagcaggtgggacagtgttgggacaggggttgagcaagccaggcacaagaccagcagatcacagcatatacatgattaaacgaggtccagattgggccagccacattttctctgccttgagtagagggctgtgagtacagttaaactatctagtgatggatgacattgtaaagagactgcccttcagtgcattctagtacagagatctccaaagctgctttgattcctccaggactttacgcgcaggtcctcttctctgtgaggcctctcctccccatatcatttaaactgcacactctaacactcccttcccacttcctatgttccctatttctccttagcttttatcactgcccagcatgctatacatcatcctatttattttgctattatctattttatcctattagaatataagctccatgtttcacttccttgccgtaatttatccagtaactagaatagaactttgtacataatagtcacgtgagtcaaacaaaacaaaacaaaacgaacaaacaaacaaacaaacaaaaacaaccctgatatttttggttttctttcagtgtttctgtatcattctgatacatttttattttgtttaatgtgcccataagtttctgctgctttcaactgcaagcctcaactgaatggtgttttaaaatgtataaaatgccttccaatatattttctcttcaaccttgagaaacatatttactatttttattactttaaaaataaactgaacctcggggaaattcaatatttgcatattaacgtttcaagtttagatataaggcccaaattcatatttcctgctccttgcattttgtagtccgcctcatctagaaaatccccaatatcgagatttgactaagattccatttttaatgattattttactccaatacttattgattcatatttatatccaattgaaacatcttgtttacattcacttttatgtattcccacaggtttctcaccagacatggtgaacaataataatgtattcaaatcaaagagtcttgcttttgaatagatggaattgagtttctcttccatgttcttttcctcagactacataatgcctgtgattttcttcatcctttcttcttaagatctatttttcacttagtaaattatattggcagcatttcatattaaatatttctctatattttttgaaaatgtaatatactaactggctatattaataaaattagattaacgcaatattaaaaataaggctaattttctaggcctgtgagtgtatttgacccttctctacaaaagcacaaattctcctacctttcgtttagcttataaaaaacactatgactgtccctctcatcattatctacaatggttgatgtgctcacacgtccttcaatgcatgtttcatactgctacttattctttcttattagatatatgtaaaagttaaatttggggattacttaatagtgcaaaatatattaactttatttcagttacaatattttacaaggtaaaaaaaaatcttcaaatttgtattaccaaataacatctattcacttcacatatatttttggagtgtcacatatgatgaaatgtcctgggaatcatcattgaataaaatacattttcttggaatttatgtctgtaacatggtactataataacattaagcaaagtacaattttccggggagtttttctatttttttgagaagtgaaatatattttcaataaaaatatcacttcctatgttcattacctaaagaataacccatattcagtcagttcaacattactcattgaaaccttgaattccttgcctccttaatatttcgtggcatctgccaatacgtatttccatttcaattctgtttagaaagataatcacagaaatctacttaaaagacagctacacatctatgcttccaattgcaccttgactctcattgctgctaacatctattatcccccaaaaagacattatttccaatatttcccactctcctgaagcatgcaacgtcattcctgtgccatttacttttggtacagtgattaggataaagccatttgatgtaaattgtttcaaaatgctttctatcaagttttattacgtctctttacccatcttctcttttccttttttttttctaagaaaatgaagcattagtcactacaaggtttatgtgctagctcttaacctcacccttttcaatttcttcagcattctctgccttctatcaataaatacagtaaagatcagagaaaatacatattttccttcttgtcatgcaaataacctagaagaatatttaaaaataaatataggatgtttaagatttattaaaacaaattggccattgctttttccagtaaaacatgctaaaacagaaactagcctgttctcagaacaaggctcttagctgatggagtattcttcataattaccatcaccaatgggttgtactgaatgagtgtgtctatgtgtgcataacacaacatggagacagggaatggcatccctaaagatctggaggcctagggtccacagtatgttttagaacttcaagaaggtaaagaaaacaaaaattctagggaatgtctgccatggagaagctctgcctagaatggtccctcagttcatggcccattggccagccataaaccatggctggtatgtatgtattaataaaatacttctttacttatgtttttgtaatataattatttcaaaattcctcaagactttttaaagaataaaattcttcctcaaattctttctcaattgacacatttagaattaactgattcttttagcacaatataactgcatcttacaatcgtctattaaaatatttgttttaacctcttatgctttacaaaaactgctccctgaaaatatacttcacatctaaagcaagttcttgataagtgtttcctgaatgaaagaacagtgtatgcaaatatttgaaatatattgttgttaaaacatgtgattccttatatattaaatatttaacattaaacaaaattgtgttaaaacaaataatgtagtcagacagtgataaattataatgctcgaaatacagttaatgtataatattttatttatgatgccatatatcatttaggatttcaaagatggcttcattttcagcatctgtgtaacatcaaccaactacacctatggcttcttatagtcctattataacctcagagctggatcatcttaaaaagagcagaataataatgtgccaaagaagacagaagtacaggataaagtatgctacagttatacatcatctaatgactggcttgtgttctgagaagtgcgtaattaggtgattttgtcatgtaaacatcatgacacaatacataaatctagatggcgagcctactacgcatctagcctatatggcatagcttactgctcctaggccacaaacctgtacagcatgctactgtagtgattactgtaggcattgtaatatggtagtaattgtatatctaaatatatataaggcctatctaaaacatatggtaaatatatagcataaaagaataaaaagcattatatataatatatatatttattatatacaataaatttattatatttacatattttataattataaatataatataattatattatataattatatattaattatatttatatataatatattatatattaattatatttatatataatatattatatattaattatatttatatataatatattatatattaattatatttatatataatatattaattatatttatatataatatattaattatatttatatataatatattatataattatataatatataaatataatatatataatatataaaagaataaaaagcataaatatatagcataaaataataaaaaagaataaatatagggcacttaccataaatggagcttgcaggactgcaaattgctctgggtgaattggtgagtgagtggttggtgaatgtgaaggcctaggacattactgtacactactgcaggcatagtaaacgatgtacacttgggctacactaaatttacaaaacatatttttcttccttcaatgataaattagccttagcttactgtaactgttttactttataaactttaggttatttttttcactttttgactcttctgtaataacacttagcttaaaacataaacacattgtatagctggacaaaaatattttctttctttatatccgtattctataagcttcttttctatttgatttttgtttttactttttaaacttttaaattaaaaataagacacagacatgcacattagcccaggcccacagaggctcatgatcatcaccaccattgtcgtccacctccacattttgtcttacaagaaggtcttcaggaacaataacacccacagagctgtcaccacctatgataatagtgccttcttctggaattcttcctgaagtacctgcctgagactatttcacagttaagttttttttaataagtagaagtacactccaaaatatcaattaaaatattgtatagtaaatgtataatccagtaacatagaagtttattatcattatcaagttattatgtactgtacataattgtatgtgctatacttttatatgacttgcagcatagtaggtttgtttacactagcatcaccaccagcatgatgcattgtgctatgacgttatgatgtgtatgatgttatgatgactatgatattatgatggctatgatgtcactttgtgatagaaatttttcagttgcattgtaatcttataggaccaccattatatatgcactttgtcattgaccacaatgtcattaagtggttgtatgactgtatatacaaacattacactgtagttcagaactgttgcttttgcattaattttattttgtagaaaacaaccaataaatacaatgttttctatgaatcatgtgtcttttcttcaccaaaataattacaatcaagaatatttacgatacaataattaggttatgtccattgcttcctagtgtcattgtccagttttctatttaaagttgctgaggtttgctttttgatataacttaaaatatcagtttgtgatattcttttaacatgccagtaatagcattgactctttttgactcccagtgatacaaatttctttaaatctttacatgttgtatgcagcacttagcatacaaagtcagctattctcttttaatttgtagatacagtaaattatattttaaaattagctaaattcagaaattggtaattttaatatacatatttatgactataaaactaagatggtaataaaagtcataacaaagattcaatatggtaaacttcaaaatgaattatataacacaatttaaaaatacacaagaaatgcatttataaagaaatacaagaacactttcaaaaggatacttagcattctgaaaatttatattatataagcacaaaataatgtatatattataaggatcttgacaagtcaatatattttactgagcttccctaattgatatataaaatacttaaagtagtgcctgtgctcacttaacattacatttctctaaatttaagataagccaataaaaagattatttgtaatcttgaaataaattatgctattatttaaaaagtaccttcatcattaaaacaacagttaatcttgagttccatctttactggaagtaaatacttttacaagattccatatatattccattgagcttttagaataaccttatgacctaaatattttttttattttccaatggtttaggaaagtaaaaatagagaaataatttcacttgcttatagtcacactctagcaaactgtagaacctgtttttgaataatgtatttaattccaatggtcattgatatggtttgcatctgcttccccatccaaatatcatcttgaattgtaatcctcacatgtagagggaaggacctgtaattcccatgtgtcgagggaggggagtgattggatcatggcggcagttcctcctatcctggtcttgtgatagtgagttctcatgagatctgatggttttataaatgcttgacagttcttccttcacactttctctctcttgcctgccacttgtaagacgtgccttcttccccttccaccatgattataagtttcctgaggcctctctacccatgtgaaactgtgagttaattaaacatcttttatttataaattacccagtcttgggtagtattctttataccagtgtgaaaatggactaatacattaatgttcttaactattatgaattttttagaataattcttgttatttgtaaagtattttgaaaatataaaaggaaaaagcaataaaaatggtagcaaagttaaatatgaactagaattaaaagtaaatttggaagtagaattatgtaattgaaattacccaatttataataatattgtctgtatgtacatttaaagtcaaagcacttctgtttatctgtctactctagagaacagaataatatgctattgtgactttttgatagttttccttggggtaactctaagatccttgagtgcagaggcctagtgtttttctcaacattgttgaagtctgacataatggtgcctcacaacaaggtgtgtcaaagttagcaaactaattttagtctaaaatttaaatatgaattcatttattcattcaaaaagcatagaaactttctatatgacaggcattatgctaggtgtcaataaaaatgtgaccagttaagtgaaataaattatatgctctctaggaattcccaatctagtggtgcagagagacaagcaaaaaactaagggtagtataataatgcaatacacatatctttattatggtaaggaagtataagaacaggagaatttatcttgaattaggtttcagggataatagtccaggatggggttgaatgggaatataagcttccagaaagtatttataaaataaagctaatacacacatttaggagtcaggagtatctaactttaagtaacttcaggggtaatattcaaggaggggtgataaggaaaacaacttccaaaatgtacttacaaagtaaaccaagcacacacactcaaaataatgataattctgtgtaagtgaatgtgtccagccccaccctactcccaatctcctcattctctgctaaagccatttcatctacttccatggcttcctctacccagtaaccagatgtctcccacattaacatctactactcaggcagacctctttcctgagagccaaacctgtgtttccagctgtctaatcaatctgttcaaaactgaacttaatatattgttttccaaacggctccttctccatattcatctctccttcactagaaatattaaagataaacctgacctttcctcttttgcctcttataatattcagcaactttataaattcttttgaattatatttattatacctattaaatatgttttactttctcttttattagctcacatccttgccaactctagtgtgatctatggaccataccataccactgaaaccactgtttcagtagctgctttattgggctctttctaaccacctggactgtactcagtgtattaaatactttatatcaagaacttgccaagtcatttacatacttccaatttctttcccctccagatgatacctgaaacatagagttattttagctaggtacaagtgaaatacacttgtatgcctaaacctgagaatcataaaagcatttatgtgattttaaggaggttgcactaaatcagaataccagcaatgactatatgacactaagtaaaacattcttcttcttaatttgtaataaaattcatcacctatttactaatcatggttttgtattaggcaatctgcttgatgtctgtgaattaacaatgagaataaggatgcagcacctgccctcatataatatacagcctagctaacttgtattaggtagagacttctgcaaatggaagagttataacttcctatctggagccccaaaggctactcattgatttctatggttgctatcactgatatacagaacattcttaaaaaaacaaaggtgtgtatttatgacagatgttttccttgagttgccctttatatctttcagtgcaatttcaggatataagtttattggaaatttgattataataaatatgtatttgcaactaggaaaatactatcagtaacgactacatgagggggtgtagttaaataaaagccttaaatttaaaaatccagtgaggcaatgttttcaagttatggagacaaatttctgtaaatgtctgccctaataggtaaacagtattggaaattacatagtttagaatacttttgttgctgcatgtaataattaacagtttaggcagcagaatataatggaaagagcatggatttttgtgttttatagctctggattcagaaaaactatattactccctctttgcgttattaaatgctgatttgggtacctttatggaccttcattttttcatctctaagtgggaaatcatgacaactcatctgcattttttttaaaagctactgaattgttccctctgttctcgtccaaatcccaaccaaggaaatatccagtattctaacagcaaatccaagctttttttcactcctcactgaaaattcttaaacccaaatccaaggtcttagggattacagttaaagctatctttgtattttggaggttgcatactttatttttagccatttcctgtctctaggttatgttccagttattttaaacatctcttgtattatctctgccattcataagcatgaatgcatataattgggtgacagagcaaaatactgattctctctcttggctgggaaactctgcctatattactgggtaatcttgcagctaagaggtattttgtatcatctgtatattgttactttgtcttcattaattttatttgaacacataacacatgccaagcattctgagaggtatttccagatggatttaaaatttatctaccataagaagttatatggtcctccaaataatagaaaaataatggcagactcttaggtagcaacaaaatgacagaatgtagaaaatcttgttctttgatgaaaagccagaattacctcaacctcatttgattacagagatatgatgctatccatatactaattaccattagtatcttttttctttttcttttttattttctttccaattttatttatctatttatttatttttgaaacagggtgatagggtttggctgtgtccccacccaaatctcaccttgaattttaactctctcaatttccatgtgttgtgggaggaacccggtgggaggtgattgaattatgggggtgggtctttcctgtgctgttctcatgatagtgaatgagtctcacgagatctgatggttttaaaaatgggagtttccctgcccaagctctctctctttgcctgccaccatctatttaagatgtcatttgctcttccttgcctccgccatgactgtaaggcctcctcagccatgtggagctgttaagtcctttaaacatctttttcttcccagtcttgggtatgtctttatcagcagtgtgaaaacggactaatacagtaaattggtaccaggagtggggtattgctgaaaagataattgaaaatgtggaggcaactttggaactggataactggcagaggttggaacagtttggagggctcagaagaagacaggaaaatgtgggacaatttggaacttcctagagacttattgaatgactttgaccaaaatgctgataatgatatggacaataaaatccaggctgaggtggtctcagatggagatgaggatctctttgggaactggagcaaaggtgacccttgttatgttttagcaaagagactggtggcattttgcccttgccctaaagatttgtggaactttgaacttgagagagatgatttaggatatctggcagaagaaatttcaaagcagcaaaacattcaagaggtgacttgggtgttgttaaaggcacttagttttaaaagggaaacagagcacaaaagttttgaaaatgtgcagcctgacaatgctatagaaaagaaaaacccattttctgaggagaaattcaagccggctgcaggaatttgcataagtaacaagaagctgaatgttaatccccaagacaatagtgaaaatgtctccagggcatgtcagagacctttgtggcagcccctctcatcgcaggcccagaggtagaggaggaaaaagtgttttcatgggccgggcccagggtccttctgctatgtacagtctagggacttggtgccctacgtcccagctacaccagctgtgattaaaaggggccaaagttcagctcaggttgttgcttcagagggtggaagcctgaagccttggcagcttccacatgctgttgagcctgtgggtgcacagaagtcaagaattgaggtttgggaccttctgcctagatttcacaggatgtatggaaatgcctggatgcccaggcagaagttttctgcaggggtggggtcctcatggagaacctctgctatggcagtgcagaaaaaaatgtggggtcaatctctactggggaaccaccattgcttgcctccagaccccagaatggtagatccactgacaccttgcactgtacacctggaaaagccacaggcactcaacactggcccatgaaagcagccaggaaggaggctgtacctgtaaagccataggggtggaattgcccatgaccatgggaacccacctcttgtatcagcatgaatggatgtgagacatgaagtcaaaggagatcattttggagctttaagatttgactgccctgctggatttcagacttgcatggggcctgtagtccttttgttttggccaatttctcctgtttggaatggctgtattaacccaatgcctgtgcccccatggtatttaggaagtatgcaacttgctgttgattttacaggctcataggcagaagaaacttgccttgtctcaggtaagactttggactgtggacttttgagttaatgctgaaatgagttaagattttgggggactgttgggaaggcatgattggttttaaaatgtgagaacaagacatttgggatgggtctgggatggaaaaatatggtttgattctgtccccatccaaatctcatctttaattgtaactcccacacttcctacatgttgtggaaggaacccagtggggtgtggttgaattatggtggtgggtctttcctttattattctcatgatagtgaatgagtctcatgagatctgacggttttaaaaagaagagcacaagctctctctttgcctactgccatccacttaagacatgacttgctcctctttgccttccaccgtgattgtgaggcctcctcagtcacagggaactgtaagtctactaaacctctttttcttcccagtcttgggtatatctttatcagcagcatgaaaacgaactaatacacagggtatcactctgtcacccaggttggaattcactggtgcgatcttggctcactgcaacctctgcatcccaggctcaagtgatcctccgacctcagtctcccaagtagctttgaccacaggtgtgtaccaccatgcccagctaatttttttgtatttttgatagagacggggtttctctgtgttgcctaagctggtcttgaactcctgagctcaggagttccacttgccttggccttgcaaagtgctgagaacacaggcatgagccaccatgcccagctaagtatctttttgaataaaatttcttcatgcaattgagattttcagtttacatatcagtctcctatttcaggtgctaatcctatctgccaagtatgagactatatacaataaaaatttaaagttctcttggtaaaataagaaaaaccccaattaataaaaatggtaaagaggtattaaaaatcctcaaaaaggctttggctagctaccatagaaatattaaaaaacaataaaattaaaaaatttccttggtcactcatgtatctgttacatatttttaataatcttactttgtgtggtacacaagcaaatttacatttatacatctttagatactatccctattaataaatagttacgtctcactaactgcctatatagttaaaagaaaaataattagttgcttactgtgttaaattttaataggtaaatcatttatttttgaaatatattttccaccttacacacataatattggtctccatgtatgaggaacacagcttaataaaatggtcttggggattataacgaagcataaaatttgttttggtagcagtatgaacaaataaagaggattttttacaaaaggcatttaatacagtgtgcaggaatgggtgaaggcttcacagaggaggtagcatgtgagataagtctttaagaaaaattttccagtgggcactttgagtgaagaggcaaagacaatcacacagaagagcatgcaaacaacttttttaggaaagaaagtagagtgtgtcccatatcaggaaggtcttttttatgccaagctgggaagataatttctgtcatttaaggcagtgatcccaactggtggtacctgtccatggcctgttaggaactaggctgcagaacagaaggtgagcagtgggcaagtgagcaaagcttcatctgtatttacagctgctccccattactcacattaccgcctgagctctgcctcctgtcagatcagtggtggcattagatgctcataggagtgtgaaccctatcgtgaactgtgcttgtgagggatctatgttgcacctgccttacagaaatctcatgcctgatgatctaagatggaacatcttagatcccttccctgaaaccatcccttcccgtccccctctcaagttcatggaaaaattgtcttccagaaaaccagtgtctggtgccagaatggttggagaagagaagtattttaagcacggaagcaggaggttactatgtttccaaacctatagtaaagtttctttctcttgttttcagtaggtatgaagagttagccacttctatacatagttctgacagataatgttattaatgctaggattcaatggctaaacaaataaataaatatatcttaaacagaaataattcttctatgggcccaggagataaaatgccttctatcagaaattattcctttggtttgaagaaatgggttgcgaacttcgttttgttttgtatgtgatagtaacacactgttgttatttatgaaagtttccacagagaactcataaataaaaaatgtaaatgtagaatagagaaacttggtgagcctcaaaagaatgtttcgtagcctggtggggtggctcactcctgtaatcccagcactttgggaggccagtgttggaggattgcttgagcccaggagttcaagaccctggaaaatatagtgagacttccatctatacagaacattaaaaaagtaactgggtgtggtggtgtgtgcctatagtcccagctacttgtggggctaaggtgggaggatcgcttgagcctgggaggctgaggctgcagtgagcttttattgggccactgcactccagcctgggcaacagagcgagatgctgtctaaaaataaaaataaaataaaataaaaatattttccctgctgttgctagcaactactgacaaactcccatgaaagtttaggactgtgcagatatggtttgaaaacagctgagtgaaggtatttaatttcgaggaaatgaggggagccatggtggtggccaggatatctgggaggaggaacacattaagtcatgattaaccactcagtagggttagtagagcaaatagatggtgttatttacaaagataaagctatgaaagaacaaatgtagaatcatgttgagacatcatttttatggacataaaggtaacaaaattcactgtgtttatatatatatatatatactttaaacaaacatatatatatatgtttgttttaaagtaggttttccatttgtatatatttgagtcctacaaattgacacttctaatgcataagaatactgcaaatattattttcctctagtagctcttaattttaacttttgtcaattaaagggcattttagaaactacattctagaacttgacttttgatgagaagtcattcattagacatacagtgcaaattgagtgctggcatcatccagggtccaggcacctctgagtagaaaactgcaggcacaagtatattcacagtaatataaaactgatgattcacacataagggaattagcttaaattgagtgttacatattctattaaaaaaggcatatgtgtttgcacagaagtatgaatgtgtttgtctaaattaaagatgcaatgaagagcaaggtcttgtactaagaatatccttcaacttcttatttgttgccttttcacctttgaactgcttaggtcaaatacattctaaatcttactcttaaaatgtgatagcataccatgtcagaaaaaaatgacaggatagtttggatgtttaacgagaatatggagctaaaacacagtattattcatgctaagctctcttaaatatatttgcatatgttaactcctgtgctagaattattttaaggaagtaagcattaaaatcccaactccttgatgcagaatcattttagaagtacatttgcaccatttcataatgacaaccatttttgaaaatttaatcattttctcaagatacagtttttgacaaatggtctgttactttacagcatctcatttgtttttatagcatttcaaccaaagaaaatatgctgcctcaatatgggttaatgtatataggtaagaaaatcatttaattctttataatcaatatataattctaataatcattcagtataattgtaataatcatttaattctttcttttggaaaaaaaaaagccaagagttgactattatataccttaatctttgtgctttaaaaatcttctttctctctttcttccaccaaaggcaaaaacaaatgacaatagcaacaaaaagataaacatcaaaacttaaacacatattgtctgttatagacctcaggatcaaatattttaggaaattaaaaatgtagaagaacagagtttatgtttggtaaaatttatatcttatcttaattcctacggtttttacaagaatatgttattatcgacaaaaagggggtagttaaaaatcgttgcagtgtgttttcaaagaaagtcacctgccaagaaaggtgtcagtaagatctttactgaaagaattgtaaaaagcctctgtcatgaccgagcatatggaatgaactgacccttaaactttaagagactgaagtagaatacctaatgtcaaatgctacccaaagagccagctgcaggatattgtaagaggtgttcatatctcagtgtacagaggagaaaaaaaagtaataattctgtacagcagccccagggcacttgcattttgaatcactgccacaataagcagatcaccagtaggaagagaatatattttgtaaaaccacagacttgcactatcagtagacatcagtgtaaaacagaagaggcaacagaattaaaaatagaagtatagaaaggggagagagaaagagtaattatatctactgcctacagtttgcaaaggcaagagacttataattcagatgtgcatttatttagagatcccttcaaaaaattctgaccacctttattatattaattctctaggccgttatacttattttttccaagtatggtataattatacagccagaataattaaatgtcaggctgtctatatttccataatgtataatatacagggaaaagaatatcaagttcctttttcatgtaacgatgatatgactgaattacaaagtaaaccttaggaatgaaaggcacaatttgaagataaaaagaagatagaatctgatctagtttagacttagccattttctagactgatggctgatttattcacaggcaattgaaatacatttagtaggtaacagctttctaactcatatttatattataaatcattttgacttttcgataacacagaaaatcttccatcttaatgagtttctactctatttcaaattggaaagcatactaaacttggttcttaaacctcctgtattgtttattgtctttatgttatacacataagaaaattaaataatgggaattatgttaaactgtgtatatgaaatgcaaaatatttttctaagccaagaggacttagtttgcaaagttcataaaatgtgttttaatcttactctttctgcgacgcacaaggaaagtaactctacaatgtttaccatattataaccataaataacaatatcaggagacacaacacatctcataaaccttcaaggatgacactgtagcagatttaaaaattcctgtggaaaattgtgttcactatttttttttttaattcacagagactcctaatgccatcctatacccacagtttaaagtagattaaactgacatgcacattattcattccatacattttcttcaatacttccaacctttttaagtctttcttcctttatatagcactttgttaaaagtttgacaatacattaacttactaagtagtgaagccatttaaagcacacttacttgaaaagtgtaaaaccgggtcccattaggaggatgcactttaggggagccagaaacggtgttcatatccgagaaaatcatttctgatcactgagacaatataatccacaaggagctacagatgcagagcagagagcttagcgtacagataaatccgtgcatgcattgagggagactagagggtaaaatgaaatctgccccatccttcttacatacacagtgatagcattttgaattgttcttctacatttgaaatcttagctgaaagatcatcagccaccgaccttttgtgaagctagttctctagaacatacaatgttttttaaaaaattaaaaacacagaaggaaaaaagcaagaaccaacgataaatggagcttgtgcagaatctggcagtgctgtggacctgcccatctgttctcagtgataatcacctccctccaccacagtctagcagagtgattatgctaaatatcctggttaaccaataacatacagtttcatttcagggaagcatgcacagtgtattcagaggacctcttctgactaacctgaagcatgtttcatatactgtttaaagctctacttagtaacaaattgctgttttatcactcttatttctgtatctttctaaatcttttagtcactcccagacttttcaacaagatgtgattttttttttacaaagcctttttttttttaaagggagttcttttataatttatagatcaaagtatattacagctgttacagctggcccggatattgagaggcaattgcatacaattcagtaagactgtatatactaggagtactatcaaataaaatgtaccaaatattttccacttttctgaactgctatagaatgtcatgaatacgaatgaaattattattatctcatttccccatcttagctaaaaaatcattatgtttgacaatcagtgcttcaaaaagtaccacatatttgttttaaataatcacaaccttatttcatatacatatatacacacaagaattaataaaaatatttaatacacatgaagattttcaactcaaaaatccaaaaatattgaatgcaaacatgtaggttttgttgcaaaatatgttctttttgtatatctttaacaaattcttcaatttgtacaaaagatcatattcagatgacttgacaacttttagaggtaaaaataaatgttccatttacacatcgttcaaatgtggagacttcagtaggataggaaacagaataagccaaaagtggtgtctttgtgaatgtatctaagatgacatagtcatacataataaaaaccacctactttaaacctgaaggctgtaaaggatgatgatttacacatacaacctaaattattattcattagtatttctgattctccaattatgcatgaagtttataacatcaatggaaaggatgcagaaaagtgatcctcaattctttagatgggactcctacattctgataaattaagtgtgtaggtaattatttaactagcaaactgctaaataaaccagaaaattattttaataaaatcttaatttgggaataatttctgatttatagaaaatctgcaaagaaagtacagagaattcctgtatgtccttcattcagtttttctaactgttatcttacattaactatgggacacttgtcaaaactaagaaactgatgttagtgtattattattaactaaactcaatactttacttggattttactagtattgacattaatgtgctctttgtattttaggttcaaattcaggataccatatttacttagttgtcatgtctctccagtttcttttggtgtgtgacagcttttctttgtttctcatgaccttgatggtctggagaggaactggccaaatgtaccatagaatatcccctaatcccatgaaatcatacatgtttgcctgttttcatcctgattacactgggctatgaatggataagcataccacaaaggtgaagtgtcctcaatcacatcatattagtggtacatgacatccagataacattattaatgatgtcaacctttgtcatttgacaaacaaagtttttgcctggtttctctactataaagttactattttccctttcccatactctattatttggaaagtagtacaccctcaacagggttggtaagaaatggcggaaattaagcttggccccttggaagacagagtacctacatatattaaatagatttcttctgtaatggctggcctcttttccttcaattatttactttttcagttatttacttacaacagtatagactcatgtatacttactttacactctggtttgaaatttaatattacataatttaatatgtttttcatattgtcccagctttaatcattggtagctcctttatttcaggttgtctcctgtgtcccttgacatgctcccatccttttgtttttagagcactcaatgattatttttttaaaatggttttctcttgcataaatcgcttatgatttgctgaaactatttatttccttaactataactctaattattattgtgagtaaacttgaaaatttatgttttattttccagtaatttttaagcagctatattattcaattttttcaaattaatatttttcccttctgatatcttagtccacatgggatttattcaaatgataatcaaattttttaaatgactaaatagatttactagctgtggaaataagttatatatgtgaaatattctagatacgtgttaggatcttacttcctcttatggttagcgaggccatgtaactcatgttccccacagagttgtgagtagaaataatccctcaaacagaaacctcaaggtttaagagcgaagttttaagaaaaaagaatgtttgtcaaatagatttttaccatgcaaatataaactccatgtacttttatgtttgcctgtaaactgggtctaacacaattgagatcagaaaattcaccagatcccttgttattgtagaggaactcataaatcaaatgtttttggtaaaatatcacatattcttaatataatctcatgtatttgctgcatttgcatcagccagaaaactattttattttagctgggaattatgaatctttccagccaataagaatacactttctttttcatatttctttggtgggggaggagatgaaaatagtatagattaatgttaaaagaggcaggagggagaaatagtactactaatatataattattttaagtacaatgctttattctaaatgttactgaaattgccaaagtatacaatttttccagaacattttttcctatgattattttgataataatgttatctcgtaattctgaatgtctatttggaaacaactcaattttctcttctgcctggtagcaataggaaaggtgttgtccaggtctaaaaattgccaagatttagaattattcattgtccattgtggttgaggccaaagcttatatatcaaggtacggtcccatcattctcattctgaaaagccatgagagttggagttgctggaggatggaaaagtttctgtctcactaaaaaacacatccctttaactcatgttaactgcctaaaggaaataataagtattaaatttagtcagggacatttgacactttttttttttctgtagggaagccccattcagtcaggcccaagaagtcctaatgggcaggaactgaacagtcttggagcaggctcagagttgtgctaagttccatgcccaacatttcatctagtactgtactttccaaacctggtttgtttgtacccttaggtacatacagtttgaaaaactatgaagcctctctttgtcaaaatttaaatattttaagagatttaaattacagtacctcataggtattgacagatgatactcatttaaatgaatcaaatggaataaagatgatctagcaatttaatgcccatcttctattaaaaacctcaagagctcttaaaaattgaaattttataccatcccttttattccttcaacttttttccttttctcctgcacataattttattttactatattgtactatctttctatattgtgtgccttaaagtattttatcagtaatattatattttgttgctgcaaaaatatataatatacacttaaaatatttttctttttaaattttaaatgactatatggttgtaagtgttaaaacttgtctcttgaaatgagcagcattcacaaatattattaccacacaatgtaccagaacagaataaatatattaaaatgctgataaacagagaaaatacaatattatgtctggataacacaaaaaatgtatgtttgtataatacaactgcagttttatcttttttaaactagcttatgtttcaattcaaacatcctattagaattagacagagtcctaattttcagttttgtagatttattgttgagaaactctgttcccagaagtaagtagatggaaaagaaaaaaggttgtgttgttgttatggtttttatcagcaatattactcaaattttctgatttcttctgcatatatactagaataaagatatattttataataatcattaaataccttgattaaatcaacctccgattttgttgaaagctaacaaccagaaaacatctggctttcaaaaaggatttcttatgtagctattaaagtcattcactttcctaacacctaaatctataatttgagtggtttcttattttggtccttgaagttttgagaccctggagtaatgcgacacagttaagattcatgagaaacatacactctgaaagagaagattgatttaaatgcagacagaactccttaattgcggcactgttctcagaataataaattttagaaaagggtacatatagaagaagaaaatgaatcccttgcaaatatccatgtccttgtatttcttggacagtcttcataccttaattttaaataactatcaaacatctatccctgcaatcaaatacgtttccggtggttgataaatgttgactcaatgaatgtgctgcttacacaatatggctaagtaattgctttaaacatcatttctaatcaatataatcaaaaattaaaaatcagcctggtcatagtcttattagaaattcaaaacttcagcatatgctcagaatgtagaggaaaaaattcagtgaccacgctgagttcattgttccttaataagcctcaatctcctcacttatgaaatggggagaatattgcctcactcaaagtcttctgtaacatttaaataaaattaagatagtaagaccctaatttgtctccattctctgcaatgtcttgcattaattgcaatgtctcattaattgcatatagtagataatttatagtgtaactggcacatatttgaggggaaaagaagaacgatcaatcattatttcagacaatagacacgaagactgttcttggtaaaccagaacttggtcttgtgtttaccatggcctttgtactcatggtaaacacaaaagtatgtttacatttgaggagcttttattatattggaggaaaaaaaaacagatacactttttgaaaaattactttaagagcattatatatatcaaatccattctaaagaatataaacaaatgtggacattaatttaggcttattaattagggtgacttcatgggctacattacctgaaaatctagaaaggaagaaagaactaacattcagtacttgtgtgtcagacatggacacatggcatttaatttgagccatacactgtcatttggcctgggtaatatattgattttacatatgagaacattgatatttaagaaagtagaatacctttttcaaggacagaatcactattctgactaaaaaaaaaaaaaaaaaaaaagccctgtccattacacctgtcccttactgttttcctttctcttccacatttattcgtttatttatttattcaactatgcattaatcaaagactaattaccaaatgccttaaatttgcctggtattgtttccaggctttggggacaggattatcagatacaatatcagtgctttaggaactttaaattttgtgggagagataccagctaaggagaggtagttaagtagcaaaacaactgcaatgtagtttgacaaatgctaaccattgacttgatgtaatgtatactgagttcatctggaaatcactgatttccagtgggtgatttccagtgggtgaccatggcaaaagcaggaggttaaaggatttccaaaaagagaatcaatgtttgaaacaaaatgaaatggcatggaaatggttgggaaaatatggctgaaagcatttcaggacataagaggtaactgtgctaggtgtgtatttgtatttacaaacagttttttcaagtaaaattagtaaagacacttaatctggtcatcatccttttcctataaaatcaaataaaattagaacattcctgtttggaaaaaaaaaagatatgaaatgttgagtcacattttcacacttttggttagtatattttaacatctttctttagtttgccaaatagctttccaagattatttttggttgtgaagaaacttcattcttagtttgattgctttcaatttatcataaaactatttcaatcgaaaattatatatatatattacaatatcacacctcaaataaaatttaatgtgcttatgttatcaatcattggttttcaggcaatggctaccactttacgtgaagggtaaataacatacccattttaatcgctacagacagaccactaccaaaaatttcttaagatgtatcttttccaagagaggtaaattatgaagttgagcttcaggaaatttaatattagctatcacaaccacctcaatttttacagaaaggaattgaaaatgaaacagtaaaagtatgactaaactatacttaacttaaaacggagtaaattaaaaatcctgaagccagacatttgctcttaatagaattaagagaagaccccaagaaattatctaatacacccttgtgcccttaggaacaattactcctatgccatctgaaatgcatgttatcagcttggtgttaatcaatgttccaaaaatacttagagcctatgcttttatatcaggaaattcaactcacatatttttataatcctggaaaataattttgttttaagaaatagttgtgagatatattctgttttaagaccagcaatttgacatagcctttctttcattcatttgtgggtaaagctcaaaattttgctaaaatgataagaatttggggatttaaatacactgaaaaggctgcttattttatgttaatttttgataaatggtcaggggaaaatggtcatactgaaagaacaatggggtgaagaaggaagagaagaacatagtggtgaaagagagagacagatgaaagtaggtaaatgggaaagatgaaggtgagagagaaaagggagaggagagaggaggcgaggggaggaaacagatattacactttgcatggtagcattacacgataacaaagcattttccaagcaaacattcagttaaaattcatgccatatggaatgaaatttgcagcccagatggacaatacatcctagtaaatttatatggataacatatgaacgctagttaagtatgtaatatcactagcctgtctgtctatccatccatccatccagctatctatctatctatctatctatctatctatctatctatctaatctgtctataatttctctatctctatttaatctatcttcatatttatccacttctaacagtatccatacccttagctttatatcatgagttctacaatatgtagcaaaaatgaccctttacagatagccaaaatcctgagtttactctatgatttattttctcaacttttattcagattcagggggtacatgtgcagatttgttacataagtgtattgcacccaggtagtgagcataatagccaataagtagtttttcaacccacgctacactccatcccttcccaccatagtagtctacagtgtcaattgctcctatgttgacgtccctctgtactcaatgcttagcttccacttgtaagtgagaaaatgcagtatttggttttctgtttgtgtgctaattcacttaagattatggcctccagctccatctatgtttctgcaaaggacaagattaattatttttatatggctgcatagtattctacagtgtatatggagcacattttcgctatccagtccaccattgatgggcacccaggttgattccatgtctttgccattgtgaatagaatgacactgaacatatgagtccatgtaactttttggtataatgattgattttcctttgagtatatacccagtaatgggatggctaggttgaattgtagctctgttttaagttatttgaaatatctccaaactgctttttacagtggctgaactcatttacattcccaccaatagtgtataagtgttctctttatccacagcatcaccagcatctattgtttcctggctttgtagtaatagcgattttgcctggtgtgagatagtatctcattgtggttttcatttgcaattctctgatgcttagtgatgttcagtattttttatgtttgctggccacttgaatgtcttcctttgaaaagtatctgttcatttcctttgcccatttttaatgaggttatttgttttttgcttgttgatttaagttccttaaagattctgtatattagacctctgtcagacacatagttcacaaatatttcctcccattctgtaggtcatctgtttactttgttgatagtttatttcactgtgcagaagctctttagtttaattaggtaccatttgtccatttttgcttttgttgtagttgcttttggggacttggcaaaaaaatatttgccaatgccgatgttgagaatggtatttcttcagttttattttaggatttctatagtttgatgtcttacatttaaacctttaatccatctctagttaatttttatataaggtgggaggtaggggcccagtttcaatcttctacatgtggctagcccgttatcccagcaccattaattgaatagggagtcacctcctcatggcttgctattgtcagcctcatcgaagatctgatggttgtaggtggtatctttatttctgagttttctattctgttctattggtttatgtgtccctgtaccaataccatgctgttttggttactggaggcttatagtttgaagtagagcagtgtgatgcctccaactttgttcttttgcttaggattgctttggctatttgggctcttttttggttccatatgaattttagaatagttttctctaattctgtgaagaatgacattgttagtttgatagaagtagttgaatctgtaaattgcttcaggtgtatggacattttaatgatattggtcctacaatccatgagaatggaatgttttttccatttatttgtgtcatctctgatttatttcagcagttttgcagttcctcttgtacagaactttcaactctgtggttagctgaattcctacatatttcattttctttgtggctactgtaaatggaattgtgttctgaattgacttttagcctaaacattattgatgtatagaattgctactgattttttaacattgattttgtatcctgaaactgtgttaaagtcacttatcatttctagtagccttttggcagagtctttagagttttctaagtacagaaccatatcatcagtgaagagagatattttgactttttttcatatttggatgccttttatttctttctcttatttgaatgctctggctaagacttctcgtattatgtcaaataggcgtggtgagaatggacatctttgtctggttccatttctcaagggggacggttctagtttttgctcattcagtatgatgttggttgtgtgtttgttaaagatggctcttcttattttgaggtatattcctttgatgcctagtctgttgggggtttttatcatgaagagatgttgaattttatcacaagttttttctgtgtctattgagatgatcacattgtttttgcttttaattctgcttatgtgatgaatcacatttactcatttacatattttgaaccaaccttgcatcccaggaatcaagcccacttgattgtggtgaattagttttttgatgtgctgttgaattctgttttatagtattctgttgaggatttttgcaactatgatcataagggatactggcctgtagttttatttctttgttgtgtctctgtcagattttggtattaggctgattctggcttcatagaatgagttagggaggagtccctccacttcaattttttggaatagtttcagtaggattggtaccagttcttctttatagatctggtaaaattcagctgtgaatccatctggtccagggcttttttgattggtaggtttcttattactgattgaacttcagaacttgttatgggtcttttcagggtttcaatctctgcctgattcaatcttgggaaattgtatgtttccaagcatttatctatttcttctagattttaaaatttgtgtgcatagagttgcttgtaatactctccgagaatcctttgtgtttctgtgggatcagttgtaatgtcatctttatcatttctgactgtacttatttggatcttctattttttttctttgctaatatagctagtagtatgtcaaccttgcttattttttcaaaaaacaagtcttggtttcatcaatttttaaaatatatttttgcatgtcaattttattgttctctaattttagttatttctttatgtctgctagttttggggttggtttcttctttttatttttcctaggtcctttcagtgcaaagttagagtgctaatttgaactctttctaactttttaatgaaggtatttagggctatagacttccctcttaacattgcttcagttgtatcctagagatttggataagttttatacctattttcattaatttcaaagaattttttttattttaatgttcacccagggattattcaggagtaaattgtttaattttcatgtatttgtatactatagattttttttgctatcaatttctatttttattgcactgtgatccaagaatgtagttggtatgattttaatttttttaatttattgagatttctgttatgagtaagcatgtcatcaatcttaaaatatgttctgtgtgcagatgagaataatgtatattctgtggttgttgggtggagtgttctatagatgtctactaggaccaattggtcaaatgttgagtttaagtccacagtttctttgttgttttgctgctttgacaatctaaggctgtcagtggggcgttgaagtctcccatcattactgtgtgattgtctaagtcttctcataggccaagaagaacttgttttattaaactgggtgctccaatgttgggtatgtatacatttagaatggttaagtctccttgttcaactgtactcattaatattatgcaatgcccttcattgtccttcttaatttttattggtgaaaagtctgtttcatctgatatagaaatagggacgctttctcttttttgttttccatttgcatggtagatctttccttattcttttactttgaacctgtgggtgttgttacatgtgaaatgggtccctggaagaaagcagaaggttgaatcttgtattttacacagtttgccactctgtgtcctttcagtggaacatttaccccatttacattcaaggttaatattgatatgtgtgatttttgatcctgtcattatgttgctagctggttgctatgtagatttgattttacagttgctttatagtacctgagggctatgcacttaaatgtgtttttgtggtagcaggttttgttcttttgattctaagtttagcactcctttatggatcccttgtaaaactagtctagttgaaaacaaatccctcaatatttgcttgtctgagaaggattttatttctccttcaattatgaagcttagtttggtgggatttaaaattcttggttgattttttaaggacactgataacagtctccctatctcttccggcaagtaggatttctgctaagaggtcttttgctagtctgataaagttacttttgtacctgacttgacctttatctctagctgcctttaagatttttttgttaaaaaaatctacatgccttggggacgatcaacttatctagctggggttatctgtatctcttagattttcatgtcaacctctctagtgagattaggagaattttcatggactacatttgcaaatatattttccaaattgtttattttctttctttctctgtcaggatgccaatgaatcatagatttattctctttacataatcccatatttcatagaggttttgttcatttttcccaattcctttttgacttagttgcttcaaaaactggtctttaagctctgagattctttcctcagcttggtctgttctgctgttaatacttcaaattatactatgaaattcttgtagtgagttttccagctttagaagttcagtttggttctttcttaaaatggctatttcatatttcaaatcttggatcattttactagattccctggattttttggatgggtttactttatcctgaatcttgatgagattcttgccgtccagattctgaattctatgtttgtcatttcagtcatttcagactggctaagaaccattgctgaggagctagtggacttgttagaaggggatactgtctttttgaattgtcaagagttccggaactgattctttctcatcagagagttttgatgttcctttaactgtagtataagttgagtatagtcagttgctttgtttctggatgctttcagagcaccagggctttgtgcaggatttttgttgtgggtgaattcttgggcttgttttcacaggtgtatatattaataggataattgttgatgctgtagtttggactgtgatcctgtagatggcacttaagagtaatggctggcagctaggctgatacctagtccctgactcttctacttcctagcattcgcggggaggaataaagatggctcgctcaccatgtctgctctcgggccttgtggggagccctctacagtcaccagcgctgtgcctcggtttcttttggtaggggttccaggccacgagcctctcttgggcaaaggttgtgacagggagatatgccgcaccgtttatgaaccagctcttcagagggaggcatactccactcctacctggggcccgggacccagcaactggcccctctcagtgttctgagctggggtttcctctcctgcaaggggggttcctcccctgcctgagtgctggccgcagcactgagctcttcactgcagccctggggaaccaggacatccgtggttcatggttgggttctagctgtgccagggtgtctgttgtgttcctgtgctgtctggaaagtactcatatacagcaacacattcagcagggccgtggaggctgtggggtgcacccactcctgcagggcagctaggcacaggccctgcgggggtcaggggacagcatgtggaagggtttgcagaacagatgtgccccggtcacatctgttgcaaagaaagttcagctctcttctggctcagaagtcagctggggccaatgcctctgggggagtggggaggcgggcccaagtgatgggcgtttatggctgcttttcactagagctgccagcacacaaaaactcctgggctccatgccgtctcaaggcctgtctctgcctattccctggagagatctcctgacatctcacatgtccataggggatgcagggtcccctgtcactaagttcccagaggtccatggggagactgaaccaaatctcatttccctcactcacccctctcccacgagccattagtggctgggaactggccctagtgatcaggtaccctaagtagggctgccagcttcctttctattcagcctcagtttcagagtcacatctccatccactatcagctttttctctcccaatatctgctcaaattatggtggctgacttaataatttggtctctcttggtgggagcagtgctttctggctgcatctagtcagccatcttgtcctcctgagtttactcatacatcctacttctgggccttctacttcctgggcttttacttccagacaatccacagctggctatgcataggatcgtagtgctcattctttcactcactcacttgtagtgctcattctttcactcactcacttgttcaacaaatcattattgaggagctatgatgtgccagataacagctacagttagagcagaaatgattctgcaggtgaactgggagacaaactctgcattttttggcacccaaatgagaaactccattcagcaagtgttgtcaattttagcagttagatattggattagaggatcccaagaaaaagaaaaaaaaacttcgaatacctcagtctttcttccaagatcaagaaatttattttagctaactcaccattcattgaggatgtcacacaaatgaagacattttttagactccactggggtaacaggatatacaggcaagtgaacaaaaaggcatgtcaaaattgaaatttaaaacttctgtttataataagacaaaattagtaaatctggttaaactcacattttgatgatgttttatttttacataatttcataaaatatgtatatgaatgtacatagatgtgtcatatatatgtgtgtatgtatatgtgtgaacattatctacataaatacacgtgcacaaacatacacacacacaaatttaaaatggtgttttctttccgtattttatttcttcttatttgttaactgtttttctctgtgcttaaaccaaatttttcacaaatttttacatgtattatcatggtgatagcccataatgacctttatgcttaaattataatgttaaatcatataaaatacaggattaagagttttgtttttgttggtcctttgacagacatgttagttgattagaagaactctaatattataacagaatcattttattatatgctgttaggtttatttcatgttttgaaatatatgtcatcaactagttttatagaaattacattaaagctctagagcggaatgttatttcttcacctatcactctggataccagatgcctacatagttccagagtttaaaataatacctggaggatttttaaaaccatgacttttataaacacaaaaagagttacctgagcaatttggggcccactctatgacatgagaaccacatacagattattagatgttgaacttcaacttgcacacgccctccatgctcatctatgtattatgtagtgcacttttgttgttaaatttcaaccactttttgttagcaactgttaaaattcttagacattcctgactcaataaaatatttcttctctggataaatttaaattatccactttatttactgttcagcgtccatgtaggttctatgatacactgtgcagtaatcattaaatcaagatacaaagaattctcagtctctcatacataatttggattttttaaatctacaagcataattcctagccacagtttaagagataataagtttccttagtgtgcaaaagttatggaatctatggaacttctagtgtatcactgctaaggactagaataatgcatagcatggagttggtattcaataactatttaggaaatgttaaagacatcttcctctggctgttttgcttctctgtgagtgtgagttgcattttaatattaattatctcattagacttgctgaatagtcttgagaattagaaaatacttattctaagattattacagttagtatgtggtacatctaacacttaaactttgggctgaatgcactacttggtacttaacaggctagattttggtgactgaatgaacaagcaaaaccatgaccaaatcaagatattctaaccaccaaactatattatttctatgaattcgtactgtctagtaggttagattgttttaaaaaaagatttttatggattgtttttaaatatagggacatgcccctttgcattcctacatacatccacttgcctaaatgcacacacagtatgctaatccccctgcacatattcacagagtattgggggaaatatgacattaatgaaaagaaatatgtggtctaaaaaacagaaagcagatgttttcgtgctcttcaatgtatgctttagcatacattttatttataacatctcagaagaaacagatgtaaatgataagatgagaagaaaagaagaatcaggataataaccaattacatgcaaggactttaggataatatttacatgggtagcatggaatcatagaacaaaattttaaaacccagtaatttatatgaatggacattacattcaaaatcccatgtttaagatgagaaagattattggttttacaggaacaagacaatattaggcaaaactgtggagtagactaacacaatgtttaggccaccttatttcttactcatcaagatctctactgccactcttaccttgctagcaaatacagtattttctcctaaattttactttttccaagaattttatttaaagacaaagccaatcactctcttgttttatttctactaagagcaataacaatgaccccatagttaccatttattgaatactgtatgccaaatatgaggttgccctttataaaatattctagtaaatcttctagaatagtaataataatgataataatgataaaccttctatttattcctcaattatgcataaggagtcttagataaattacgcaacttgtctaatatcacgtaactaataagttggaaagtcacatcctttgaaattagatctacctgattacaaagccacagtataaattaaaattacatcttggtactgctttgtgtgacacggattttaaatctgtgcagaatatgaaaaaataattgatttcatacataaaacaatttttaggtgactggctatctgattaagtctttaattttatgtaattgttcagatttttctgagggagcaaatggattgggaaagatagaaaggtattaaagacagctgcaagggctttggtctgagcagctgctcccgtttttggcctatgcaatgcaaggataaaataactgagatggggaaggctgcaggagtagtaggtttaggaaaaattcaagtgctcactcttgcacatgttgagtttgaggtttctattagtcatctaaatagagatgtcacatagccaggtggatatacaaatctggacaccacattagcatatagactgaaatttaaaagaccgaaatgaggtcatcaagaaagtgaatgcaaatagagaaatggtccaagctggaggccctagtggattccaacaattagagccctgggagaccagcaaagaaaaatctgtaggagcaattgctaacattggaggaagaccaaaagagcagtgtgaactaaattgctcacgttaatccagtaattaacctgaatatttctcagaggtcaactaagatgaggactgagaactgaccatcagattcaacaatgtaatctggctttattggagggttaagaaaaaaagcctgattgaactaaatttaaaaataaatgggaggagagaaattggaatccatattcttatgcaacacttttttagcacattgtttcaaagggaagcaaagaaatgggcagcccctggcaaagaaaggaggaataggaataagagcatgttgtgctgagggagaggctccaggagaggatgaaaaactgatgatgtaggatgaaaagtggataatcactagagccatgtccttgagtagatgagaagagaaagaatctacaagagaagagactggatttggtgaagaatggtactatctttaataacagatggaaaggcagagcatgtgggtttacatgctggtaattgtggtgatgggagtctgtgcacatttttggaaaatcaagaagccaggatatcagctgagagtattgttgggggagagaattttggatgtttaagaagtgaaggattcaattcaaggcttcagcatccttctctgtctatatcagtatattgtagaaataacatgattttctatctgtatcatgatgtgagcaagattgaaaaattgatctagtagaacgttatccacaaaatctgctaactaatatttccttttgagaggtcattttacctttttctccgtcaaattctatgattttatgctgatggtctcttctaattccaggccatgtgaccagttttatattattaggcaagtctaacaagtatattattaattaaaatgactaggtaagaaataaaggggttaaacatcacttagagagagaatgatcccagcaaaacttcatttttacatattgacactgaattattaagaacgtcatggatcacaaccacttaactggaaatgtaaacacctaaaatactatgatcaaatcacaattttgcagcttgctgattaggaggccatgtagatacagaattaaatttattacatcatggtaaattatgggcatacattaatttctttaatttgtctttctctacttgacattcaccacacatttacttaaaggaaagaaccataaatattaatatttcataataaattcagaaattcttattacaaatgctttcctttaatatcaaaagggcacacattcagtaacatgattacagtgctttagacagcattatacacactggcagtcacagtcatgcaaaattaatattaatttgattgaactgattaggtgcaaagagtcagatatttctctgaatgctgattgcattattattcactcaacaacccagtataacagtttaaagcatgggctctagtgtcaaagagattcaaattcaaattgccactcttctgctttctagatgaacaaaactttgagttagcttctctgagcctcagttttgttctctaaaaagtgggaattaaagtaggtttttaacttactagggcatttgcaaaaattaaaggaaataatgtatgtaaagcactttatgtcattgccaccctagtcactcaaaagaaaagaaaaaacttcatctttctaaatttatttttgcccagtagattgtgttgaatttgtccctttcttaattgtttttctcttgtccaaaattatcttttcacatttatccaagatccagctccagtgtcgcctctgtcatgtcatcccttcagtctagaggaatggttctttttattttcccaccactagtctgtagatcttttgtatcccttttaaggtctgcagtaggcaagttattcacatgttattgtgcctgccccttcaacttggagctcctagagaatttgaattgtgtttctcctgtttccacttgttttccacacagtagcctatgatacctgtaaacatgtagatcaggccactccatttgcctaatcccaatcctccaatagtttcctgtcacatttctgagaaaatccaaagtcttatccacagcctataagctgtacaatatatggccctggtcctctctctgtcctcactttatttcacactatctccttacacactatcctcaggcaacatgggtgtcgttgcagttcacaaagcataatgtcattgatacataaaagacctattaagtaccagctataagttgcacactattctaggcatttaggatacattagtgaacaaaatagacaaatattcttctgtgtagagtttccactgtagtggggagaagtgcagaaaaacatgtaaaaagtaaatgaaactgtatgtgacagtggggaaaggaaaatgagaagaagtagaggtggtgtggagggacaagaactagagcaaaggataaagggattcgtgagttgtgattttaaatcctccattaagtatgttttctcagggcatttgcagttgctgattttttttgccttgctttctctccagtccacccaatggttccctccaccagttaagtgtctgtgcaaacagaaacatctgtcaacacttctgagaggcccagtctaaacagtgtaaaaaggcatgcctccactcccacattacagctctctactttcttaatcagctttattttcttcattgcatttttactatgtgtaaatctgtgtgtgtgtgtgtgtgtgtgtgtgtgtattcgatgaggaaatatatttttttctgttttattaactgtttcattcctagtatgtaggaacagtttggcatagagttgtcaataaatatttattaaataaattaatgtaggtaatagttagctttagctaatgattattaaatttaaaaggtagagaaaactgaaatttactcattaatgtattatttctgaataattaaaagaactttcattttaaaacctgcttttgatacccatggcacttttttttttttttttttttgagatggagtgtcgctctgtcgcccaggctggagtgcagtggcgcgacctcggctcactgcaagctccgcctcccaggttcacgccattctcctgcctcagcctcccaagtggctgggactacaggcaccagccaccacgcccagctaatttttttttgtattttttagtagagaaagggtttcaccatgttagccacgatggtctccatctcctgacctcgtgatccacccgcctcggcctcccaaagtgctgggattacaggcgtgagccaccgcgcccggcccatggcacttctattcattcattaattcaacaattatttgttgagtgatattattcattcattaattcaacaattattagtcgagtacctataatagtctaggctttatattaagcattggaatacaattcaaaggacaaacagttattttttaaagtcattcttaattattaaaatgctctatctacattattataaaaataaaacacaaaaattgcttgtgaagatcaccacactgtctttgggttaaatcatcattcagtaacggccttagaaacttgattttttttgtcctatatgttacttactacattcttctctttggactacaagcgaagtaaaacatccgtctctggtaatgggttgggaacatgtgaattggcaaatgtgccttttattcttaggagctctggtcctgagtccaatgacactcaagtgattagtgaaatagatctataaagtgtggttaatcatacacgttagatatgtaacttttcaattcaagttgtcatacaacccagcaaaagcagtccacttaaatgccataagatgtaagtatcgttttttcttctctaaatttctacctggacatgacctgatttcaaaaatgtgcccattcaagagtgagtaggactagtttatatcttcacttggtatcaatttactgcaagatagtaaaaaaatctgttacttcctacttgggaatataaataaataatttttctggaacaataaatttaagtaagatcttcattatttttgcaaacaaaatgctaaatacatttttctggaacaataaatttaagtaagatcttcattatttttgcaaacaaaatgctaaatacatttttctggaaattttagagtttctcccagttagataaaatgcaaacacattggaaaatgtaagctttagctactcagctgttaaggtttaatattcctgatactcagctgcaaaggtttaatattcacgatactaaatattcacaatatttccttgtggtcacaaacaaaataaatctgaccatttaagaagaaaggcaggccaggcgcggtggctcacgcctgtaatcccagcactttgggaggccgaggcgggcggatcacgaggtcaggaggtcgagaccatcctggctaaggcagtgaaaccccgtctctactgaaaatacaaaaaaattatccgggcgtgatggcgggtgcctgtagtcccagctacttgggaggctgaggcaggagaacggcgtgaacctgggaggcggagcttgcagtgagccgagatcgcgccactgcactccagcctgggccacagagtgacactccttctcaaaaaaaaaaaaaaaaaaaaaaagaagaaaggcaattctagtagagataagttgactggataaataaaaaataatttaaaaaattaagactggcttattgaaaaacaataaaaacagatgtatcaaaagtaaaatatgctacagctaaatcataatttacagttttaaggaaaaaagtttattccaggaaaactccaaacaataatgattcacatcgttcaaaattttcctctggatccagaagggatgttataatggatgttttaatgcatctttttttttgtattttggtaattaaactataactaaaacccagaaccataaagatataaacaaatgtccaaagcttaaggtgagagacagccagaaaggcatattctggggccagagaatgcctaacgaaccgtatgaacttagatatctactactgattttaaactgatgatgtaatatcttgtgctgtcctaaaattagcagtgaaaatctgccttagtgacacattggggaagaaatgcaatgggatgcatttgtgcaaacattaaagaggctcagcagaggacagaatctggtaggagtggggctgagattatctaaggtaatcagaattgagcttgaagtatgaatctgaagtaaaaggtttcaggcaaatgtaaacattcctctgacatcttctaaaatattaaggtcactgagatacccatgtaaaatcaatacactgtttagacattaaagggaaaaataaaatgatgttccaaaagtcatggattcatttaccaaatattttactgagtttctaaagctatatgaattggtgtggaatgaaatgtgagcaaaacgggaaaaaaattgtcttcataaagtttatcttgcaatagaataaataaccaatttatatatcatggtagaagaaatcagggagaaaatcagagagaaggagtaggggagttgaaaaaatatcttataggtaattagggaacccctcaatgagaatttaacatttgaacagatatgaggtgagaaagggagtcatagagggctcaaagagcataacaggcagagaataagatgcaaatccaaaggtgctaggtaggcagtatagctagggtgtgactgaagaagaaagaggggtttatccaaactgagtaagtgagcaagggagtagtaggtggtgaaagcagagatataacaagaatccacattgtgttggttcttgcatggcattaattggacattgatttttattctaagtaagatcagcaagcaggctgaatgaaactttggaaggatctgagcagtgggatgccataactgaataaatgaccaagattttgaaaggatcattttagcttttggattgagaacagtggatgcagagggttagttagaggggaagaagctagttggccatgtagatgaaagctaattgtggtttatacagggtggcagtggtgaaggtaatgtgaggcatatctggactccaaaaatattttgaaggtagatttggatatgagggaaataggagtcaaagataactccaataattttcctaaagaaatgaaagaatcaggttgtcatcagctgagatggagaaaactacagaagtatcaggtttggagggaagatccagaactcaattgtcaacatgttgagtttgagatatcctttagacatatacatggagatgtcaagtgggtagctgtacatattacctaggatttcagtggagagtactggctatagatataaatttgggaatcctcagtatatagacttaagggagtaagtatagggaaagaaaagaagaggtccaatagctgagccctgtaacatcccaatatgaaagaccagaaaaataaggaagtagcaaaaaatcatattaaaaggaggggccagtaagcattagacaaggacttggtgtttcaccagtgaagcagccctcttttaggctcctgactgaagcacattcctccactatctggataatttggacagcaatccagatggaatgagaaagaaggtgatgtttcccaggccaacccaattgggtatatcaacttgggtgaccaatgaagtgacaaattaccacataataatgttcatattctgactttaagcataataataaacaacatgtgcttgcaatttgatacagggctcaatagcaataccccaaatcatttggagtgctggatgtcagtaataaggaaaatgatatagcttcctagagtaaaattttgacataagcctgtgcccagtaactttcaggtttttttcctcagcataagaatgaattttcaattaaatttatatgtagaagctcaagatataaggcatataacagtggaatgtgtttgtttgaggcagaggtaaaggaaaaaatcagaaaacagcctgctcagagttcccactggagctatccttgaagcatctggacatatccctagagcctgggtaaagcttatgaacatagctttaaaactaccaaaatcctaaaaagaaaagagttcagagatgaaaataactgatattggaagtactcagagaaggtttacatagtattcagggaaaacctgaacccaacagaatagaatgtgccctggctttcatttttatgttcctccttctgcccctacccctcagattaaatattggttgaaatacctctaaaactacacatatcatcatattggtgataaccagagtcctttagcaacaatttgaagtagattttgtttaaagaaaggtaggaaagttatagtccagaagaaaattaaactgatgtgagtaagaatatacacatacagcaaggtttacccattataggaaaacattaactgtatgataagggggaaaatgtgtttacatgtttttggttttgcttttcagaaagagaaacaagatagtgactattctcttccataactatcttggggaaagaagaagttgaaacaaaaagcaggcataataatgaatctacaatgatatctgatatgtatctattttaatcaaatggaagattagccttccagatagcattaaatagaagtgtgactaggaaaataatcttgtacggtccctcaagaggaatatgccagtttatttagagatgtgagcctttcaagaggcatccaaaatagtgaaaagagagatgctaaaaatgtataaaatcaattaaaaagagagaatacaaataagtgtcatgagaaatacaaactggtattaatagtgctcattaaaatgatgaatatcttaggcaattttcatgacctaaaatgatgtatcattggcctcatccatctactacctagaattgggacacatttgtataagactgaaagatgtatcactagtttacaaatataagcagttaagtgatctccccaaaatgttggggtaacttacatttagagtgtaggactgtcaccgcttccttttttcaaagcacatttgtaatatattcatgattgtatccttatagttgtgtgggtaaagttccttaaaccagacacttgaaagatgaacaaattattacgtgttagctaaggatattatgtttttgagttttgagtttattttgaatagtaaagtattagcactcaattttccacctaagatatagtgaaagtaagagcatgatactggggtcaaaaagggcaaattttacttagtattcttttatctcctataaacaaggcagctacattttgggtactacttaaatagctgcaaaaaaacaaacaccctacaacaaaaaataattttcattattttttgatcagaaaattatgccaacaatcctttatagtaaattacctgttatattattttgtactaaacgttttttgcaattaatctgtctttcccttgccagaagaaaagatcccatgtgaaatggtgaataggaaagcacaggtgcaatgcaaggaagaggtgttttgaaaagtgggtctttacatctataagcacttaatgtcaaaagatgctcttcttagagtagttggcatctatgtatatatatgtataaaaccttgtatatataatccagatgcttgctttatgttacttatatgtcaacttgtaaattgagaaaatatagagtagattcatacagttaatctctatatactccattccttaattattaacttcttaggttcaggaccagtccaatcctataatctgtatgttactctagcattaaccagtcccaggtcactataaaatatatatactgattttatatttcactataaaatatatatacttattatatacatatattatatgtataattatagtgacctgggcatatatatatatatcatacattaatgatactatatattattatatgtataatacatattacatatgtataacacatatataacaaaatatatattttatagtgacctggacaaatatatatatatcatatattaatgataatatataattatatatataatatatattatatatgtataacatatatataacaaaataatggttttgaagcaacttggatggagctggaagccattattctaagtgaagtaacacaagagtggaaaaccaaaaactgtaggttctcccttataagtgggagataagctttgagtatgcaaagccatacagtgatataatggacttcagagactcagaagggggagggtggagggtgaccagggataaaaaactacacattaggtacagtgtacactactcggggaacaggcacactaaaatcccagaattcaccactatgtaattcatccatgtaacaaaaatccacttgcaccccaaaaactattgaaataacaaaacaaaaataaatcaatacatacattgctaaaaatgtatggcagtatgggaaatgtcactacgatccctaaataaactgattttattatataaagactatattatacacacacaatatgtttgtatgaatagatataaattatacatatgtgtgtatacatatatacacacatatatatatctgtatgactacataagtatgctgtatataaagaacagcatggatgtcagaaatgtatcttttcagctcatgagaatcatgaggttcctagttgctaaaactatgtacttacacactttaaatggggtcatgatcagggcctaaacatattaatctctgtaagtcaaatatgtcgaggttgtctataatgtgtttgatttgcatggacatgtcctaagcacttggaaagagttgtgaaggaggaattttcacaagacaaaaatcaaaccacatataataaatagtatgatatatatgtgatgacctgactaggaatttgatggcatgagttgaatcctggctctgatacattgtgtagttgaatcctggctctgatacattgtgtagtatctattatgtgtcactaggtaagatacttaacttttgaaatcatgatttctaaggctgttaatgaattttaatgacacaaacctgaaagaaaagattcttgcaaccattatatttggacatctaatttaaggataattagtattgtaggtattaaaataaaatattgattgatttcatttatatattacctctgctaccctccaacatttttctaaacattattataatttcctgatttatttgcccttccttctacttttacttcctgtagctattttatatattattaaatatattataaatatagtatattatagtatattatttatacataagatatagtatatagcctttggtgtttgtcaaagagagagaaatgatgcctaagtcacagaaagagaaagggataattctcaataacaaaaattgtcacatttccttaaaaaacctcaaccacagggctctactaagttgacagaaatgtccagtttcaaaagcaaaatatataaagctcatatttgttattccttttctaaatttgattcataggtcttcaagttatcaattcatgctgttatttacaagattgtagattaactttacgtatatttcctaattaaaggaacatcaaactacgtagaggattcatactaggttaaaaaaaagggggtgggatgggggctctaaagctatctaaaataataactttctgtaagttggaaaataaactattttcaagctttttatgttgttcatcaaaggaatattttcttctaaagtggcctattccaacttataaaaccccaaattttaaggctacattatatgatctgaggcatcatccaaatataattgcatgatatatttgatccaatattattaaaaccttattaaatttaacaaatggcataatcttgaaaattaaggcatgtaaccaaataaacacaatgttgggatatgaatagaatttatctcttgtgctgtttgagtcaccctgcagtatgtctggtaggatgggcaaagtactgcaaacaatgacaaaattaataaaactggaattgtgtgctgcacattatgttcttggcaggaaataaggtgatgctattataaaggacacctgcttccagaaattcaattagaggactctactgcattattttcctaggaacaaaagttaaagtacattttggacgatgtgtattattttggggattgttggggtgagatgttagggtgagcaaggatttttgaggtactcagtatgccaaatcattctttattctctagacactttttcatcttgatgtaaaatttaatcattttatactacactaccttgaatcatagagaaatacacaaattagtaattgatctattttacctatcaaaactattttaatccataaaggatacttttttgcctcaggtctcatttgatgtgcttgaaagcaggtaatggtattatcaatgattatgcaaggtctcaaaatccatgactatctttaaaaagcaagagtcattttgatagttgaaagaagaatgatggttatcagaggctgacaagggtaatgggatggggagggacaaaaaggggctgataaatggatacaaattaaaatgagcatctatttataatagataataggaataaaatccaaagtttggtagtacaatagggtaactgtggttaacaataagttattgaatatttcaacataactagaggagtgggcctaaaatgtttgtaacacaaataaatgataaatgtttgaggttatggatttcccagttagcctgattttatcattatacattttatacttataacaaaatatctcatgtaccccataaatatgtgcaactattatgtacccattaaattaaaattgttttaaaaaacaaagaatgtcactctcctaggaaagtactgacagtctgttgcaactgtttttccaagacatcattactagaaagatgtcatctgattcccgtgtcacacatgggatatatctattacataactctcaataccacaatctaaagggcaatgtagacattaatttgtctcagttgattttccagtttgaaaaaaattgaaatggaactcttttatacattctgacaataatgctaagttcatgatccaagttacctaagacgcacatattaaacgttgcagaggtttttccttggaatttcaattactttcataggttgccctcttgtggccatctgtaaagctactaacaacaaaatgaaaacattgtatgtctttttttccatctagtaaatgcttcgagggtttgttaacacatggtatcttaaaattgacttaataatatgtcaggacaaaattgaaatgaaaaatcttaaatatgaattatagacaaaatcttgattgctgaaaattcagtattggctacaataaaattattcaataaatacaatacctaagtatatgagagtttgctatgattatttattaatttttaaaccatgggcattcattgattcatgaagttgatataaggctttcatttcctaaaataaagttccaatgttatacttcatataatttcaggagaaaggatattttaagatatcataagatgatttaaaaaattctttttttgaactgacatatttaatcaaccgagcacctctatcatcaaagatggattaagtaacaacatgaatacaatcaggcatttaaggtattaagcatcaattgatcccaagctacctatttaagctttccttatttgtaaaagaagtttgagccacatgatctcgactaaatccacaatccactttcttttacctttttttttttttttttttttgatatggctcactctgtcacccaggctggagtgcagtggcgtgatcttggctcactacaacctccaactcccaggtttaagggattctcctgtctcagcctcctaagtagctgggactactggcatgcaccaccatgtctggctgattgctttgtatttttaacggagacggggtttcaccatgttggccagcctggtttcgaactcctgacctcaagtgttccatttgtcttggcctcccaaagtgctgggattacaggtgtgagacaccacgtccagtcataacatctactttctatgtgtcctacttctagttagcaagaactgattagcaatcaatagctcctttctcttttttcttttttcacttcctccaactgatttctagaatgcaagtcaaaatatctattgagtcctctttgtttgaagctgctgtttcctggtcacatttgcaggtttcagaagccattctttttagagcaaagggatccaattgcacataaggcctatagcctcctgttgttttcagtgctcaaatactcaggagtggcccagagccaatacaatggaggaaaaggaccacaggcagagagatgctgagcacactgccctgggtaatctaaattagttgacctttctacctcttccagaagggatatgtgccaaaagataaggtaaaaccagctcagtatgcaccatcacaatgagaaatgaacataaatgagatcatacgagctttgaaaatgtttatgtaacaaggattcaggttatttatatataatatgaattttttaattgtataatataatcaattactataaaaaatttagattccattgaatgagcttcaatattatattctaactaggtagaaatttaaaatgtaggaatcatttaaaatacatttttggtacgaaaagcctttaagattaaaaataactgattaatgaccactacattttttcagtaaatcaataattagtctttttaacagttagaaactctcttttaattttttggggttgggggagggctggatctttcatcttcaaacatcacctctctcatccattcattaccatctatactcaatgccctctcttccacagattcaggtttgtgattaatcagtaaggaacttatggaaggagtgcttaataggtcacagagctacccaaaacctgagaaacctggcttggaaaatagaaacaaggatgaaacgcttaggagtaacctggatcacactaaacattaacctttcattccagcacccatcaagtgaggacacttgtcacagaacactaaatgtcactgattttccaacttccactgcaccctacatggtcccactaggccctaggtcactgttgcctttaagaaatgaacactgctgttgttggtgagccactacacaggatttctgtgatgggcagaattacggcttctcaaagaggtccacatcctaatccctgaagcctgtatgtgttactttatatggccaaaaaagtttacagatgtgattaagttaatgatcttgagattgaaagattatctgggattattcagtggtcccaatgcaatcacaaagtttcttataagagagaggcaggagttcaagggtgagagagtgatttgaagatgcttatcctgctggtttgtggctgaagggaccataaaccaaggaatgcagggagactcttgcagttggaaaaggcaaacaagtagattcttccttagagtctccagtggaacacagcctggctaacgctatgattttagcccagtaagaccaatttcaagtttctgacctccagataaataagataataaagttatgtagttttaaactataaaattatagtaatttgttgtaggtgcaagaggaaacatgtacaattgcccaatgcagatgcttctttgatcatcagctttcaactccagtccttattgggtgcatcagacttgccaggcccaaaagatgcagctactccctaactacaagaaaggctggaaaaagccagtatttttgtagcttctatagaacatacaggttacacttcccctaagaagtatatgatgaagaattccctgaggatacggaaggtattgagaagcccctcaaaaggacaaatatctcctattatcacactttcttattatcattattctttggactctgatataatcagcttttggaagcctaatagtcttgtcctgatgactctgataaactatttccattccttcccagattaataccttcaacagctcaaagcaagaccaaaaaacttcagaaactaagacttttgatttagctctcagagataaaggctaatttctacggtagctcaacctagatctatttcaaacataatataaaaagaaaaataaattttttctatataattgcgtaatgctttctttaaaaagaattgtgcttccaggccctgtaacatttttatgtaaagatgtctatggaaaggctatatatatatatatatattttttttttttttccagacagagtctagctctgttggccaggctggagggcagtggcacaatctcagctcactacaacctctgcctcccagtctcaccatcctcctcccacagcctcccaagtagctgggactacaggcgctcgctaccatgccaggctcatttttgtatttttttgtagagatagagttttgccatgttgcccaggctgatctcaaactcctgggctcaagcgagccacctgcctcagtttcccaaagtgctggaattacacgcatgagccatagtgcttggctggaaagtctatcaaattttttaacctgattcttattattagatattgattttaatgctactagcaatgttatcctaacagaacatttccagttattacagtgaatataaaatttggattatggaattgaatttgttggtgttgtctgatgaaaaaaaatactgctcaagagtcaggatctaaattctggaacattgaatgaatgaatggccttgtgaaaattaatttttttgagcccagttcttcttaatcctctgtcttacctaaccccaagatccgatgatatactaaaaggaagggaaaacaatttaaaaggttgtataaaattataaattcttatatagaaatacagagaaaaaaggaaagttcaaagtatacgtttttcattctattaaaacatttcttctgttgatacatggggatctaactcaagaattctagaaccttgaaattggaagataccatttcaactaagttgcaacataatttccacagtgtctactattcagtgttcatgcttctgtaagcgagttcatcatttgcaaatatatccaagagcaagactggctctgacctattggacttacagtcgccaaacacctcgcctcaagtataaagtgatagtaatcatcatattttcctcatgggttagtaatgtgtgatgtagtggcatgacataatgcctttagtgacttggcatggcatctggcacacaataactatttagtacatcttagctattaatatcaataataaggacaaattaaatatgtattaagtgtatagcatttgtatcagttcttggggaaatatactatgttcacttattccatatattttacttttataaaccattaacatatacaaagggcaggtatttttaaatatacttcttatcaaaatacaactttagaaaatattcattaacagaaaatgcagaagtgagaacttggtttgtgttttataattttaagtattttgtagaccatgaaatactctcaatataaaaggaaggtaaagaaatcaacagtgtcataaactacagttgtattttttttattatagtaatcacagacatcaccccaaatcattctgtaaatatttggcaatgctagttttgttactccatcagatgaaattattcaatttcccttaaaaatcatccttacataatttgaaaaacatataatgaataccactatatatatatgtaaatatatatatgttgtagatattgagagacacaaaatatcatctcttatctagaaattttcaagtgtacattgcattaaaattcttaaaatgcaaaagtagtttgcaaagagatcaagtccatatatacatgtaatagtttgaatgaaggaaaaactctatattgagctgaaattctttgctccttcattcttgccctctttgcctttccaattctcttgctgtatcattacctttctttaactcctggtaggaattacacaatatgtttaatttctcacctctgtcaggaataagaaaggaaatatgcaagctacaaatgcagtagctgttttagtgtctgagccaaaaaagcaaatcaggatgtgtataaggggtcccgttttaactggcaaaagcaatctgtgtcctgaggggatttacaaggccatggatactctgagctgctgtactcttctgttcccagccctgtggaccctggcattctgatagggctctagtgtagttctccatatactgattttcagtggcattggagcccatactgcaatctcagcttagtttctgcctgactaggaaaagtaatgattactgtcgttgaatcactctgcgttatatccacttggattatcacattgaatattcatgcccacccttttgatgtagtaaaaacttgatcataatcacgtctagtaaatgatgaatgtggcatttgtgctcaggcttctgtctgacttcaaaatctgtgagtgtggctatttttattacaatgtccttccaccttaatggagctataggaaaaggaaatattttacaatctcatacactttgaatacatctgggatttctctttcttatccaaaagatacaagagtagcctgcagagaggcttagggatgactagacagaaagagtattgaaatatttaatgaaccacatgctggagtcatgtgctaggtacagggttgggtactggagatttggtgataaatttttcattgtccccaccatttagttgctggcaatgttcttgagaggcagacatgcagacaatgtgatacaacatattctgaagttcacctggggacccaggcaagacaactgcactataatcatggctaggttaggcaggacagcaaaaaaaaaatacccaaagaggcaacttctaaattggtcctttaaagttaaagaggagcttgccaggcagagaaaggaaagttagatataggaatagaacatttcaggcaggagaaattttatgagcaaaggaaacaaactaaggatcgcatttatatagtgaaaattggataattaagtagataatgagattaaatggagaatattagacaagataggagagtataaaattagccataattccttattaggatggtatttaaggtaattttgtttttgttttgtgtttggagcaggggggagaggaaggtgggtaatagagaggttgcttatgtttatattaggagctcaagaaaatatgtgccaaaactgagaagaccaggtacttaaaactctgtcagacaatgctttggcaatgcttggaggtgaacagctattcaaaagcactctcttgtgttaaactggtgttaactttgtaatggcttaaaatataagttaaaatgttacattaattttttccagtaatgcattttttgtttgcctcacccaatatagatccaaataagagaacttcttgcatttccagaaatgtctgtaacattgcaatagcaggttttgttctcatgggctgctctgtataattggttagtttgaaggttggcatctttttgtagcttgcaatatgaattttggagctaagggtttaaaaatgtggataaggcaagacgtcccctccattctttctcgaaatgttcctgcttcaagtgactaatcctatttttgtaatgaaacgagaatgatttctgtaagtttattttgtggaatgaaaaaaaatgtttgagctgtttcattttgtattctttaaagcacagagcacgtttctggcctttggttgaactgatgaagcatcccaatccagctgtaactttgctatactgcagagttggaaaatctgtcaatatcttcctgcaagtgagctgttttcatgtcttaaacatgaattttgtgtggttaaaatcagttcatcacaccagaggcttctgtattgacctcttgtgaaaagtggaataatttttcttgaaggaacaatgctgcatattataatacaagtttcagaggcattatttgaattatcataattagttttgagaaccacatgaggcactgtgatcatttttgcttcaaccattaaacataattctgaaaattccagaggtaaagagaagtctatattatttacccacattttcacccttgcttgtttttttcttcttttctggtgttccaaatttccttcttttgttatttcccaatagtatgggtaatgtgtcctttaaaattttccctaaatattgtctttatcaaagaacactacataatagctctaacttccaacatatcttcattgtcattaataggtactaggagacattattttaaaacatcttgcttgcttctcagtatgtgatacaaaattaggattttattgctgcatgattggctcagattttctgatgtgagacaatgggagcaacgatgaaagtgtttgcattttattctaataaatttcaaatggaaaatctattgaaatgtcccctttccttctagaatctctactgcttatctgtcaaatataaatcaaggtgggcatactttagagtaagaatctcctgaaccttggtgactttctttataactctctttgcattttaggcagtataattattaaatttgttgctttgacttcaaaaataaataagagctgtcactcatcaatacacacattattctattaaaggaatatatacacacactcactgtttcacttactataattgtataaaaatatgtgacagaaaataataattttattaggtttatggattctttgggtcaagaattttgaaagatcacagtagtgatggcttacccttgtgcaagaatgtctgtagcctcaaccaggaaatcatgaaatgacctcacacctggggtctacagcctcaaccaggaagacatgaaatgacctcagacctggcagctgaaatcacctggaggtgtctttattcagatgtgtggtggctggtgctggctttcattggggactccagccctgctgttagctggaacagcaccacacctgacatgtccatgcggcctctttgtatgtattagtttgagctccctcacagaaaaaaaagccaagtggaagctagattgcctataacctagccttggaagtctcctaacataatttctgccgaagtcacaaactctctcagatcaagttggaaggagtatcaaagtcacactttaagaagaacatgtggaataagagatactactgtggccattttgggaaaatgcaatctctctctctcacacacacacacacacacacacacgtgaaatgtttgaattttagaaacaaagatatcttgtattagtatttatttatgcaaaacattttaccattaatctctacacctacttagatttctatgttttttaatctttttttctgtttctgccaaaagtaacactcactgttaaatgtgaaagaatatggaaatatgttacaaaataatctttttctcagtcttcaataatagcttttgatcctatctcatacctctgttctatccctctagacattaatctctattggcgccagttaatagtcctcaaacgtaaatctgattgtatcaatcataactctctgattttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgctaccacgcccggctaattttttgtatttttagtagagacggggtttcactgtgttagccaggatggtctcgatctcctgacctcgtgatccgcccgcctcggcctcccaaagtgctgggattacaggcgtgagccaccgcgcccggccaactctctgatattaaaaaaaaaaaaagtaaaggaaaagagacagctcacaagattattttccaaatccttagaatgaaattttggtttgttttgttttttgttttgagacagagtcttgttctgtagctcaggctggagtacagtggcgcaagctcagctcgctgcaacctctgcctcccaggttcaagtgattcttgtgcctcagcctcctgagtagctgggattacaggcatgtaccaccacgcccaagtaaattttgtacttttagtagagatagggtttcactatgtgggccaggctggtctcaaactcctgacctcaagtgatcctcctgccttggcctcccaaagtgctgggtagaatgaaatttattaagacacttcaaaattgtcaaactacctttgttccatttttcttaaaatggaattttctccctctaaccattcattgttgtataacttacttcctaagaacacatcttataatttaattactctatatcttttttttttctttttgtgagacggagtttcactcttgttgcccaggctggagtgcaatggtgtgatctcggctcactgcaacctctgtctcctgggttcaagcgattctcctgcctcagcctcccaagtagctgggattacaggcatgcgctaccacgccaggctaatttttttttttttttttttttttttttttttttttttttttttttttagtagagatggggtttctctatgttggtcaggctggtcccgaactcccaacctcaggtgttccgcccgcctcggcctcccaaactgctgagattacaggcatgagccaccgtgcccagccaacaatttccttttttctagattggtcttccttttcctaaactgtatttccctttatctacctgtcaaatatttggattcttccatacctaactcaaggtatggccatctctacccctacctcccctcacatggaatcatttcatacaaataatctttcagaacttacagcattgtagcatttgcttacctgcctgattcctctgttacactatgagccttctaagggtaggaatcaagcactagataataacatttgttcatccatttatactgagtatttatatgccatgaaagatgattagccatggcaactgatggcaattggttccagtcacctcaaagcttgtaggctaatgtggaaaagagacaacagtagacatattttttctttgtcctgcacatgtatcatgtgccatataccatggtctactcttccacaaaaaagcacagtttcaaattatctggttttattgaaaacaaagaaaaaggacatacatatctttaaaaggtataggtatagattttaaacgagatataataataaaatacttactccctttccacgagctatacgctatcttttgctcagtcacagaagaagaaaacttgtattctttttccccattacccgactatttttcctagttattgcttcaaatgtcctctgctttgaaatttatacatcactatttattcctcattattcttccttcttcttgtcatctcatccttttcccattcctccctagtcacttatgtcatttaatattgactttaactcttgaataacttccttatttcagcatcaattcttatcaccaccctgtatgacttgaaaatctactcaagatcatctgactgcatggcagaactatttactaaaatatagaatgtaggagaaaaataagggtagtaatgaatttgtacttcaaggtcttatgtgccatccaagtaaagtggatctagagctcagaaaaaaacctaaggaataaataatataaatatttatagataaagagataagtttatcttcctaggaattgataattattatagctacaaagagagccataagttagatgatttttatgaagagagaaaagtaaagagttgaggatgaatcttaaagcaatgtttctttgatcaatataagatgaatgcaagatgatcgctttataaatttgggatatgtacataaggatttcttagggttctgtacctagtatggtaaaatagagactgtaatttcagattttcttgttttgtcataaattttctttttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctgttttgtcataaattttctttcccactttaatatacttcagaaatgtctttccatatttcttctctagtgtcctgtcacttttcttttccttcctttgaaggaagtacttgttattaagggaattgtccaaagtctttagtttgtcaaatatgaaagccagtaatcttgttcatcactcagtatctctctcatgaagaaacaaaataaaactggaaaagcaataacaactaccagatgagtagtgtaggagtatgcttaactagcatcaatttccccctgcttttttttcttttaaaacatgttgctctagatcaaatttccaaataccatctgcaagaaaaacaacatttagcacatctctgacaaaagaaaatagaaactacaatagaacattcactcccaagcctagaaatatccccaacatatcaaaatactacccacagcctagaaaaataaaacacaaccacccacatttcttcccacctccagcatgactcaaacacacacattctttttaaccacaattacaattacaaagaacatctactcggtaaaaaaaatatatatatatatagtattcctaaagtcagcaataaaatataatgtattatgcagttacaacaggtgaaatgtttttagatttaaataaagaaagctgagatatatgtgtttttcataaaagttataaatgttttcttaattgataaacaatatcatctttcacataatatatgctaaatcaatgtcttttgaataggactgaaaataacgatataatatttcactgtagaatttgcattgatatcgcaatactaaattatatacgtgaggacaaggttgttgataatctagacaacctctgccctatggtgagccatacaggaaagaatctccatttaagaagcaaaacacatcaccctaataaaatgaatataagtttgcttttgaaggcagcagaagatgccaaaatttcttatataaattgaaattattatttatacctgctagtgctacgtgtatactcacttatgaggaaggagtgttagtttttgaaatatttgaagtttcggaaaacttagctgtatttaatgaccctcaaatatgagtatgattatacataaacatgtgtgtatatgtatctaaatttaatgtctgtgtaacatttgaaggactatcataaaattttggagtgatttatattatgaatcctgcatcttattgttattcagtgaaaatactccctgaagagttctttacctatacgatacattgcaatgtgataatcaaacacagaaagcaggagatacaaaagaagtctgtagaggaataagattctaacagttggtgatgataggagtgactagaaacaggatgagccaaaactcagaacgacaaacaacaacaaaatatcgtcttatcctacgtatctaatcacacttgccaaataatcataatttaattttcaaaattcctcaatatttagttttggctgcttgctcttttccttgcacagacttttgctccatattttctttattcacaacttttcaactatcttcttgatatggggatctttatctatgacttctatctaaaactccagtttaaattttctagtgccccatcatccatttccattgacagtacaattaaactttgtcgaaaacagaattaatttcaagcgagtttttccttctgagatgtgcttttgttataaccaggatactattcacaatactaccaagaaaatataaatcctaaaaataataaactcatgccattttgagcccctagaacattaagtacatagttatttattttgcttgcattatttcataatgctcctaatcacccaatgagctagcaaccatcatttacagtttttttttgcaaatgaagaaacacatgagaccttaaaaaaaattaagttgtttgcataagcctagtttttagggaagggaattggtgataaaatgaaatcgattctttattgatacataattgcacatatttataggatacatgtggtatttttatacatgtacataatgtgtaatgctcaaatcagggcaattaaggatatccataacctcaaacgcttttcatttctttgtgttgggaacatttcaaatcttctcttccagctattttgaaatatataacaggtgttaaatatagtctggaatgggttttaatcaaggtcaacttcaccgcaagtatttaaccacataaattttattatttctcattaactaagtcacctagttaaaataatttaactaggcttttctccctttgtcacttatttcatagattccaaatctcattgattattatctcaccatatgtagcatttccacttccatggccacaattcagattacagcaaattacaaaagtgaccacagttctttactgatctgcccattgccaaggtacgcacaccttgaatctaacctgtccggtgattgactgtggcccaaagaatgccccagaagtgaggctgtatgagttctgaatctgtgtctcaatagattttcatgccactgctctcagtctggagccacgggccactgctgcctattgaagacacctggtccagcctgttgggggatgaaggaccccacaatatgatgagtcgtctcagctgaaccattttagaacagccaggttccttgatctgacaactgaccacagtcatataaacaagcccagccaagttcacctgagccttgcccacatcagcagaactgccctgtagagccaacctcaaattcccaccccatagaatcataggtgaaatgaatatttactattttaaaacactaagtgtctaaggagaactaagtgtcagggtgtcttattatgcatcaaagtgtagcttatccattcaggaaaactctgctctagtcaaactgaacttcttactattctcccacttttgtacttgcatactatattttaacactttcatattcttgcattcatgtgttactgattaaattcattgaatattttatcctatcatatgacacaattctagttatccaaggcttgcagtatcaaataatggagatgatttcaatgatttatatcattgttatatatatgtagatatatacatgtatagataggtgatagataaatgtattgatatttcaactatatgatttcaattatatatattttatctcaaagactctgttataataagacttatacacatatatacacacaaaagcttacatatctgaaagttaaagaggtaaaacaaaaaagtaggaaaaatagcagattagctccagttatagaacaacttctatgcagagttatgtaagattttatgcagttattttatctctctggccttagcttttacatctgtcagaaaacttatcaccctcctatgttcctatttgtaacaaaagaattttcttggaatgttaataataatgttaataaaaactgaaaatatatgcagttccttccatgttgcaactattgtactaaagaatgctgtgtaatgtccttagtacagtgttacaataagggacaatggatataaaacaagcattgccccttattataaaagtataataatatatgtaatatatatatacacacacataatagatactatatatctattatatacatacatgtatgtatctattatatacatacatgtatgtatctattatatacatacatgtatatgtatgtatgtattatatacatacatgtatatgtatgtatgtattatatacatacatgtatatgtatgtatgtattatatacatacatgtatatgtatgtatgtattacatacatgtatatgtatgtatgtattacatacatatataacatgtattacatatgtgttgtaagaatgaaatgaacatatttatgttatatacacacaaatgtaaaaaatgtgtatatataacatatgtaataatatatgtaatatacacacatatataaattatatatctcttatgtgtatataatatatattttatatagtgtatatatctatgacatttattattacatgttatatatacacgtatatattttacatatatgttatatgtgtatatatatttcataaatatattcattttattcttaaaacatatatatccaaattacttaaaatatcattataaaaataaaatatactatcattcaacactcaattcagttggttaaaagtcaaagggattatgatttgaaactcattcagaataactgtcacatatctctctgaaggataggttttcaatagacatcaagaaactgaaaaataaacaccaaagacccctcaaccactaaaatacttttgcagacaccttccctataatttctattaattatcctgcataatgatttctagtaattacacaaagtccaataagtctacagcttctagttctttagactctggaatactttcattagatgcaacaaattatgaatgaaaataagtcgaagtagaatgtttacttgaattacatttggtaataagaatagagagataaatattgttataaccaatcaatcctggtgggcaggattatttgagttatggatcttgggaaaaaataacgatatacaggttggatgatgtgacagtgagatggtttcttatcagactgagtaactgaatttggagtcacctgaaggtaggttatcaaaatcaggtggggaaaatctggctcaacaaaatcccatgtttaaaacaatatataatttcattataaaatattttattattctgcgattttgtcgtagaagagtgatatgacttgaggtcttcaagtagtaaggtaatttggcattctaaagcatagagtgattttaaaagagataaaatcaatgttccttttctgtttggggaagggctgttttccagttctgagcttcccattaaaagaggaatagcaacaaacttttccccaattttcgaaagcaaactgagatgaattgatgtcaaatgggaaacatttaaaagaaccagcaccttgaccaacaaaaatgtcaagtttttttgaattaaattccataaaatgttatgtgcattaaacatatgctgttaaaaatacagataatacaccacagaaagattctataaaaataatcatttttaaggatacagtagtgtgttgtattataccttttacattatgataaaatttacttttgctagataatctatacctcagtatgggtaaatgatgcattactatattctattgtctgaaaatccatcaagactcactcaggcaaatagaaatgatgtttacatgaatatagctatcacatcgctggttatatgtaagttggtgaacacactaaatatatccccttaagtttggattccttatttttaaaataaagcttttctagattaggtcatattcatagttcctgatagctctgttattttaagctaaatcttagttctaagataattaatacttataaaaaagtaatcattagcaagtacaatattgcagacttgtattgagtcataacatgaaaaactgacaaaattttcaaattctattttctacctttttagttttttcttcagaagtagtatggtgctttctttctatactaatttaaaataaataaactgtcagtaatttaaaacattattattctgttaatatttgttttccattttctgtaacatggttaagcatgtgttcccacaaggtggtgctctttatttaaaaattacaacaggaagcagttttgttctatgtaagcatagtgctcaatgatgatacagattgagcatgattttaagtcgctaaatgagcagtgaaaatgcatttattactgaaaacttattttcatttgatttttattttttaaatgctaaaagtataaaacattttggtagcaatttcagttattaagaatttagaggttttaaaagttcagaaaatgcatagtagccataaacaaaaacacaaagggaggaatagtaaaaataaaattttggctggaacagaaattcttctctggaaataaagaaaagctagaatataacatagaaatactatatttaaaccttctaatattaaactaagtacagaggagtcatatactaagcacacttttttaacctgaatttaggtattcagaaggaaaaggaaataaagaaagagagataaagggaaagagagaaggaaggaaggaaggaaggagaagaaagagaaagaaggaacttttaaaaagaaattgaatagtggtattaattttactcatcatatttttcaaatattatatttcctgactgtctggtccctcagttccttcaagactcatacagttttacatctcaccctgctgaggcccaacttaatgttcaatattttacatgatttgcttacaccacccctcagcataaaccaaattatttttctggtaaccacctaaaggaagaataatatgcaccaatactgaaaaaaaatagataagagttttatttctacttcggatgtaaaaagtgtgaagggaatattgatcccaggctaaaaatgagaaagaggtaggtaattctgaaaagtattatttttttcttaaacattcagaaagctgagtacttaagacgtccctctgagatgaacaaaattccaaaggttgacaagttcctttgaggaaagacaggacacacaaactgtttaattatcagcagaacatggagccaagtgaaagcagccataaaagtgggtagtagggaggcaagtaacattttaaaaattcttaagacctagcgtgggctatcatgagaagtcagaattcctgagggcaccattccaagggaagtctgcacctgcttggacaccagctcttttacaagaggggttcagctactcctggagacaggtaggaaaagagaacaagacaatctgctgctagaggaagggcaagatcctgtctagcatccaacatttagtcctgctttgataaccaaagccatctgcccatgggagagagacaggaaacccttccataagacgcaggcaaagattggctgcactggcaaagagacaggagacactcttaccccttcctcctaggccaaggtcagctgccatgaagaaaggtatagaagtcttactcctccaaccagccctttacagtaggaaaagccatctgctactgagggaggagtaagacaccaacttaattccagaattctacaatgatatagtatattgctacaggggaaaggcaggaaatcagcctgtagaaacacccaatcattcaaggcagaggtcagctgtcttgaaggagggctagaaaacttgattgcaccctagaccctctagagaacaggaagggaaatgaagaaagacccagtgctgaggtttggtgcagagagccagcataagactggggctggaggagaactatgaagttccaatctcccctttcctttgctcctaccatgagactggcagtaagtaggaagccacaatagtctattgctagggaaggcacaggaatgcaaagagaaagccctcactcctctttcaacacagtcatgcaaagtcttctgaaagttaaaaatggaagaggaacattttgacaaaccctctgacattgcaatactcatacaaattataacataggcgcagtccataaaaggaagaattttaagcctgtgtttcactgaatgtgtccatagtgacactaaagcccaaatcaagctcaactactttctgctaactcaaactccaagttactggcctgtgagataaaggggagtggacattcaggaatacaaatatttacctcagtgtcttctgtgttttttaaccaatgcaatgtttggtatggaaggaaggagggaaggaatgaaagaaggaagggaaggagatgaaggtggggggagggaagcagggagaaaaggaggaaggaaaaaaagttctagtgtaaagcaacaaaatagtccatagaaccagaaacatagaaattcaggatgatgacactttcaggcagagatatgaaattaaaaattatggataatttgaaggaactggttaaaaaaaaagggggggggagcgtgtataaacaaatggggaatttcaacacaaatttggaaactataaataaaagaatcaaatacaaataccagaaattaaaaattaattatcagagatttaaacattcccttaattgggcttagtagcagaccagacatagtagaggaaagatcagtgaacttgaaaatgggttaataggagttatccacactgaagcatattgagaaacaaaatggaaaaacagaaaacagaacatctaaaagctgtaagacagtatcaaatggtcttatatgcaaatatattttccaaaaataatgaaaaaagaacaaatcatacattcaaaaagttcagagaattctaagaatgataagaggaaaagcgtaaccagaaaaatcgtagtaaaattattaaaaaccaaatatggctgggtgcggtggctcacgcctgtaatcccagcactttgggaggtcgaggtgagcagatcacgaggtcaggagatcgagaccatcctggctaacatggtgaaaccctgtctctactaaaagtacaaaaaattagccgggcgtggtggcgggtgcttgtagtcccagctactcaggaggctgaggcaggagaatggcgtgaaccggggtggtggagcttgcagtgagccaagatcgtgccactacactccagcctggtcaacagagcaagactctgtctcaaatatatatatatatataatatacatataatataatatatattatatatactataaaatatatagtatatataatatataatataatatataacatatataatataatatatattatatatatataaaatcttgaagacatcatcaagagaaaaagaggaactatgattaaaaattaaaggaggcttcttgtcagaagcattgaaagctagaagacaagggagcaacacttaaccaaaaggaaaaaaaaaactcaatctagaactctataaatatagaatataattttatccagaattacagaaaaagtataatatctcatgacccattatgttttagtaaaggagtaaggttagttcaacaactgaaatcaatgtatacaattcactggaaaagaaaaatcacattattttctcaatcaataaaaagcaagaaagacaaattaataaaattaaaatcaattcatacatacaaaaaaacttttagaaaactaggaatagaaaagaacttgctcagtttaaaaggggaaaattattaaaatgaaatgaaacacaacaaagtataaaatttcacagctgacattcatctatgtaaaaaaagctattagaactaatagtgtatacagtaagattgcatgatacaaagttaatataaaaaatcaatagtaagttgatacactatcaacaaaaaatggaaattaaaatattaaaacaattttgagaaaattttaaaagacctaaataaatgagaggatattccatattcatggatcaggagattaaatatgggtaagatatcaattctccttaaattgatttatatatcctatgtaatctcggtgactctcatgcagggttttttctttttttgtttatgtagaaattgacaagctgattctaaaatttactcagaacgtgaaggcctttattaagtaaaacaataaggaaaaataagaacaaaattgtagctctttcaaggattagtataaaattgcagtaataatgactctattattggcaaaaagatagacttacagatcaatggaaaagaagagagtccaaaacagaccaaaacatatatggtcacttgattttggcaaaatactatggtaatttaaggaagaaatcatagtttttttttaaagaaatataactagaacaattggctagccatatgagaaaaaatatttacatgccatacacaaaaattaatcattcacagatcataagtctaaatgtgagagctaaattcatagattctaaaagaaaaagcaggacaaaatctttgtcacctttatttagagaaaaatttctatataggcctcaaaaacaaggaaaaaaataaattggacttaatcaaaattaaaattgctctttgaaaggcactgttagaataaataaaaaggcatgcaacagattcagataaaatatttataaaacacatatctgataatggctttgtccactcactacataaaagaactctgaaacctccataacaagaagattaaaaagtaactttaatgggcatatagacagccaataaatgcatgaccacatgttcaatgtcattacttaacaagaaatggaaagtgcaaactgaataagatatgacatatccactaaaatgactaaaattaggagtgacaataccaagtgctgctgaggttgtggatcaatttagaattctcatacattattgttgatgatgccaaatgacatttcattttggcaaatgtatgccattttcttacaaagttaaatatgcactcattggaaaacatagaaattctacttgtaggtatctgctcaagaggttttaatatatatttgaatatttagagcagatttgttcataatatctgaaaattagaaatggccttaatatctatcaaatggcaactggataaacaaactgcggtatatgtatataacagaaaactattcaacaataaagaggaactattttacactactgataccgcaaaaccatagaagaatcttaaaagcattgtgctaagtgaaataagtcatattgtgtgattcctttgatataaaattccagaattgtcaaaactatcatgacaaaaagtagatcaatggttgatatggtattagtgtcagtatagtctgactcaaaaggggcccagggaaatttttagggccatgggaatgttccatatattgattgtcatggtgattaaagaactacatacatttttcaaaactaatcaaattatgtttttgtttttgttttttttttttcctgagacggagtcttgctctgttgcccaggctggagtgcagtggtgcgatcttggctcactgcaagctccgccttccagattcacgccattctcctgcctcagcctccccagtagctgggactacaggcgcccgccactgcacccagctaattttttgtatttttagtagagacggggcttcaccgggttagccaggatggtctcgatctcctgacctcgtgatctgcccacctcggcctcccaaagtgctgggattacaggcgtgagccaccgagcccagcaaaattgtgtatttttaaaaatgtggattgtactctttctctattgtacctgagtaaaaaaattaaatataccggataacttgtactattagtctttaacatgccttctttctaaaggattttcaaaaataatttgagtatttttcatttttttcttaaggctttcaaataaaatccctaatgcataagagcaaatctaccatgtatagacttatatcctataggaaataagagaaagagaatgttctggagcaagggaatgaaattaaatgtataatttagggaggtaaaactagattagtttagggaggtaaaactagattgctgaggttgcagggtaggcacgggttgaagtttagaaacctatgcaatatttctcaaataatcaattttttcctctttaattccaagtggaagattaagaatcaaaagaaatatttggcctgaagccagagattttagatttagctacctgcagtggaagctatgattgttcttgaccaccgtaaaaatgtaggtaggaacgaagagaaacatatggccaaagactgaatttcaagacaagctcactgaatacagtgggagaaaggagtctccaggcagaaatagaacagttttaaattctacggagagggcaagagaagtgaagaatgaaattaggtcactggattcaattattacagatacagatataattttcaagcattctgttttagatggaggttaaaaatcttttcacataaaatggagggaatcatagttgagagactgtagtaggagatataatgtactaatttgaggaatctggctatatagtaaagctgtagaccccaactgggaggatattatagtttcataaaaggatcttcagcataggggacattccaaagcagagaaaagtgagttaatggaaaggaagagactgctggagggaaaaggaatatctgaaggtttaagttcccccaaggagctgggagataaatgagagcagtaacatgggtaaaaaccaagagagatggaaaaactgttctaatctattaagatgtaaaacagagatttattcttcctgcaggcagaaacattaacaaaactttttttttcaaaaaaatttgagtaaatagttgaaagtcaatgtatctgtattgtattacacttacatgaccaaaacttaaacatgctattttctttttgtcttttcttttcttactactctctctttccctctacttgactctttccctcaaggtcagcttctgatgtaatgattcaaaattgtgttacttcagtggtgttatgactgaatgctacaagagtcttaaagtcttcattatagttaccaaaagattatcacaaatcctcacataacagtgaaatgcaagtttattcttacagatgagaaaactgatgctctgtgagaataagtggcttgtctaaaatcaaagagctcataagtgataaaattggaattaaactcttgggtcatttcttaggacttcattcctatctcacataaccacaatattcaagaaatattatctgttttgttctttcctttggtattattggcttttgaagatagcatccccttgtgattaattacaaagaggagtttccacagttgacagttttgaccagccaaaagaaaactagtgatcttaattccatttctgccaataacaagatgcgaccgtaggcaggttatttgctctttctgaacgttgatttctttatttgtaaagtaaggtatacagttatacagtctgtaagatcttttctagttctacatttctatgagtctaaaagtaggatgactgtgaaagaccagttctaccttggagatgagccaaatttgaaattggctatttgtttatagccttcttcactcttcacttggattttacatataaatgctatttttaaaaagtcatactagataaactggctgcaaaatttaaaacagaataccattgaggttttcggctcatgaagctataaaaagcagtgtgaactataattgtggccttacaaagttatcattggcgatttgcttcagaatttcatttccatctcatcttacatagtaaaaaaaacaacacaaagactaaagacccagaaatctcagagagctactcagaatgtattgctgaggaaaattttccctaagatattaattaggtagaaagtcctgaatgcagtcatttgactaattaatcctcatttacataaaaataaatcagttatatcaattactgtggggcaatagaatgtggttccccacctccccgtctttccttctgtaatataagattcatacattttcttcctgacagctagttatttagtgtcctttactgcacatttttcctctaatttgcttcattgttggtttggtcttagatttctttcctcccatctttctacttgctctttgtagatggtctcactattcccatatcattatatattatttacatactgttatccctgaaatttacatctcaatccatatgaagaattcacctacgccaaactaaagaacattgcccttttcttcccactcccaaccccacccaaatctttcttatgttctctgttttggtaaatgtcatgagcatctatccagtagttccccagacttaggagccatctttaattttcctcaatatacgaatccaacccatcagcaagtccccaattctaacttcataatatatctcaacccaattcacttccctactgctatgaccctaaaccaaactcccaccacttacctgaactcctgtattagcctagccctttaccagattctttttggttcagtccttgttctatttcacttaattttaagagcaaccagcataatatttttaaaacataaatcttgtcatgtaattccatagtacttccacttccatcattttccatagtacttggaataaaatccagactcctacaggacctagcatgattagctgttgcctctcactccaataccattttatgccactttgcctttagctcactacatttctgtcacagttagatcctttgttccttgtcttagtatcttagtggtgctgtagcaaattaccacaaatggatcccagacatccaaaaccaagttgtcagtagatttgtttccttctaaaagctccaaaagaggatctcttccatgcctccctcccagattctggtggttgttagcaatccttggcattccatagattgtagaggtatcactccaatctctgtctccatttcagatggcattctcctgcaccagtcattagatttagggcccaacctaaatccaggttgatttcaagatctttaactaatggcatctataaaaatcatattaccaaataaggtcacattctgaggttctaggtggatataaattttgaggggacaatatttaacccactgcatttcttctgctatttcatctccctgatcttcagatggtccatcttctgaaaatcacttcctcagagaagtcttccttgatttccttcctttcttcatcatagctccctgctgtttccttcacaatgccagccaaacaagtatcatttcagtggcatagtttgtatataatatatgtatatgtgaatacatactaaatatagatatgagtaaacatataaatatagtaatatgtgcgtataagtgtatatactttgtgttatcagctaagaatatgggaacatttcttaatttaactgtcatggcatatactcaaaaaaagccagtaaacaactggagtattcaaggaatggaaaaaaattaaaaaaaaatcatctgtagaatgaaaagtactagcgaagaagaaaaaaatttaaaaaatctgtggatttaaaaaataataataaaatgagaaaataatgtaaatgtaaagaaaagatacagagtgataacaccttgtattatataagatgttgaaaaaaacatctattttatactgattttttttcttaggctgagagatagtaagtcccaatattaacaaatgtaaaataaacaaaacataattgtaagtaaaaactgcgagacacttgatcactattttaaaagcctactaacataaaatcctaactaattactatcaacgatgtatggatcttggtgatttgtttatagaattaaatttctgcacagaagaacaaaacaaaaagaattgcttcataagtcttcctcctagcatgtttttctggctatataatgagtatatagacctagcatttatggaataaacccaactatctcctgaggtcatattctgtgtattgcttcatttaattaactaattataaaataaacatgagctccaaaggagaccgtaagctccagatcagaaagcagccacaccagcaccttaattgcagtccattaaacactaagcagaggattcatctaagatgttcccagacttctgactcccagaaactgagattgttattttaagtcattaaggttgcgtcaatttgttacgcagcaatagaaaatgaatacacctaataaaacaacttgggaagcgcttcttctttttaactgtctgttagagcttttaataggtggtataattccttccttaaatgattgtagaattcactggtgaagccatttggtcctgaagttttctttgtgagaggagatttttaattgaagattttttcttttatgtgaagtatcacctgaattttttatttcttgaattaacttggttgaagtgtgtttttctaggaatttgtccatttcatccacaattttagattcatcagtataaattctgttgaaaatatcgtcttatctttgattgtctgtaggacctatagtgatatactcttactgagttctgctattgtttatctgcaccttctcacttgtttatttgatgaacccgccagagagttgtcaatgttaattttcccccaaaaatcaacttttgcctttatcctctatattaaatattccaatatattttattaatttctgctactaacaccattatttttttctatatattttaggttttatttacttgtttttccctaggttcttagattaaatgtttatataattgatttttagcctttatttttctaatacatatttttaaaaatatattataaatttctctctaagttgggttttaactgccttccacatgtgtcaatatgtagtatctcaaaatgaatcaaaaaaattcttatttgtacttgaattattttttggccaatgggttaattagaagtgtctatcttgttttccaaaaattttagcactttttagttattatttttaaaattttcatgtttagtgttaactactagctgaactctgctgttaaaagaaaatgtattctatatgatttcaattctttgacaattaatgtgtttatctgtatatggccttcatttggtcaatttggggaaataaagtaagcgctctatatatgtcaccaaggccaagcttatttatcacattgctcagattattatctttacagactttatattctagtccaatcagatctgcggagaagtaaaataaaatgttctaccatgattgaggcttttctattctccttttgattctgttaatttttgtatgtatattttaaatatatgttattagatgtataaacattaaaaatttttctacctacctggtacaccaacttcaatattgaaagctctctttttaaatctattattttttgaaagaccatggttattgacattaatgtagttatgtaggctttttagttagtattttatggtataccttttctatcactttagtttcaacctttatttaattatcatatttgttctctcttatctgttattgtctgtaggatctagctgctcttctcgaggagtatctttgtggcgtattttagaatttttttgtaaatacatggtttcaaaaacattcttgaattttatcttgaattgaccatttttctacttatatttaatgcaatttcttacatgcttttgtttaaaagttagaatgatgatgttggttgtaatcagtttttatttaaattcttgacctgttagagaatggtgatttaaattaggtgaaatctagtgtttctgaataggtgtatgcggaagatttctccagacttcgccatgcacaatatgtccatgtaacaaagctgcatttgtaccccctaaatctataactcaagaaaataaataaaaataattttgcagaaggagttgtcaatagaagaaaaatagtcattcatgtagattagccattgtaatctgtgataaaggaaagaaaaatttttaaaaataggattttctataaaagttctcaccatgcttcaatcaaaatataaattatgtctatgagtaaaatataagaatatccagagaatttattatataaatgatttagttactttcagagaactttggtgaactcttttggtaaaatattaaatattaaatatatataattttaactcctcttcctataatacttataaatcttctaaatgtactttaatagattaaaatacctctttgaaaaataatttaatagccgatcataaaatctttagggcatattcctattatgtggtattctggaatcaacatagattttaattgtaagtaataattctgcagaatctcaactttaatttattatgaatatacaatcagatccatttttaaagtgcctgtagtggttataattaatgttaagtgaaaaaaatgcataaatttcacgttttgctgattaatgtttccctgactgtaagcacttgaaaagactgtctagttacagaagaaaagctagaacaagttattttccttccagatgagtgctccttaacacagagacatagctcccctgggaaggttaatgctgccgccaatcttctggagacccagagaggggaaagggaagaatcccaagccaaagaggtttgcaatttcctacaaagccaaagtttaatgaatactaatgacagaacagggatggatccttggaaaactagctcatttcttatcttgccaaaagagatagaatgcagtaccaacttactggggtccatggagaagcaacagaagctaccttggacctgtacacgtcctgttgcctcgggctatcctggagattggccttcagactcaccttcttagagagccatcttcattctttctggaatgactaagcaagtatcaaccctaatctaactgagattgaacaggctattaggctacacagtcacagggaggatgtttagggttccctagaaaaagtaaataattttgaaaaagatttctaagaatcaatttcaattttattttctaaataaatttggcaattaaatgcaaactgatgtaccttaaacagttgcagtagctagcttttgtaattgctaaagtctgtagaattgaaatacctttggaccaagaaaagaaagatccttgatttattcccatacataatgaagatcttaatgtaatgcaaattagttatttaagacctggttcaacatctacctctcaaaacaagtcttccaaaaaaataaaaataacccccccaacccaaattaccatgattatttccatataatgcaaaattaatcatttatttatgtactcatttttacacttgttaatcatgtgttaaaaagaaatgattgctggctgggtgtggtggcttacacctgtaatcccagggagtgggaggccgaggcgtgtgggtaacctgaggtcaggagtttgagaccagcctgaccaacaaggagaaatcccatctctactaaaaatacaaaattagctgggcattgtgtcatatgcctgtagtcacagctacttgggaggctgaggcaggagaatcacttgaacccaggaggcagaggttgtggtgagcccagatcgtgccattgcactccagcctgggcaacaagagcaaaactccatctcaaaaaaaaaaaaaaaagaaaagaaaagaaaaaaaaaaatgattgctaaccaattagagtgcaaaaatttaaagtaaagggtcaatattttttattttttataaagtgctaagaatagtactaagtgtacaacagacattactaatatgctttctctataagcctttatctttacttcatatttttcacattttaatgagtaattatatgtataaagctgtattcatccatctgttttttccagaaaaacatctatctttgataaaaagtaaaaatcgtttaactttattgtgttagatgagaacagtctaattagaaaccagtctcttgttaagaatttaaaagatcaagaaacctgttctatttgctgtagaagaatatacgtatatatgtgtgtgtatatgtgcatacatatacatatatgatatataaaaatatgttacatatgttttatatatgtttaagggttgtatataaatgccttccaacttacatgcaaagaaacaaatgtatgtctaataaacataaatagaaaaggaagggagaaaaaaagaacaaaatacaaacatttgcaatttctatggttaaaatgatatttccatttttgacaaaactatggaattctagggagcaaaaacacttgaagtaaaataatttatattgcactttaaataatttaaccaggaagttgaatatatattaatatttattttgcatattttgccctatttcattaacactgattttccttcacaagcctttctttaaatacctttttcctttagattagttataaattaacagtacaacggagggcggttccaagatggccaaataggaacagctccagtctacagctcccagcatgagcaatgcagaagacggatgatttctgcatttccaactgaggtactgggttcatctcactggggattgtcagacagtgggtgcaggacagtggtacagtgcaccaagtgtgagccgaagcagggcgaggcatcacctcacccgggaagcgcaaggggtcaaggaattccctttcctagccaaggaaaggggtgacagacagcacctggaaaatcaggtcactcccaccctaatactgcactttcttagcaaacggcacacccagagattatatccttcacctggctcgaagggttctacgcccatggagccttgctcattgctagcacagcagtctgagatcaaactgcaaagtggcaatgaggctgggagaggggcgcccgccattgctgaggcttgaagaggtaaacaaagcagcggggaagctagaactgggtggagcccactgcagctcaaggaggccctgcctgcctctgtagactccacctctgggggcaaggaatagccaaacaaaaggcagcagaaacctctgcagactttaatgtccctgtctgacagcttggaagacagtactggttctcccagcatgcagcttgagatctgagaacggacagactgcctcctcaagtgagtccctgacccctgagtagcctaactgggaggcaccccctagtacgggcagactgacacctcacacggccgggtacccctctgagacaaaacttccagaggaatgatcaggcagcaatatttgctgttcaccaatattcgatattctgcagcctccacgctccaggcaaacagggttggagggaactctggcaaattccaacagacctgcagctgagggtcctgactgttagaaggaaaactaacaaacagaaaggacacccacaccaaaaccccatctgtacatcaccatcatcaaagaccaaaggtatataaaaccacaaagatggggaaaaaagcagagcagaaaaactgaaaattctaaaaatcagagctcctttcctcctccaaaggaacgcagctcctcaccagcaacggaacaaagatggatggagaatgactttgacgagttgagagaagaaggcttcagatgatcaaacttcccgaggtaaaggaggaagttcgaacccatggcaaaaaagttaaaaaccttgaaaaaagattagatgaatggctaactagaataaccaatgcagagaaatccttaaaggacctgatggacctgaaaaccttggcacgagaactacgtgacaaatgcacaagcttcagtagctgattcgatcaactggaagaaagggtatcagcgatggaagatgaaatgaatgaaatgaagtgagaagagaagttcagagaaaaaagaataaaaagaaaataacaaagcctccaagaaatatgggactatgtgaaaagaccaaatctacgtcccattggtgtacctgaaagtgatggggagaaaggaaccaagttggaaaacactctgcaggatattatccaggagaacttccccaatctagcaaggcaggccaacattcaaattcaggaaatacagagaacgccacaaagatactcctcgagaagagcaactccaagacacataatcgtcagattcaccaaagttgaaatgaaagaaaaaatgttaagtgcagccagagagaaaggtcgggttacccacaaagggaatcccatcagactaacagtggatctctcggcagaaactctacaagccagatgagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgcactaaaagagctcctgaaggaagcactaaacatggaaaggaacaaccagtaacagccactgcaaaaacatgccaaattgtaaagaccatcgaggctaggaagaaactgcatcaactaacgagcaaaataaccagctaacatcataatgacaggatcaaattcacacgttaacaatattgaccttaaatgtaaatgagctaaatgctccaattaaaagacacagactggcaaactggataaagagtcaagacccatctgtgtactgtattcaggaaacccatctcacgtgcagagacacacataggctcaaaataaagggatggaggaagatctaccaagcaaatggaaaacagaaaaaggcagggtttgcaatcctagtctctggtaaaacagactttaaaccaacaaagatcaaaagagacaaagaaggccattacataatggtaaagggatcaattcaacaagaagagctaactatcctagatatatatgcgcccaatacaggaacacccagattcataaagcaagtccttagagacctacaaagagacttagactcccacacaataattatgggagactttaacaccccactgtcaacattagacagatcaatgagacagaaagttaacaaggatatccaggaattgaactcagctctgcaccaagcagacctaatagacatctacagaactctccaccccaaataaacagtttatacattcttctcagcaccacaccgcacttgttccaaaattgaccacatagttggaagtaaagctctcctcagcaaatctaaaagaacagaaattataacaaactgtctctcagaccacagtgcaatcaaactagaattcaggattaagaaactcattcaaaaccactcaactacatggaaactgaacaacctgctcctgaatgactactgggtatataacgaaatgaaggcacaaataaagatgttcttcgaaaccaacgagaacaaagacacaacataccagaatctctgggacacatttaaagcaatgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaagataagagcagaactgaaggagatagagacataaaaaaacccttcaaaaaatcaatgaatccaggagctggtttttggaagagatcaacaaagtcgatagaccactagcaagactaataaagaagaaaagagagaagaatcaaatagacgcaataaacaatgataaaggggatattaccaccaatcccacggaaatacaaactaccatcagagaatactataaacacctctatgcaaacaaactagaaaatctagaagaaatggataaattcctcgacacatacaccctcccaagactaaaccaggaagaagttgaatctctgaatagaccaataacaggctctgaaattgaggctataattaatagcttaccaaccaaaaaaagtccaggaccagatggattcacagccgaattctaccagaggtacaaggaggagctggtaccattccatctgaaactattccaatcaattgaaaaagaagtaatcctccctaactcattttatgaggccagcatcatcctgataccaaagcctggcagagacacaacaaaaaaaagagaattttcaaccaatatccctgatgaatctcaatgcaaaaatcctcagtaaaatactggccaactgaatccagcaacatatcaaaaagcttatccaccatgatcaagtgggcttcatccctgggatgcaaggctggttcaacatatgcaaatcaataaatgtaatccagcatataaacagaaccaacaacaaaaaccacatgattatctcaatagatgcagaaaaggcctttgacaaaattcaacagcccttcatgctaaaaactctcaataaattaggtattgatgggacatatctcaaaataataagagctatttatgacaaacccacagccaatatcatactggaaggcattccctttgaaaactggcacaagacagggagtccctctctcgccactcctattcaacacagtgtgggaagttctggccagggcaatcaggcaggaggaggaaataaagggtattcaattaggaaaagaggaagtcaaattgtccctgtttgcagatgacatgattgtatatctagaaaaccccatcgtctcagcccaaaacctccttaagctgataagcaacttcagcaaagtctcaggatacaaaatcaatctgcaaaaatcacaaacattcttatacaccaataacagacaaacagagagccaaatcatgagtgaactcccattcacaattgcttcaaagataataaaatacctaggaatccaacttacaatggatggaaggacctcttcaaggagaactacaaaccactgctcaacgaaataaaagaggatacaaacaaatggaagaacattccatgctcatggataggaagaatcaatatcatgaaaatggccatactgcccaagggaatttatagattcaatgccattcccatcaagctaccaatgactttcttcacagaattggaaaaaaccactttaaagttcatatggaaccaaaaaagagcccacattgccaagtcaatcctaagccaaaagaacaaagctggaggcatcacactacctgacttcaaactatactacaaggctacagtaaccaaaacagcatggtactggtaccaaaacagagatatagaccaatggaacagaatagagccctcagaaataatgccacacatctacaaccatctgatgtttgacaaacctgacaaaaacaagaaatggggaaaggattccctatttaataaatggtgctgggaaagctgactaaccatacttagaaagctgaaactggatcccttccttacaccttatacaaaaataaattcaacatggattaaagacttaaatgttagacctaaaaccataaaaaccctagaagaaaacctaggcaataccattcaggacacaggcatgggcaaggacttcatgtctaaaacaccaaaagcaatggcaaaagaagccaaaattggcaaatgggatctaattaaactaaagagcttctgcacagcaaaagaaactaccatcagagtgaacaggcaacctacagaatgggagaaaatttttgcaatctactcatctgacaaagggctaatatccagaatctacaaagaactcaaacaaatttacaagaaaaaaacaaaaaaccccatcaaaaagtgggcaaaggatatgaacagacacttctcaaaagaagacatttatgcagccaaaagacacatgaaaaaatgctcatcactggccatcagagaaatgcaaatcaaaaccacaataagataccatctcacaccagttagaatggtgatcattaaaaagtcaggaaacaacaggtgctggagaggatgtggagaaataggaacacttttacactgttggtgggactgtaaactagttcaaccattgtggaagtcactgtggcgattcctcagggatctagaactagaaatactgtttgacccagccatcccattactgggtacatacccaaaggattataaatcatgctgctataaagacacatgcacatgcatgtttattgcagcactattcacaatagcaaagacttggaaccaacccgaatgtccaacaatgatagactggattaagaaaatgtggcacatatacaccatggaatactatgcagccataaaaaaggatgagttaatgtcctttgtagggacatggatgaagctggaaaccatcattctcagcaaactatcacaaggacaaaaaaccaaacaccacatgttctcactcataggtgggaattgaacaatgagaacacatggacacaggaaggggaacatcacacaccggggcctgttgtcgggtgggggcaggggggagggatagcattaggagatatacctaatgtaaatgatgagttaatgggtacagcacaccaacatggcacatgtatacatatgtaacaaacctgcacgttgtgcacatgtaccctaaaacttcaagtgtaataaaaataaacgtgaaaaaaatttacggtacatcaaaaggaagactctttttctaacccagagttgtttcattactcagagcttctcaaataatttgacagatacagcaaaaaattatttctaaaatgttttctatcacattaatcatcagaatgattaaacaatatgttaagatatttccaaaatgcttcccacatttgtaacacgtaacactcagtgttagcataaacttaacttttaggtctttcaggtgttagtctgaaagttcctatttctttgctcacttctatatttaacataatttaaatttttgattatggaaaactacatttgcatgtgccctctaagtagtttgattgtgttgaaatatagatgcttaagtagttctatatcatagcagttacagtggtaaacatttagagaggacttgcgtttgccaggcaggtttggagcactctacattgctggctcattaaatagaaccatcttgtaaaagatcctgttttcatcataatcacatggtttaagaaatagaggcagaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaaagaactcaaacaaatttacaagaaaaaaacaaccccatcaacaagtgggcgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttctacactgttggtgggactgtaaactagttcaaccattgtggaattcagtgtggcgattcctcaaggatctagaactagaaatactgtttgacccagccatcccattattgggtatatacccaaaggattataaatcatgctgctataaagacacatgcacatgcatgtttattgcagcactattcacaatagcaaagacttggaaccaacccaaatatccaacaatgatagactggattaagaaaatgtggcacatatacaccatggaatattatgcagccataaaaaatgatgagttcatgtcctttgtagggacacggatgaagctggaaaccatcattctcagcaaactatcacaaggacaaaaaaccaaacaccacatgttctcactcataggtgggaattgaataatgagaacacatggacacaggaaggggaacatcacacaccggggcctgttgtggggtggagagagtggggagggatagcatttggagatatacctaatgttaattgacgagttactgggtgcagcacaccagcatggcacatgtatacatatgtaactaacctgcacgttgtgcacacgtaccctaaaacttaaagtataataaaaaataaaaaaaagaaaaagaaatagaggcacaaagaagaaagtaaatttgctcaaggttacaaacagctatcaagaggttgagtcaaaaatcaaattgaggctgactttccagagtccacactctacaccactacatcttatgctattttgcaaggattacaagaaattgaaatcaaaggtttatataaaatatggtttgcacacaatattgtatactttctataattttattaacttttaataaattgtagtctgaactgactctatgtgtacacttgacactaattattttggaaactttcctagcagttaccctttatcatctttggggcatatacaaaatgttaaccattctacatcaccaagcttctccagcatgtttatcctagtgttctgtgctttttctcttttacctactttccactatatcttcccctcagacttttcactgtgcctttgaaacctctattttacataaaacaatctttcctattttatcactttgttgaaggagcccatcatcactttacctcaacgaaaatagatttaaatggcttcataggttgcaccaataggatgcttttccaaattcctcagctcacttaacttcagaaagcagtgttagcacctttcttgaaaaccattagaatttccaacccattactcctccattctaaagtagaaccatctctactttggtgctcacaccatctgactattcctcctgttactcctccccatcattaataactaaaaatggcatggtctttttaacatgtaaatgaagttagttaatgaaatgacttcaattcaaacaagcaactacaatcaagtaacagatcccaaataaataataccttcatctttcatcaatcttgttattaaacaggctttgtcatatattccctctacatgtctggacttcagcttgagcagattcataactttccagtcacttagagttacaggaataaatctcattgtggatatccagaccattttcaagttcagaatatccagtacagcccaccaccaaaatttaagttacttatttaacagagaacttttctgatcaccccaccttgaactactagaaaagaggaagatgatccactttttcacctgcattctatctgcttcataggtctttcttctaggttggggcagggatatgaaagtgggttacaggaaaaaaagcaaagttttataagactggtgacttctatgttccaggtgccaaaatactggacttctaaattgggactcattagaggattctttggaggtcctcccatggggacatcccatgctacacagatcattgacataggcaattgctatttgctttctgactaaccatttgcctcctgccaccacctcacatttcagtttatattcttggcaaaacagctgacatcctattaattcttaatactggatcccattgccctagcaggcagtcatcatataaagggttctattatccttctacttcatcagtctggcccatgggaagctcatgtacctttgacacaccaaattcttgttgtaaagaccactcttactgctattctttctcactggcctaatttaggttagcttaaccagacttctacctcccaaatttactggagaagaaacaaacatctgattcagtggtcttgcatgtccgcaaactccaaggaatgcacattaatttatttcttctcttaccttacatctaacccatggaagtacttgatatattgctgaaaaaatatcaaaatacgaaaataccactgcttctttctatgagtcattgctttgggtccaccctcatttggctaaggagaagcacacacttccctccacagagtaaaaaccctgcagtactccctaccagctgacagctctctgctaatgagtcatctggtcttctctaagagagaataatagtggtgattcatagtggcaggactgatgctgccattattacaagtctgtggtgaatatgtctaacacttctccaaagaatgtggggatacttatcatcaatggcactatgttttggggttttaaagataactatgattcaacaatggaaacctcatttcacattttttaactcctgcattttttgaagttttcaattactggttcacactattacaatctgagacctgttatcatcatcattcttgtttaatttatgtttattaaatacttattgaaggcatactatgtgccagcgttggtggtccagcattaaaccagacagaaatttctgctctcataaggtttctattccaatgatgttaaacaatgtaactaagacatacggcattctaaatttgtccctttgattttctctactgttatttcttccagtggtcaacatttaaaggtttccctgggtcctatttctttccctaccataaaattctattaatactgattttgtaagttttttttcatttgctattgtcatttttactaccactactatagtctgaagttcacctttgtaattttattccagaattattataataccctcaatctcctttttccatgcagtatgctgctagagttatcattgtgagcacacaaatatgtccatgtaaatcgtgtgctcattaacatctgttctaattcattcattcaaccaatagttattgaggaactcatatgccaagtattataaatctttattctataatagtgaaagaaagagacaaggcttgtaactatgtaaagtttatattctagtagaaaaatataaacaatcatcctataggatcagaaaaaataatattgagtgttcacggaaaactctgttaaagtgacaataaaacaaagacctaaagaaagtgaggcagtaagccatgaggatatctgaggggacagcatggcacaaagaaggaaaaatgacaagcgtattgtcccttaccagtaataaacttgtctgggtaaaggggacagcaatggctagtgcagcctaagtggataagctatggagaaaaaggtagaaggtgagttcctagaatcatcgtaagggaaggaagtaatgaagagtctcagaaaccactccatgagctttgggaattttattgtgatgggaagctaacatagctttaaggctaaatgtaacatattgcaatttacatttcataaaacctgtccttggttcatagagactggacagatgagaaagaatggtggctttaaacacagtggtagttttggaggattctaaataaattgtgaagacaaagccgaattatgactttaagtgtttggcttttgagaagggtagcatgaagtagcccttaactgagaggggaaaatagcaggaggtttgtaagagtgatagagggaatcagaagttcaatttttaacttgttatgttttaaattcctatcagatatacaagtggacatgtcaaatgtttagtcatatacacaaatctgaagttcaagggagtgatctaacctggaaatataaatttttcagttattattatttaagtagaacttatgctgtgaaatagattgggccatcaagggcctgaatgtagatagaaaacattgcagggcccacaaaaatgattcatccaacactgtggcctcccggttccttaatatcatcaattccaattagcctcagtccctctttatttcatcacccatgtctatgaccacaatctggaatttactagtacctggaaatattttggttctgaaatgcttaaaccaagcacacaggtaatgacaaaacacactcaaatcttatctccttaaaataattgtgcctcaatcccatctcctctattggctattgcttcctctgacttcctgcataaccaagctcttaaaatagttctctacagtcactgaatacagttgttagtcttccatttaatctctcaggcccctggaaacttgattttacctaaattactctactacaattactctcaccaagataatttcttcttgttaaatacaatgaacatagtttgtgaactctcaacatcatgaaactgctaataaccctcttgccatcctctctttaacttggcattaatgattctcacatttctggtatcccatccttggacccatctctgttttgtcttttttgaggcacattcttcctctgacctttacttaagtgcttttctttctcaggctttattctgaactctctcatcttataactctatatacatgttttttgggaggatgatgtcatcaactccaatagctttaattaagtcttctacatgtccaaataaatagctttaaatgagacctcacctttaaatttccaaatcattcatatattcccaactcagctcaacttaacatgtctaaaactgaatccctcatttcccccttgaaaatgctctatctcgttggtttcttgtcacgatgaatggtaccttcatccactcaattgccaaaccagaaagttccaatatcagccttgacttctcaataggcctcagtctgcttccaaacaaccacctattcttgtatgttcaccatgttctcagtatctcatgagtcaatccattcttctccattcttgttgtcaccttacaggcttttattaaccatctaatttttttaaaaaataatgtcaagtttctcctgtgatattgccctcagttattgttataatctagggagacagacaaaaaaaaagtcaccatgatcattttcatcactatcctttggaagaaagactgcaagtcttttcataggtctctttgctttagtcttttctctaattcgctctccaactggtaacaagaaaatgtttctaaagggaagatctcgttgactcttctgtttaaagacttcaatgcttccctttggtctttagtataaagtacaaattccttccatgtaatttatcatattcttgcccaggcttaactttctagccttctatctcacctttatctgccatgcccaggttattttatactttactacatgacgttattttctcattttttacttatgcagatgctgtttcctctgctgaatataccatggtccccccatcacttggcgaacttcaattcattctacaattggcaagaaataaattattattttctatttgccttgcttgtttctccagcccctttctattcccatcaattgcattatgtgatactcttacttgctttcatctcatcttgtgcttacatgatattataattggtttttgccaaactgttcattcaagtatattgtaagattctgaaatgagtaactgtgtattgattatcagtgtctccaaaacctaaccaaatgctatagtacagcctagcacatagtgtacactcaaatatatattgaatttgaaataaacaaataggaaaatgaaaggaaataatataacaatataaggttgaaatacaacaatataaggttgaaataatttaaattaggacacgattcagattaatattattttattatcttatctgttgaagtaaatgagtagaacattgtcacttttgaataatcaaattaaaatcagttttgtagatttttaaactctaagaccatttacaatttaaaatatatataatttggtctaaacagcacactcagaaaattgaaattgttttaaattctgtggtgtgtttatctaaattgctaaggaccatcaggaagacaattaaaatgagaacagaaagtacaattctgtttcctcagtggggaaaaaaaacctaatagagcttaagaatgttcaggacagtgtgcatatcaagcccaaggatatgaattagatgggtaatcacttattcatcacactctagaaataaagagaaccattagcatttaggaaaaaaactaaacttagaacatttaaaagtattaagttctatagggagcaaaatgtatagatcttattattccaaagaaataaatagaaagaaaacaaggaagaaactgaataccttcagtggtattcttgctataattactatatgaggcaatgaagtagatttaatttaaatcctgataataacattttgtaacatacaatgaaacatcttcacatttgaccaatgtatgttacaacgaaacatgctctggaatgtctcatgtagtctctttattagatttttgtcaatatcagcccttaaaaaacatcagaaataataagaaagtaaatagctacataacaatcaaaatattttcctaaaccaaattgcaaagagaaacacctttcattgtgtatatacagactctgcttgagtctgttatcactaaacttaactcgtatggccaagctgatccactaaatcctacctgttgacttacacctagtccacagtctacagacaattctggcaccagggcaggggttgtcttaaaaattacacctctctcctactggctcatgggttcaacacaagaagggatccttcacactgctggttacacactgacctgcacaactacagctctccagatagcaggttcatgctttacagatacataacagagttcatgcattgcaccccagtacttcagtattcaaagtcctcttggccataggtaccagacatggatatactttaccctggccttgccaggggttggctgacaatgtggggcactttgattctttacagttcccaagttttttacattttaatattgctcatatttaaaacataaaacactatgacaaagtggtatatttacaaagcactatttaatttaataacgaattttgcactttcaattttgattatctagtttcttttcctttgtacttctatgtaaatataaattctatgctcttatgctggaggttaatctgtgatcaaatttttatgaatggaaacatatgccaaatatagaatatcttttgatataattttcaaagacagctttaagttaatatttaacagatactatttttttctccaatgataaaagcatttattttctaaaataattatgtgatttggaaaaatctgcaagttgtgtttgctgctacaattaatttacagtttctgaattaaaatccttttcagaaacaggccatttgtaaaattttgaatcacccttgaaaatcatgaatgagtgattttctttttctttattaacattaaaactgagaattttcaataaaatctattgaattttcaataaaatctatttaacacttattgttaaaaatattaatacaaaattctcctagagttctcaaatttattcttaccagatatgcaaatttacttataatgacatttgcaaatttgacacaaccttctatatatgccttaccatttgaaataacaaacttcactcttttttctaatgcttcagaaataacatttatgtgtacccacagcaaaatttgcaattttaaacataccattaacatttcaatatacctctgagatttctattacactggcaaagaaattacttgacagctatgcatccttatgagagatcattcactcaatacttgatgtattctgttcaataaatgaaaaaatataagactttgaatttcttaccaatgaaaacatcatcatagaatggtttctagaaaaagcatagcttttgaagtagacaatagtattttgatgatctattaaaatgacattttttagagaaaggaaaaaatacactttgggaggccaaggcaggcagatcacttgaagtcaggagttcaagaccagcctgaccaacacggtgaaaccctgtatctactagaaatacaaaaattagttgggcatgctggcgcatgcctgtgatctcagctactcgctaggctgaagcaggagaaccctttgaacccaaaaggcagaggctgcagtgagatcaggctactgcactcccatctgggtgacagacagaacaagactccgtctcaaaaaaatttttttttaattttaaaaaggagaaaattattttaaaaacttgaaattgatttagattatgtataatttaatctgactttcagttttctaacttggaggcaaaaacaatagcttcattcattgctttattcttaaataatggaagtaaccctagatactattgggctaaatacctagataccttagatacttagggctaaagaaaatgactgttacatagctcccggcagtatgttctagatagctccttaacaatgggagacactaaattaatgtgtactactgaacccctagattagctaagcccttatgcactctgaaatgttcataatgttttccactctacaaaatgttataaaataagcacaatcattgaaacttcagaaaacgtaagtataaaataaccatcatggtatagcacagccaagaaagaactatcctcttcacaatattataagttgttttaaaagaaaaaaatctatctatctaagtatacatatatagattgatatactatacacacatacacacacacacacacacacacatatatatatagagagagagagataaagttgtataactcatgcctattcacttttatttattgggaatgacattgatgtcgtttgccttcaggataccatttttcctttctgtgacctttattttctccctgcaaaaggattttttcaacaactaggccacatacccattcaatctttcatgtttagaaacatgctttcttagagggtatgacaaactaacttattttaacatgtaaataatggataagatctttatcagtacttagcagaagacagatattttattttgctttgaacaagagacaaatcctttgaaaccaactaatctctaactgtagaattcttccaggaatcagtgaacagttgagggaagtattttgaaggtagtagatctacttttctgatgtaagttgaattctatgggcaagcactgtgcaaggcagaagggtaaaattacatcacataagcactcacctgaaatacttaggtaaaagactggccattaatcctgtcaatatactttctgggttgacttacatttcatcttgccttacattgtaatgtaataggtctaggggataaatacaagcagctgtctgcagccaatacatttttccacataaatacttatgataaaaataaaaagaaggaaaagaactataatacattttttagccatactttaggagcaacttgatgaaaattagataacaccgtgagacatatctgagtgagaaagagctagaacagaaagttatctctctaacaactcactggtgttttaatggagttaaagtacttcacctacatgcctatgtgaagaacagctaaaaagtgataacactgagttctgtatgttccacattaaatttcattttgctaaacaaaaagcaagtaatgacaaaaatgtatgcattgactatttgttgatataagttgaatctgtcttattactttagatatactttgaatttattttggatctcaagcatgaagtcatagggatgtcatctctatcagtgttttctgaaatctgacatcacagaaaggactaagatgttccaataatagaacatcaagcttttgttgctgcttgtaaattataattcatagaaactttagaacactttataaactttaatttcctggaagcttcctgaattaagtagaaaagaacaatgtccagagtcaatactatttatcacatggacataatttttctcagtaactagaaaatatattgcaacccaaatactatactcatatttagaaaaacaaactctccagttagtagaacataaattactgagatattctaataaagattttattcctatttttaaagccaataaattgagataaatttttatgagttgttaaaactttttaataaaaacaccagcccacacctcaaagcaatttcatacttctgttattagtttctataatagctgtatttataaaaagtacctgcatatgacaaataatatacaagcaatcaactgataatctggtgtgtacacaattcaattcatcaatagttaaatttaatgaagaatctaacttaccggtggatcagcccccttagaaccagccagccctcctgttagggattcgatatcctgaaaaggggagaggtgttgattgtaaagtgctactcaacagcatgaagaatcccccagtcccacagtgtaataatttatttagctgcaaagttagggcatgtcagctattttattatttttttgcaatcttggacactgtagtactatacaaatagtctacatctaaacatctagatattctctccaactctggaagtctataaaaagaaaaacatgtaaacagatttttttaaatatgcagaagtttcatctttgaagagctgaagtgagagcagaaaaaagaaaatttaagaaaacttcagtttaacgtactattttgaaaaatattaaacccatggaaaatgtttaacctaaaaatatttaatttttttttattttttatgaatacataatagttgtacatatttatgacatatgatattttgatgtaagtatttgatgtgtaataatcaaatttaagtccatcacctcaaacatttatcatttcattgttttggaaacgttccaaatatgctcttctggctatcatgaaatatacagtaaattattgttaacaacagtcgccctattgtgctactgaacattatatcttattcattttatctaactgtagataaaaatattaaccaaatcttcttttttcaccacctcccaactagccttcccagtctgtggtaaccaccattctattcactacctccatgagatcatttttttttatagctcttacatatgagtaagaacaggtgacatttatctttttgtgcctggctgattttacctaatattctccaggatcatccatgctgttgcaaattttaaaaattataactatggtctactctatttctacacatagagtataaaaatataaagagatcgatttttaacctttaataggtaaccacagaaggtcatgcttgagtaatgactatagttgttaaatttataaatggggaaataggaaatggtgtgataagctgtagaggctgtgacctgtttatagggacaactacaactcagccctatcagttctaaggctttggttccagggttactaatgattatatgacttattcaaaagaagttgcaattctaggttttaaagtaaaatcacccaggtttttagtgtttgcaactgatttaagttgtaaaccgtccctcatccctcccaaatgaaaaaaacacaactctctgctaaaaggctgctggaaaggagttttgggttaaatcgaatggttacacttcttggctaaaaatgttctttcttatgactctgatcacctcttatctgtttgcatctagttggaaagacagggatgaagaggggggaatatagttgcattaagaaagcaaaaaagaaggataattaagtcccaattgaagtaatggaaatttaaatgcctatgatgaggaaaaaggccaatattttgatataattaagaggacttatgctactaattcacttaggacttaatcagatgattttccccttatattgaaaaagggaggactcttaataatacattatggggctgggatgagcatgtgatggaaacgttcaaggaaggggacagggaaggatggtgttataactgtttctatctgaaatgctaactgtgaaaaggaacataatgggtaatgaatttattcatgcatagtctattaaaggtcacaaatgacaaggagtacttaccaagaaaattattaaatggtctcctttctaatggaaatgtatatatattttttctctacccagaatccttttgagaaactactccttcccctctcccattctagctacaaaagaggctaacaaaaattgcttcaaatattgtagggacctgccagagaattaaggcaatatagaatctgaaaaacataatggtagagtttaagtccttgattgtatcatttgaggaatgtttgaaatgagatgttctctctgcctgcaattcagcttaaaatagatttctggctctgaaaagtaaaaatatcctaattatatcggcattttttgggtctgtttgtaaaaggcccaccctctccatcctgttcaaatgctttattccaacatcatgcccaacataaaaaaaatcaactcatctaaattatctgatcttacatgttctttagcattcttattgtcacttaagtaaattttgtctttgtataattaaaacaaagcatcaaacacatgtataaattgacaaggaatattaatatccttatcaaatccaaagataaaacataacttaaaattgtcttaaaatctcatggaatgaacaacattaggtagtaaaatgactaaaatattagatttacagaaaataaaacacacagcttgcactgtttgataatattctgctatgaccatactgaaaagtttctgttcatgtaaaatgttatttccaattatacttaaaatgaaaaaaagataccaagtgcatttggagttaatacatgtctttctttgtagaaaggcatataagttatattaatgatataaattttaatgaagctatcagagggataatagagaaactgatgtggataacaagtattttagcaatttagtcaatgcattttctcatattttgtaaagtttgatcattaagatttcttatctaagtaagttgtgccaagtttcagatttttaaaattttaagctctttgtgattatcatgtcttgagaaaaaatgagaaagaagaatgtagaagatgaatgaaaagggcaataaattttgtagtttttaacacattgaattcaaaatcaattacgaattcatggctctaaatagtatacagatgtatattcttatctctaaatgggtaagttgtaaattgaatgtaaatcattcaattgtaaaaaaatgtttgagttcatgttctattttgagtgtaagttgaaaaggagtgtcctacttggagagaggtccaagttaaacacggcttatcagttcatgcaaaaggaattttctcaggtgtgcataatgaacataagtgtgcatggatacatttatgttgtaaaataatagataaaacaaatacttgaggaactctggacatatgattactacatagctttcaaatgataactaaaagtgagtcaatatttttgatggttgttgaatattttatctgcaaagtataagtaaaatctttggcaaatgtgtctattttcttatttcaatatattttatatagataacaacaaaaggggacatcaaatagtataaacattgacttcctagaaagttttttgacttactattgtaaaaatattatttgtttaattaaaacactcaaaacatcattttatttttaactaggctacagaatttatttaaccatattgcataccatattgaggtcatcatttgtatctaatagataataaaatagctactactcagtgaacagttgctatgtgccaggtacttttataagtgctttgtagacattaatgccataataaacttatgttagttaattattttctcacttaaaaggttagatagtttacatgactcatacagtatcatagagctattaagaaatgggttataaaacatatacataggactccaaacctgtatttttttaattaccagtcctagtgaacagtttcaccctggtaccctggtgacactgcacatatctatgttggcgatgcaggtaaggctaaaccacaggctggtaaatcttgatggaatatcccgtgactctcccagaacatgacaaaggaggcagtcttatgaggagcttttacatagctatttcttatttgcctccctcacactagtgaggcatgggacttcccacacctcacacctccctacaccaggtccatcttcaggatatcaaactacttaggtgcagtatggaattggctcctacctaacaatacagcccacttctcttgttgcctatcatttgacccatccagttcagtgttgtccagtggaaattgggaccagggtcagaattagagcaggtaagtgaggtgcctatagtgcaaaatttaagtaggtgctggttcttagggtcatacaactgctgacctgcacttgtataatcttgatagtgagcaccttattaaattttgtgccctaagcacctcacttgtctcatctgaatcctggcctttctagggacctgaggagctgaaacaatggtagccttctttatgctgactgtgtaagtaacaaacataaaaccatttggattcatcgtctccttatcactcgaatctgtagaagtgtagcaagcacctacgccatgtggttgctcagggactgcatgctgcttcacactggtatcctcaatcatatgaatttttatcatcaatgctgaatgaaataaactagtatgtattaattatataagaaacttcatttcttaaacatcatttcagataatgaaagcttcattttcctctccaaggtgtgaaaaacctaagtggggttattagccagtccttaacacagctgtgcagattcagtttttcaacactggaaagttctgttcctggcatgaaaacccagtaaaccaaggatggccagtgaatcagaagtcttaaagcttgggaaggttgagctccaggaagagtgaggtgatcagtgtcagagctctaagtagagtgagacttagggcattctcagacttgaggagtctacattgcactgcatttgtaatagtggttgttcgcctgcacctttgctccctggcctcctgcttcaagaattggcatatttttcccttgacaaacactttgaatgatggagctatagggattaataatgtggctctcagtgtaagccatcaagttcagatactgtaagtcttgcttcctttgtgtgcaagtgaaaaaaaaaaaggatattaggatttcaggtctttctcagagctgttgctggattcttatttttatccctgaagagcaggatcagccaattatgttaaagaaaaatatgataaaataatttggctatcgaatacagtaagaatgaacaaataaaattctaaagagttagttgactctcgcatcgcatatcccacaagacccaagagatcttcaaacctgagagttatatttaaagttaatatcaggttttaagctttcacttgttcaaaaagtcacttaatgtaatatgaaaatacttaaaacattataataattgtcaattatgggcattttaaaatttcagatttatgcattgttatgggttaaattatgttccctgaaaattcagatgttgaaatcttaaccctcagtacctaagaatgtaactgtgtttgaatgtaaggtctttaatgaggtgattaagaagattgatccaatatgactggttgtccttataagaagcggaagagatagcagggatgtgtgcacactgagcaaaggccatatgagaacacaagaagaaggcagcaatttctaagccatggagagcaccctcagaagaaataaaatctgcaaacaccttcatcttggaattctagccccagaactgtgagaaaatacatttatattgtttaagtcactcagtctgtggtattttgttacaggagccctagaaaactaatgcatgcatatttgtaatttgggactagtttttagattctttgggaaaagttaacatatttcaatatagagtacataagagttcattaagcagtctataaaaaaagtcagtatcagtggaatcaatgtgaaatagtaaaatgaccatttctgtcaaatggttatatttaaaattatttcaagtctttaaaatatttaatgaagtattatgtatatgttaaaacttgacaaaatttattgtattcaaaatattgaaattaagcatttctctcatctcctttatagaaaaatttctcaaaattcccctctcccactactttctgttgacatgccctattgtgcccaccacatcactgcaactcctcttatcaaggttgccaatgacatcctatcgttcaaatttaatttttcatgttctgtcatcatatttcttgatcgctaagcttcagtcgacacagctgactactccatctttattgaaatacttttcccttttggctttcatttattttcacccgctacatgattttatttagtactgtggctctaaatataatgcatgttgataaattttgaatttctatcttcagcttcaacttatcctctgagatccatactgctacttcaatctccacttagatgtattatagccatgtaaaatgcaataatgcaaaattaaactcttgattccatcacaactcttcccttaaattaggttcccatcccagtgattgccatcttattaaatgacatcaccattcacccagttgctcaggtccaaatccatcagcaaaccccactaagtctattgtaaaaatactacttgaatttgactacatctcattaccttcattcctgtcatcctaatcccttgtactatatcaataatatctatcacataaactgaaaaaaataatatatatatatatatagctttctaactgttgtccatgaatttgttatctccctctcccctatatattctccacatagtagcccaactatccatttaaattttaagttagatcacattgctgtcttgaccaaaaccctaaatggtttcccagcaatcttaaaacaaaacacaaacttattgctatgctctgccatgccctgtatgatttggctcttggctatctctctgactatatcttttgccgttctccctctgtcctgccttctcagacacaatggcgtccttattattccaaaaaatattcaaaatttggcttgtatctcaaggcctttgcccatgcttttcctgcttcttagggtgcttatttctagatgtcctcatccattttgtgttgctataaaggatgacctgaggctcggtaataaaaattaaataaagaaaaaaaaggtttatttggtgcagaattctgaggccagaaagttcaagattggacttctgcatctgagcagggccttaggctgcccccacctatggcagaaggccaaggggagccagctgtgtgaaagagtgaggaggtgccaggctctttgtaacaaccagctctcatgggaactaataaagagagaacccactcacccccaagggagggcattaatctattcatgagggatctgtcccatgacccaaacacctcatagtaggtaccatttccaacattaggtgtcaaatttcaacatgaggtttgaaggggacaaacattaaaaccatagcagtagatatcctcctatttaactcacccacttcattcaggtcttagcataccaaaattctgaatcaccttccaaaactaattatctaaatcagtcaaggttccacctgaacaaactgacaaactcggagactatacagaagaacatttaataaaggtatgatttatagaggtatggatagtttacagggtccagagaaatggtggtacatggggactagcaacagctagacattgcaaccacccttaaacctaaagaaggtgcaagaacaatgtagtcaagagtccagcaagaggtgaatacctatcatcagcctatagaacagcttgccacacagtggagactcaataactacttattgaataatacaattattgaatgaatgatgtgatactatttttacatatataaaaagctgaatctcagagtacatatggtgaagtgtgtcttatttttgtataactgtatcactttgaaagcatggctgaaagcaataatgtttgcacaataaatctttataaaatgcctgagtgaataaactaataaatgacttgccccaaatcacacagctggtgaatgcttgaaagaagctttgaaatcccaagtgttataactccaagcccagcatattttctgttccatcatatatcactaatgagacatcctcctgaaagaaaaactcctcaactctgtattttctcatctcttgaggtactaagtttctatatattacatggtttctagtgcatcagaaggaaaaatgcaaaattatttaatagtcaataaacaatacattaaattcatcctctggttaaatactgccaatgcttccaattaaaggtctgacaccttaatcattgtacaatcaataaatcaatgcttgaaaatttgacctaacatgtatgtctggcattaataaatggttcaaatatgttaaactaaaaatcaataatgtttatttttatgtaacatctcatagtgtgttggttcacagcactgggaataagtaatagaagataaaatttattttaaacaaatcattcactttttcacacaaggcttaatggaaacaacctttcatcaccgaataccagctccttaaggcaagcatccaaataatgaagctgagtttgttaatgaggcatcttcctcctcaaccagacttaagcagttagtgtttccttgacaacattatagggtaaatttcctgggaggcatagaataagcaggaaacatacagaccaattttataaatttttcctatgtaagccaaaaggtgtcctttttaattattctttaaaacaaaaaaaggggaaatatctctttctttactttgagtataggccagcctgaatctgaattttccttaagccacacaattaattccttcaaaaaagagcagttgagcaaattttgtggctgaggcactgtactcttcatgggaggacacaatgaggagtaaatcaaggtcacaggtttcatagtattcagagtcatgacatgctctctgactttaaggatttttcagtccaaaagcacataaatctgcagaacaacatgaggaagaattttgagaaatgtggtgttaaaattataacagacaggggttgtggtgttaaattttatagtgtgacaattagtttgggtatttcatattgccagattgtactttatttttgaatgcatattgggtaagtgtctccaggaactggttgagtaacataataattaacatttattaagcatttactgaaacacacaccatgctaagagctctactgccgcattaggtaacatcgtaactctcttagccattattatttccaccatttcaagatgatgaaactgggtctttcagagtttaaatgacttaacaaaggtcacacagccaataagtattcaaaccaaagaggctgattccagaggcaatgatttttaacaatgatgctctcttgaatgaattgaggtatgagaaaagagtagggagaacttcttggcatgcatatggtgacttggaaaaaaacataaatacttattcactatctgaagaagaaatgcaacaaattgcaggcagaataattctgaggtggctgatatcctctgatgggaggatgattatccttgattgacctgtaaatgtaagagctgagaacatcagatttagccaaaaagtaaaattcccaaaatcttggctatatatttctaatttcaaagtcttctacctgaattcaaacctaactaggaaatataatgtgtatcaaaggcacaagtgtttcaatagtgcataagaatagggctttctgaagaaagtgccagagattcaggttctacattttccacttcataaattttgtgtgtcgctttttcttgtccattcctttccatatggctgaggcgataaagggaatgttttgctaattcctgactcagtctcaatcaatttctgttttccaacttttccacactgatgcatccttgctatctcaaactcactatatccaaataagacatcatcttctttatcagccattgccatggccaaccgccaatttcctattcctgttgatgttttcaataagcagttagttatccagtctaggtttatggatgttaatagagttttcccttactctggtatgcatattccaatccagtctagttttccttgtaaatatctgcttagttgattgccttctttcatttaccattgcatttaccagcttagttcaaaacctcattttattttcccctgacccctggctttttccaaaacagtgtctttgttgagttcctttttccactctcactttcatatcatcttttcttccaaccagttcccaaagtgtggcctgaggaccaccaccagcagcagcagcaacatcacctaggaactcataagacatgcaatttcttgggccctacctgaattcggctgcatctgaaactgtttaacacaccctccaagtgagtctgatgcaggctaaggttggagaaccactaccccagagtgatgtattttaaatgcaaatatagacaggttacttctgtactcaaaatacttaagtaaggtccccattcccaggaaggaaagataatcaaacctctgtacatgtggttttccattgtcatcatacatttctgaactacttttttcacttcaccttttaccactttccaaaaaagaaaccctgcactcttatcataatgaatcctgcacttccttattgtgacaagtgttttcttttatgtttctgcaccacggattcttatgtctagaaagccacccctaccttgtgggtgaatgtaattcatcctttgaaactcagtctaggcaccatctcctctggggaggctttcctgagtccctcagaccgaagggagggttctactctagcacaacagaggtactgtcccaagaaactttgcctgaggggtagtcaacagctctccaattttacttcaagcctgcaaaatgtaagacacatgcaaaaatagacagcttagtgatccagagaacaggttcaagcctggctttactacctactatctgtgtgaccttaggctaattgctttatgttctttacagaaaataaatcaatctatgtcctagtacacaaattagaaaggtttggaatatttattataataattaatattaattttaataattcatggaaagctacctattgataacttacagtaaacaatattaattattattattcatgtaataatacataggtacagtctagttacacatgtgtaaaataaagataggctatggatacagattacataaagatatatgttaaaacagataagcattagaatacatgtaaataagacccaaatatagactaatcttaggtataaatctccattagatttctagagattattttgcctgaaagggaaggaaacctaagattcattttatttccccacatagtcttacaacttttatgcatttctatggctttggttattaaacatttttcaccagtcatattaaagcatattattttcattcttcctaataaaaaaatgagtaatctttttgctgtacattaaaaactatgtattgggtaacatgtataccataaacccatacaaatttattcctctttaaatgtgttatttgatatcacaggtttatataccatgatgtgggaagctttaagtaggttagaaatgtgctatagccactgagaagaagaattcaacatttaaatgagaatatcaatattataatcctagatacacataatttatgggagactcacttttgtttgatggatcggaggctcaattactgtaattctaatttataattaagtcttcaattacatgatgcttagatcttctcctatctgacacaaaatgcaaacaaataactagaaaaatataataccacataatttaattttaaaaatcaggttttattttcaactcagtaaatagtagcctaaaatactggcttaaaaaaaaaaaacttggagattagcctatcggaagtgatttttgtaagagggaagaataaaatactgtcttttccaactgttaataactgcagttcctctgactgtggtaccttaaggcaatttatcagtctgattcataaataaccacaaggcagaattttttgtgaactgaaagcaaaaacagggcaagtggtttattaaatatatatatatatatatatatctgcttttaaaatagatacttctaataatagatatttctaatacatatttatttaaccgtatctctcccttactggaatttaggtattaagccaattaatataaacagtttcaaggtaatcataataagctggcaagaaaacagatgatctatattcaaattcaagttcacacttctagaaaaaattggcataggattttcagctgaatattaagtattttatggtcatatattaattttggaagtaatagccttggaggaattagatagagctagggggagagatgagatcttaaatttaaaaaaaaacagcaattagcaacactatccaaaatcagatatgcaaaatttgtgaaaggaagtctaatttggaacctaagaaacatgcagaaaaattccctttgcattgctgttttctttgggaaagaaattcaccaagttctaaatcataataagttaatttcaaatttattttttattttttagttcagtttttgaaataagtgatgatcataatgttaacaagaaatagcaaaagaacatatgatttatctatttttcttctgggcagctccatttcaattgatgctaccaggattctattatgaataaatgtttataataccaaataatactattgaatggaaatgtaactgactgatatcagagcataaaatgcattgatgttatgttattcaagtaattgagactatagcataatgtaggagttgtagagcacagcatagagctggagatttagagtcgatcatagaacattctatagtcattaaatgttctacagacagtcttgttctccttttcatccactcaagctccccctccccaaaatacaactaaaataaagctttaaagtttataatattctttcatttactgggatcaatttagaatattttatatccttatctctcctttccttaatatttctaggacatatttttcattacttatacttcctcccaaatgtaactgacagcattcaaatgagccacaccaccaggtaagaatttcaaagtgcatacaatgctaagttccttggggttagtgcagtggcaaagtctggatatttcttttgtttgagagcaatcaaaacagacgatacagacagtccttacttggcacagtacagtgttaactgtctttaccttgcatggctccatgaaatcagttactataaagcagggacatggctcccctggttctggtatgtactggtttcagtaaacacagtacagtaccactcaaagcaagaatatagtggcattttaatggcagataaatcttcatccctttgcctccagcataccttaaactggattgtgaatcttgaatgcatagtgcagtggctatgtaacacaatattaaaattggaatctttctcaattttagctttggtccaaaggccaaaaataatgtggtgatgaccagtatttccatatccttaagcaaggagctacatcaagccatgtgaaaatattgtaaaacagattctgccagaattgataaacattgtctcttaatgagagcattattggcaaattaggcaggaaatttcttcatggaaagtatactgaatttgaatttcaggatttttcgcatctttacacttaggcaccaaagtctattcctgtctcactcctcaccctcccactcctcctcccccaacacacagaggtgactattcctgaggaccagatttgagctgcagagtgggcagtgcatcttaaagtgcttgacctaagaggactgctagaaaagtaaagcaacgtggcccatgggtaaactactaaattccattccatgtgaagagtatattaatttcctattgcttctgtaatgaatttccacaaattagtgacttaaaataacacaaatttattatttcacagatttgaaggttagaatctaaaaatcaaggtgttggcaggggctatgttccttctgcagacttcagaggagaatccatttccttgccttatccagcttttaaaggctgcatgcattttttggcttatggcctcttcctccatcttcaaagagcattatttcaatctctagttctatgttcacatctctttttctaacactaacccttttgcctccttcttataaggactcttacattggatgcacctagctaattcagaattctctctccatctcaagattcttaaccgacctaatgttctcacacccacaatgtcccaaaggtaacatagccacatgtcctgggatataagatgcagacattttgggggttccttatgcagcctaccacaaggggtaattaaaaatgtaagttagaacaggcttggcctgaatgtaagaataccttggattcaaaccaaattaaactttcttgaccagcccaggcaggagtgacctctccatccactgaacttccattatacttattttcatctatatattgcctgatattatcattctatgtgttttctttccacataaatcctaactctcttagcataggtttatccatacctctctatattctgtaatgtttcaataaatatgttgattcgagaaaaataaatggaaagacagtttcagtgggcagtttcctgtgtgtgggaggactctgccttaaagtatcctctttcagtacctgaaattccttttattatatactgctttctgttctgtggcattgaatgctcaggcacaatgacaagataacaccttattggaattagtcaccaatactaagtgaatcatttcaacagattttgcctgaacctccactgcaaactcattaggaggaagtatattaagttagtcattcttttattgtacagattgcatttgccaagtgtctttcacataagattaattcaacaaggacctattaatggataatagttagctaaaagcaaactttaattagctgtggaaaggagataagtaacttttgaccaggggaaacaccaagaaacagtatttagcaaggaagaaattgtccaaaagagaaagaagaaaaagataaattttattttataatattctttagaatgtctttggaaattgtgataggaagactctaaaatggttcctagtgatttctacctcctggtattcacacccttgtgtaatccccctctcttacatgtagatgtttaggcctagtaaaaatatggttaagtgttgggatgtcttcttgtctctcctgtgattaggttactatagactgactttctctcttcctctctctctctctctgacacacacacacatacacaaacacagacacacacacacacacacacacacaaaacctgtctgggggaagttgccacactgtacagcttatgggaagatcaaggtagcaagaaactgatgtctcatgccaaccactagccaggaaaggaagcttgccaagctcaggttaagtgaattcagaagttgctcctcccacagtttgagcctgagctgatgtcagccctagctgatactttgattgcagccttgtgagagatctggagtctgaggacccagctaaaccgtgccaaattcctacccacagatattatgaaataatataaattgttttaagccagtaagtgttcaggtaattatttacacaggaataaataactaattttagagtcaatattcatatatttctaatctgttattgagttttctatgttcaccatacaagtgctcattataaaataaaaatattttacaggttgaatctttttagaccaatgaatccataaaagaaataagcaattttcttcctctggattttatggtctggtattataattctaattacacttcgaaaagcaaagcgatgttagaaaaacaataataaatgatcattcaattgattgatgttgacaactatcaatatgaatcataaaattgtacacataacttgtactgtatctgcttccacacatattttcatagtattggtcaattttgaatgtataacaatcattaaatttctaagaaaaacatttttgtggtgataaattctaggtggagttttgataccctaaagccatataactatcaataaagatataaaattctatgacgaaaaagcagttatttttaattatttataaatagcttggcctagttgacaataatgtttaaaaagcaactaatttttagttgctgaatatatcatcacagtagatgatttatacttttttaaacctgaaatactttctaacataagtactccttagtcaatatctctgaccacataatgaaaatatctatccaactcatttttacctagtgttttggaataaatgaggcagtttaagtctcttttcaggaagcattataaagtgtataagagataatatgatatagtcttatatatcataaggttagatgtttgtccccacccaaatctcatgtcgaattttaatccccagtgttggaggtggggtctggtgggtggtgtttggatcatgggggcagatccctcataactcggtgatgtcttggtaatagtgagttctcatgagatctgctcatcaaagagtgtgtggaacctcccctctaactttcttttggttgctcctgctttcaccgtgtgatgtccctgttcccccttcacttcccaccatgactgaaagctctctgaggcttctccagaagccaagcagatgcccacaccatgctccttgtaaagcctgcagaactgtaagccaatttaaattacccagtctcatatatttctttgtagcaatgcaagaatggcctaatacagaaaattggtaccaggagtttggggcactgctataaaaatacctaaaaatgtggaagtgactgtgtaactgggtaacgggcagaggttggaagagtttggagggctcagaagaatacaaagagataagggaaagtttggaacttcttagagactggttaaatggctgtgactaaaatgctaatagtaatatggatggtaaggtccaggtgtcaaggtcttagatggaaatgaggaacttacaggaactggagcaaagtttacacatgttatgccttagcaaagatcttggctgcattctgttcctactatagggatctgtggaagtttaaactaaagagtgatgattagggtatttgatgaaagaaatttctaattaacaaagtgttcaagatgtggtctggctacttttaatagcctatgttcagatacaggggcaaaaaaaaatgacctaagattggaatttatgtttaaaaaaacaatgcataaagtttggaaaatccataccctggccatgtgatagagaaagaaaagagtttttatttttccaggagagaaattcaaggaggctgaagagcaaccacttgctagagaaatttgcataactaaaagggacccaagtgctgatagccaagacaatggaaaaaggcctcaaaagcatttcagaaaactgtgtggcagcccctcacatccatcacaggcctggagacctaggaagaaagaatggtttcatgggccagacctggggccaccactgtcctgtgcagccttcttggcatcctggttgctcctgctccagccttggatcaaagggttccagatactgctagtgctgccagatactgatagtgcaaaagccactgaaagccttggtggcttccatgtggtgttaagcctgtaggtgtacagagtacaggagtgaatgaggtttggtgctatctgcctagattgcagaggatgtattgaatagcctcagtgcccaggcaaaagcctgctgcaggggcagagtccccacagagagcctctcctagggaagctccaatgggaaaagttggattggagcccccacacaggttccccatgagggcactgcatagtgaagctatgagagagaggctaccaccctccagatcagagaactgtagatccaccagcagcttgcaacctgtgcctggagaagccacaggcattcaacaacctgtgagagcagcctggtgcttaactttgcaaagacacagaagtggagctttccaaggccttgggagtccaccccttgcaccagtttgccctggatatgggatacggaataaagattatttgggagctttaaaatttaatgactatcctctttggtttcataattgcatgaggtctacagcccctttcttttggctaatttctccttattggagtatgtttgcctaatgcctataactgcattgaatcttggaaataactaatttgttttttatttttcaggctcataggtggaagggaattgctttatctctgctgagactttgaacttttgagtttacactggaattagttaaaaatttgagggacttttgagaaggcatgattgtattttgcaatgtgagaaggacatgagatttgggaggggccagcagtaaaatgatatagtttgaatatttgtccccaccctacttttatgtggaattgtagtcccagtgctgaagatagggcctggtggaaggtgtctggatcataggagcatatccttcatggcttgatggtgtctttgtggtagtaagctcttgcgagatctggtcatttaaaatgtggcacctccctatcccctcttgcttgctcctacttttgccatgtgatatgcctgttcccccttcaccttctgccatgattgaaagctccctgaggcttcttcagaagccaagcaaatgccagcaccatgcttcctgtaaaacctacaaaactgtgagccaattaaactttttttctttgtaaattacccagccaggtatttctttgcagcaatgcaaaaatggcctaatacaagatactttttaaaaaaacaatataaattatttcccttttcataagcatttgcaaatgattcagccttactctgttcagaaaaacaccagccaaaaaataaaaatatagtttcattagcaaacttttctgctcaaatgatcatctctatacagcaattgtttttggcttcttctgaatgtttttgcactttatatttcccaactctggtttcctttggcaattccctgacctcatttcttaattctcagtgctatgttatataattgtctgaataagcagtatccccccaaaatgagacaaatttattgagaattttgcaatcagaaaatcagcaaaaaggctaatttaatattaacatattgtgatttttgtgtggtgtaattgagtgttggtattaatacaagagctttaggcctaggatgcctggatttgaatattggctctgacactgtacagatgtgtaaccttgggctagttacttaagagttttgtgttttaatttcccacatataaaacttacgtaacaatagtacctgcctctgatgattcttgggaaggtaaatgtgtacacacagcaaatgcaaataagggttaagtggcagtagcacaaatagcaatagtagcagcagtagtagacagtgaaatactgacttgatgtgctttgtttaaattttgatttgcacattggcaggaggataaatctggtcttgtcaattcctctactgggtctgtggctgcaggctcttaactctcatcatccagtcatgaagaatgtggtagcataatttcatcaggaagtattgggacccagtgaagggtgaggaaaaagactgacatattgcatatttgcatatttaaaccttgcatatttaatttacacacttatgaaggaacctagtcttgcttatgaagcaaagacataagccaagtttaacaaatctgacaatatttttacagatcgaatggggacctcattgaacagggtctcttatactcatcctgtgcataatggcctcagcgaaactttttctttattaaacatactgctatgttttcagttgttcatactttgcttttgattgagcagtttattaagatatgtgatgaattcttcacccagtaaaggaattaaagattatttgacacttccttggtgataggcagaaaataagttaacctattaaaatgcaatccaattagtcttgacctatatgatcccccgctactagatgaaaagatattctctgatccttaaaccttatgcacttgaaaagaaatagagtcctaccttttgaccttaatttcttttctcttgagaaataggtttttttgacatgtgaagttagagaatattaatcttaaactcaggtttgttatgagtctagaagcttctttgtcattgttgaaatgaatcatagacagacaatgcctaatgagagaaatggcaggattactagaaaatgtagatctccctgaatttctaaattttgcttaattaatatgtttaaaatgtataatgaattaagcataaaaagtaaaacatctttcccattctctttcaattgaaaggaattatcagaaagtgtatacactccaagtgacatatttctcagtaaatcttttttaggccctttaggctattctgattcattaaatgtcacacagtatgagaaattacataaattatgatacattatttaaaaacttatttagagactaaaattaagtattctatttataattcttttcctttgcaataactatcagctcagactggataagtatatctaattaatctgaggaaggaaaggggaaaaagccatggaaattaagtaagtcacatttaagattattaaagttttataagccacttcagctaaaaaatctatacaggaatatgtcaaactatttgatttagatttacattattcagagcaagacaattcaaattctttagtaataacattcgtccagaaactacaagatagcatagttttccttagtaaactgaaaatcaatcagtagaaaaacttttccaaaatgttacaaatgctcccatatgtctgtctccttcactatttagaacatttcctctagaccaagactttgctttgttcactggtctatttccaggcacctggatcaatcagtgtctgcatatgataggctctctctcaataagtagagttgaatgcctagatgaatatactatttcaattcaagtcaggctagaatgatcaatcaaggaaatatccaacattaatttttaagaaaacaaactagatatcatgtttggaacctgaatgcagtaatactatagccaatgtgataagaataatcctatacagacacatttgttgagcaatatttttaaagaagccacttaaaatgtagtaatataaatgtcaccatggatataagtattcaagaacagaaacattaaggtgacaaaagtaaagattccaagacttactctgagaatttctgattcgataggccaggagttgaaaaactttgtttctaagaaagaagatttattcatgtagaattgctatgagttgaatgtcccctccaaaactcatgttgaaatgtaattaccattgtgatggtgttaagaggtgggacccttatgaggtagtaaaaccatgagggttttgtcctcataaatgaattagtgctgttattgcagaagcaagtttctgataaaagtgagtttagccccctcatgctctcactcttaaacatgctttcttgcccttctaccttccaccatgagatgacacagcaagaaggccctagccagatgaggaccccttgactttggatttcctagcctccagaactgtaaaaaataaatttcccttatttataaattagcctgtgttatgctgttatcacagcacaaaatgaacttaagagaagaatggttgtgaataaagagccagaggaaagaacatgaagaattagaagtgtcaggaaataaatattttgtttatcatttgaagtaaaccctttgttgcaaatgagtttgcatatattttggccattccctatgcctgtggaagaagggtaggtatgagatgcacagtttagaagtgttactaatttcaacctatctagtcctttatacacacacacacacacacaccacaaacacacacatctagtggaaacaaaaaggttcattgatttttctcctttaaagtagtggttttgagtagactgtatatgagttatctattgtatgttccatgacaattaacatttgttgtaataaaatgcattttagcaaaacagactttattataagcgttggtagagctaagatttttactatctatgagtagctttgaaagcagacatttctactaactcagaaaagccttagatcacatatttcactatcaagtaatatgcagaattaggccatgcatctattataaaaccacagaaaaattttagaaataaaacattataggattaaagaaattgtaagaaattactaaaggagatatagagagtatagcacatttcatgtgatctactcatgtcctcaaacattagtaaaagataaaacaagatgactttaatggtgacttaaaattgatttgtttctataggggtttaaaagtttgatagtgttgagtaaagactttactctggtaaacattataccaaattattttgataaatatattaatacatcaaaagcatttttaaattttcatgatttcaatattgtacaatttttgcagagatatttgcttcttagtataaaggttttttcaccatttatcataaaaattttatgtaaccaaaattatgtagtggtaaaattgctttcttcatagtcatagtaatattataagctcttattgaagacatataaacataaaataataatatcctctctaaaacaaaaaaaaaatagcttctttcttgactatttgaattatatttaggttagttaagtataatctaaatgaaagaaaaaacaaattattgcattctaagattatgccataaacctaaatgtttgcttttagtggatttcatcaccatggttgatctctatcatataatattaagcaatttcaattattctctctgaatacacatgtcttaaccctgaatcatcctccaagtatcttcctatctctctagtccatgtagaactaaaagagtaatacacatttatctttctccatatctaacttattcaattcctaacctgtctctgcatccacatttctattgaatcttattttgccaagagtaaaataaccttaatatattgctaaataaaattcttactggatgttcatagtacataatatagttgactcttcaatccttgaaattttaacccatgaaacttgtcttcatctttcatgaaaatattggactttcccatatcctatgaccatttgtcttcatactgcttcatggatgcctcttcacctgagctcccctgaaatggtggtgttcttcagtttaatccttgaccatatatcttcatactctgtaatccttttggatgatctcatccattcacagagtcataatcactagcaatgatatatactgatgatggctaaacctttatctcttctagtgtttattttcactgagacacataaaatataatgttatatataaaatatgtaaatgaaaatatttttaaattagttactaatcaaatgcagagttctacaactgtatgtctacagctttcaaattaaaaaacaaaacttaaaattcccattctcatgctttataaagatttttgtctaccaaatataaaatctgtcataacatgcagaaaattaaatgatgaattataagaataaaatatggaacctggaaaccctctctgaccagaataggtttggtttttgttttgttttaacaaattccaaagcatatggttctgggaaatgtgtttccaaacaattttctagcattatttaaagattactagttccacttctggcattgtgcactatgtctgaatttatacattgactgcatacagtgtttagaaggataaaaaaataaaatgataaccaaaaattatcacagaaatattccagagaacagttaccaaaaaagactatggagaaaacaaaaaccaaaataactaacatcggttggatatacatattgattagttggatataaataaatcagttggttataaaattgagtgaaaataaaaattttgtgtggagataaactttactaagaatgctcatagtttaaatttcttttatttatatactataaaaattatttttaatgtcactgacaagttgcacccaaatttggattaaaaggtttggaagataaagaagaaacaaaccatggagaagtgagtaaattcggtaagaactttgaataagtaaaggtatacaagattttaagactgacagcttgggttccagaatgaaacggcttccttctgcacatacaggttatatggcaaattagcctctgtgaactgcattttctcatctgtgagatgcaggccatcatggtgcacaatacaaaggattgttggaaagattaaatgaaatgttacagtgcttgacatttagtcatcattcagcaaatgtcacctataactaagtgtagctgctgtaactgctgctattactgctcattacaggtgggaagttgacctgctgcctccatattagggctggggtcaaactgattcatgcatttagagagagttatgagggtaccatcttgaagaaaccacacaatgttggaacactgttaatacatccatccacataattttgatccctgagacaagaagaatttatggggttagaggcagtagaatttaggggttagagcctgggctttgtgtcaggctacttgggctcaaatcacggctctgaaactttctaaatgcattatcttaattaagttatgtaacctctttatttatctgtaaaatgaagataaaaattataactgactaaatgggttgtgaaatttaaaaagcacattttatataaatcactagatagtttatgagacatagtgctcaataaataaatatcaatcagtgcctaatattctactattctttctgtcagtatgttgtaaaaaatagtaatacagttctccattaaaactatacaaataaagcttattatttgtgtttcatttcgtcagtcacacaactgttctgatgaaccccgaactgaactctttgtctcatttaaatcaacccataagagtaaactatacactttatgggaagactaaaaaaaaaaaaaaaaaaaaagtaagaagaaagtggctgcaacttagatttacaagatttaagtaagtgaggaaagagaaagagaaacaacaggaagctgaagactggaaaaagtgagagaaaatgtgggatgtaagctggcatttcttatcacttgctcctagcagctggctgctggagaggagtaagaaaaacagggcagccagcaaacacccagggcataagttctcattctgagacctacccccaccatcaatgacactgtggctgcttgtatctagtgccacagcacagattatgctgatgtagttccacacatgcatcccttcagtacacaaatgtgttgtagcacttcccagtctaaatgtgtcttttcttggtccattttctttccccagttactataaatttttctattgccattgactgccaaatttttaatgttgtcttcactagtttctccactatattacccacttcgctctgacctagctttaaatcccatcactccagtgaaatcaatcttgtctatatcaccaaattattttaatccacttcattaaatgtcagtagcaattactgaagttgtctacactctatttgtcaaaacagtggcgttgatgatcacagtaaggattgtgggttttaattaaaatgtacagaaagccactgaaaggattttggcaggggaagcctccaatgacactaggctctttgggctttattcttacttctctggtttctccttgtcaaacaaaattctaaattccagttgttatagactaaatgctgtgtgccctaaaaattcatattttgaacccctaaatcccaatgcgatcatattagaagacagagtgttttggaggtaattaggtttagatatgattatgagggtgaagcccctattatcaaactagtgcccatataaaacaggaaagtggcactggagcttcttccctcccccgtgtgaggacacaccaagaaggcaactatctgcaagccagaaagagagcttttaccaagaaccaaatctaccagcctttaatcttggacttcccagcctctagaattatgagcaacaaatgtctgttgtttaagccacctggtctgtggtattttgttacagcagcacaagtagactaagacgccggtgttccccagagttcagtccacagacctcttctcttttttctctacacttcttcttgaggggtttctacccagtttcataaccttattaaaggctacttactgtcaatgagtttcatatttgtacttttgcaaattctcctctgagctacagatttttatagcaatctgtttatcagacatcttattagacatctcacagacacctcatactaaataagtttaaaatttctcttttttacagccccaattttttctccttcttagacttctctatctgaaaaaatcattccaacaaaaccagaaaaactgctagtcatccttgatttttattcttcctcaatccccaagtcctatcccttaagtagtcctatcaatccaatgtacagaatccaatgtatagcatcttcttttcatcactactgctgctcaactgtaccaacccactaacttgtaacagaaaaactaaaatatgtccctcactgttatcacattcaccctcttgccctccttctccacttgcttcagcagacttctctgctagtatggatcatgcccttcattactccatacttttgaaataaagcccaatttccttattgtggcctaaaaatcccaccataatcccgtgccttggctacacctcacctccacctcacctcactcatggctctgacgagctcactgagtccctagatgcaccgagcatcttcctaatgccactgtgtaccaagctgtgtcttacatatgatactctttctctctggaacgctctttcttctgctcttcgtaaggcaattgtttattaatccttcagacctcagcttaaatgttgcctactcacagagtccttgttcacttcaagtatcttgatttgacttattattctattcctcaaccatttgttccttcattgaattaagataaaattattttatacctatttgttgtttacctgtttgttgtttgtatttctgctaacacaaataacacagacataggatcttgtctcttgtattcactaagggatgcttagttctagtacatttcctggactttgcagcactcaatatgtgaaatgaatgaactcaagaatgaaagagacattcaatgtacacttaaatagtgaagtagggtgtgcaaattataacattaaacaggttaaactgtgttgttgtgtagtagagtttcaatattaaacataattgtcatccaaaaatattatagctcaattaacaagtatttattgaacccagtacctattctgtgcccaaaatactgcctggtgttatgaagaaggttgagtaaaaaataaaatggtcactgattttaaaggttataatattttagaggagctaaggtataaacacacaaaacaacttgaaaaggatatataaaatgacttcatgatgagaaaaacacctgtgaaatatgtaataaaacttaatgatagcaaatgaaacttgtctttgatgggagtgacctcaaacacccaaggcccttcagaaagggagcatcaatgagaacagataaaataaaagacaagtgcagacttcactaaaataggaaaattaaattacccatatacttgcacatacaaggttcatttgccttgggaagttttaatacccacaattctgaatttttctataagttatattaaaaagccaagggacattacttgaggatagcaacttaaatataatatataaatatttattaagaacctatcttgtgggctgggcacggtggctcatacctgtaatcccagcactttgggaggccgaggcaggtggatcacctgaggtcaggagtttgagaccagcctgaccaacatggtgaaatcctgtctctactaaaaatacaaaaattagctgggcatggtggcacatgcctgtaatcccagctacttgggaggcggaggcaggagagtcatttgaacctgggaggcagaggttgcagtgagccaagattgtgtcattgcactccaacctgggcaacaagagtgaaactctgtctaaaaaaaaaaaaaaaaaaaaaaaaaaaagaacccatcttctgtccagcctctacctggtgtattgttacaaaaatgaaagatacggccgggcgcagtggctcactcctataatcccagcagtttgggaggccgaggcgggcagatcacgaggtcaggagatcgagactatcctatcctggccaacacggtgaaaccccatctctactaaagaatacaaaaaaattagctgggcttggtggtgggcgcctgtaatcccagctacagaggaggctgaggcaggagaatggcatgaacctgggaggcggagcttgcagtgagctgagattgcaccactgcactccagcctggggtgacagaacaagactaggtctcaaaaaaaaaaaaaaaaaagaaaagaaaagaaaaggaagatacagtacctactcacagagtgtccatagtccagttggagggagaaggaaggaagataatcctatgaacctcaaatcaatatacattgcaacaggtggtatgtaaaagatacaagcacaatatctcagtgaattaatacaatagattcttggggagtaaagattttctccacacagagccaaagacccttactgaaaggtaaaaatgcaaaaactcaaaccaaacaaggtgattcagttgattattttgtcatgatgcatgactgtctcatcagccagttgaattttccactgtagtaatcatttttactgaaaaataggttctcttttgtagaaactgtagtttataggaaatcatttgagtcacacattaagtcatgttctaaagtttcagtgtccaattcagcagctactagtcacagataggtatttagcacttgaaatgtggctatttgccacgtgttaaaatgatattttggatatattgatttaaacaaaaatatactattaaaagtatttttttatttatttttcttatttcaaaatgggacttttcaaaaatttgaaactgcatgtgtatctcacattgtatttctactgggcaatgctgctctaaaaagtttatgaaacaagttaatactatttttcaggaataggatgggaccaacttagaagattagacattgtccaatacggagtttgcaaaattctttctaaaacaatatgtaatataaataaggaagcataaaagtttaacactatgtactgcataagtattgtcttatccatgtgggaaagcactgagcacttttaaaaatatggttccatctagggaggctatattacatattttcaattaaatttgaaatgcatttacagtattgtgctactgtagcagagaacttcataactatctttactgttacttttatgaagctatttattgtgctacttttgttgcttccacaaccttaaaaattatacaaaaatgcatatattttttatttatgtataatactttccatttgaattcattgatttctaatagaacttttttataagttaaagctaaagagaaaagtctaaataaacatcaggtagaaatgtatagtaatacccggccgtgtgaggtgtcagtctgcccctaccggggggtgcctcccagttaggctgctcaggggtcaggggtcagggacccacttgaagaggcagcccgcatagccaagacaatcctaagccaaaagaacaaagctggaggcatcctgacttcaaactatactacaaggctacagtaaccaaaacagcatggtactggtaccaaaacagagatacagatcaatggaacagaacagagccctcagaaataacaccgcatatctacaactatctgatctttgacaaacttgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaatcataaaaaccctagaaaaaaacctaggcattaccattcaggacataggcacgggaaaggacttcatgtctaaaacaccaaaagcaatggcaacaaaagccaaaattgacaaatgggatctaattaaactaaagagtttctgcacagcaaaagaaactaccatcagagtgaacaggcaacccacaaaatgggagaaaattttcacaacctactcatctgacaaagggctaatatccagaatctacaatgaactcaaacaaatttacaagaaaaaaacaaacaaccccatcaaaaagtgggcgaaggacatgaacagtcacttctcagaagaagacatttatgcagccaaaaaacacatgaaaaaatgctcaccatcactggccatcagagcaatgcaaatcaaagccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccgtttgacccagccatcccattactgggtatatacccaaaggactataaatcatgctgctataaagacacatgcacacgtatgtttattgcggcactattcacaatagcaaagacttggaaccaatccaaatatccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacatcacatattctcactcataggtgggaattgaacaatgacaacacatggacgcaggaaggggaacatcacactctggggactgttgtggggtggggggaggggggagggatagcattgggagatatacctaatgctagatgacgagttagtgggtgcagcgcaccagcatgtcacatgtatacatatgtaactaacctgcatattgtgcacatgtaccctaaaacttaaagtataataataaaaaaacaaaaaaaatggaaatttaacaaaatagaaaaaaaaagaaatgtatagtaataatatacattgtgtttatttttatgtttttaattggaagaaaaattttaaaaacagagggtggtatataatttaaaaccaaattgaaaatggcttcagatgttcagcatctatttgtaaaccaaactaaagatatggagactcatccaccaattattgtaaaattttaaagaatgaaattagaatttacttttaacttagtgaacctcatgcaaaaagttttcttaagttattttgaaaaaaaagtattacttgtaaaagaattataactgagatttatgtagctgagttaacatgaagcaatagtgacatgcaatagcattaaactaagtggatagttacactagttctgtgaagtgtcttaaaactgattgttactatctactttgtttagggaatctctgttaatataagagactcagtttacaaccttcttcaaatgattaggaataacacagctgttaaaatgcatgagattacactgtaatagcattctttacctaataacaaatcaggccacaaatactaatgaacataatcactgggcccttaatggaagatgtctgctaattttgaaagctttacaattagctgtgattcaatgaacctgaatccatgttaaattaaactgttagggaagacaaaacagtgttgtttcaggcaggcaatgctaaaggttctaactgaattttctcaaggcaaggtaattttaaagataaaattgttctcttcttttgttactgtaaaagtgaagctctgcttcatttataaattgtactcagattaaaaacccccttttattttattttttaaattaataacctaccagagccatcggactgccaatgtttcaaaccttctctctcatctttcttattgttcaggttcctcacatagggcttctttctgcccagctctgcaagcctattccagccttagaatccttacccttgctgttccctcttcctagaaggctctgctccttgctcctctcataaatggctccttttcatttaagtctcagttcaaagacagcattccagagttttcttttaaagtgctcaccacttcccctaatgtaggaagggaattattcctttctttttgtcagatccatcatcaaattttgatttattttgttaatttttttgcttgtttattgttggattttccattatggaaactacactccatgagagcataaaccattatttagataataactgccataaacaaactaccattaacaaatggttggtacacacacacacacgcatgcataccacacatacacacacacatagactcacaaataaatatatttgtaaatatgtcatatatattttacaaagttaatttttttgctatttgctagcaaggttttttctattaaaaatatattatgagagctttcaaagtcaataagcagatccctgtagcaaatttataacagctatagggtgttccaccatttcagtacactagattatcaaatctcctgtgttgaatacttatattagcaccatacttttttactactataaatagtagtttgtctcttattttttaaatagatatttttcacttgcctgattgttttctcaggataaatccctgtaaattaaattgctaaataaataagaatatacatattttaaattatggctcatattgccatactgtcttcccaaaatattttaccagtttcttcttaaataaacattatataaatcttggccatattgaaattatgaatacttgccaattcaataggggataatatataatttcttttttaataaattatggcctttgcctattcttctactggaaagtttattttttgttgatttctaagatctattcacatattaagactttaatatctatagtaaaattactctcagttataaatacttttccaatatttatatgtattttatatatcttggggcatatatctttagttgctttacagtaaaatctgttttcccttcaggatttttgagtttagtattaactttaaaaatgggcaccttccacccaagactatgaaaattgcacactctctctcacacacacacacatacacacacacaatgtacatctaatacttatcacacatgtacatgctatatattgtatttataaaatattttatatttccaaaaactgttgtaatgttttagatttaaatatttaatcaagaagttttaaattttgtttaatcaacatgtaataattacagtgacatgtaaatgatgtacagtataatacatgcaggtataaatatagtttgagtatttcttatctgaaatgcttaaaatcagaagtgtttcagattgagtattttttaggattttggaatatttacatatacataatgagatatctgtgatcagcacccaagtctaaacacaaaattcatttatgtttcatatacatcttatacacatagaactgagatattttcatataatattttaaataattttatgcatgaaacaaagttttgactgtgttttgactgcaacctgtcacatgaggtcaggtatggaatttttcacttgtgacatcagtcagcactcaaaaagttttgggtgttggagcatttgggatttcagaattgcacattagctatgctcaatctgtatgtatatccacctgaattttctttaaacactactaaggttttgctacttagaagtaaaatctttggtcaagcacagtgcctcacacctgaaatcccagctctttgggaggccgagaagagaaccacttgagcccaggagttcaagaccagcttggaaacatagagagacctcttcaccattaaaaatcaaaaacattagccaggtgtggtacacatctgtggtcccagtgacttgggaggctgaggtgggaggattgcttgcacccaggaatttgaggctgcaataagccatgattgcaccactgcactctgccctggacaacagagtgagattctgtctcaaaaaataaaaataaaaagaatatgaaatattcaaccaacatataattaattgttatgggagctataaatagaaagtattatctctctcaattggctttgatcattataaacacacacatacacatagaaacacacacatccaccgtttaacccacagaaatgaaatgccaagattttcatgcattgtaaatccccatataaactaaactatatgaactaattatagaatactatctatctatttatctatctatctatgtagtcatttctagattctctattatctcctattgtttcttcattgatcccagtataattattgtgctatagtaataacacctgtatacctggtggtgggcaattctacacttaccattcagaattgtcccatttccacatagtttttgtttgtgaatgaatacaaataagaatggttttctacttaatacttgcctattagtgccaacatcagcttgactctactaaaaggcacacaagtgtatctttccgtctctgtggtgaagcttctcttttgggatgggctatacttacatttttttttttttaattaggaggaatatttccaaatgtccttcagcaagccagtatggtaccttatcagtgccccaatgcaaagctccaaagcaaacaaaggaaaactctactgtaagtgctcaaataaccatttcttatacttctgatacaatgaaaaaaaaaatttcttcaaaatttttcagttgcatgagaaaataataattcaacattgtgcaaaagaagattatattagaatattttacaaaagtcattctcatacgttttatacttacagatatattatatttttaaaacattattttaaaggagaattaacatcaattatactaatatgttctgtgtaaaacaacttagcaccacttttttaaaaaggcattaattcaataactactatgctggttgaaagaaaaagcaaaatttgagtttcacataacattggtctcattttcatcctgaattttaaacaaaagtctataaacaagattagagaaatcgttttataaatttgaatgttgagatttatataaatatgccattataagagtttgatacaaagtacttaatattttctattgatatgttccaaagagaacctcacaaagaatattttttctgtatggcaggaaaaatgctaaaatcccttaattgcaaatgtgaatttcccagctgacattaattttggtttataaggatgcacattaaaagcagtgttgcctaagctcctaaatataaacttagagtaagagtttagtaataagtatcagttatagaggctatgtgtataggttgcattttagaattccttggtgtttttagtcatgactaatgaacagcccactctcaaatatattctgaaggtagatagtttgaaacatcgtgatttaacaggtgccttactgggtgactcagccccttcactctgactctaacaataacataaaaggatttttttttttaagtgggacatcacttttttttttttaatcaagcacaaaaaaagactcttacgctttcaattgtgctgtctttaacttggattatggaactgccacctcgtcagttctcaagttctctttaaatgttctgatattttcaaccacatctccaagagaagtgatggtgtgactagagtctcactaaataatgaaagcttgctttattttataagttaactgttctaaaggcaagggctggagcctacatctcaaagtctaaaatgtcacgattaacttttttcattttctttgtcttctttgctcataatacaattaaatattatgccaaatttttacctgtgtgatacatagccatgattaatatttttgaaatgattttaatactttagtacaaaattattagaaaatatgataaataataatacagcttttttgggggggtctgattgaatgctaagagctttaagcacattaatttaattaagcttcaaagcaaacttatgaggctggtactatttgtattcctctttgacatatgagaaaattgacacaccaaaaaattaagacacttgcccaaggccacccagctaagagtaacaaaattgggactcaaagtcaggaagactgcttttgctatatactctggaagagtatgatctctagttagatacaaagtgcttaataatttctattgataggtctcaaagagaaccttacaaataatgttgtttctgtatatgaaaaaatgctttagtacctttaattaactaatactcttctacagcttccatagtctgcaattatggcagggtcataatgaaaataaaagagacaccatttcctttacccagcaatgccaattcctacagttatacagcaaccccaattcaatcactcctagttctggaagtcccagtgtgctagtggtgtctcataggcttgctaatgtaggtatcctatagcatattgttcaggtcactgctatgaagtttattgctgtctaattttactcttgggttaacctgattcactcatcaaaaaaattgattgtgtctgtaactattcccatcattgagaaaatagtggagaacaaaactaaatccttgttcttataaagcttatattctagagaaatgtgaacagtgacaatttgtctgttagtaataaatgctgttgatgaaaaagtcgaagatagaggatatcattttatgcagaatggtaggggtaggtctcaataataagatgacatttggaacaaagaccttaatgaaatgaggaacgatctgtgaagatcactggaagaagactattttaggaagagttctgaggaccatccaggggaccagcgtaattggagaaaagaaaacaaagaggtaagtagtatgtggtcagagagagagaggtggtcagaccaaatggtaaatatgtatagaagcataaatatgtccttatatacatataataagtagatacattcatacacactttcatgcattcaattctatgtattgaaggtagagcaaagatgattaagtgctggctgatatattttgggggagaaagaaaattaaatctaggatgacttcgaaattctggcctaagcaactaaaagaatgggatctattacaaaggtatgaaaggcagctgagtgagcaatttcttagaaggtgaatgagaattaggtattcaagttataaacattttaggcttgatattcctatttaatgtcaaaggaagatattaaacaaccagttgccaatgtgagtcttccttgaggaggaataaaacatctagggttgccacgttgtgaattatattgaatgccctcgaatagataagcacaccctcagagtggttatagaaagaaaaggcagaagaccagccttggatatgttgatattttgaagctgggaagatatgaaagtggttattttgttagactctgaagaaatagagggtctgagtatccttcagacaatatcccataatatgttttgcaaaaacagttttcataaaacatatgtggttgatttcatggagatattgtactttaattacaactgtggtaagaccctttgactttagcaatgaaccaaaatgaatataagggtattcttttatgcaaataaaagctctatttatgaggacatatatgttaatgcttgataggaattgctctagcagcacatgtcagctcttaacatttcgaggaggtagtggtagaggatttgatatataattatctgtaaatagtcaatgggtgttaatgaagtggaaagtttgttccaaactccctatgtcattcttcttcatattaaactggcagacaagaggaggtcaaattgttaaagaaatagatgtactccttggtcctaattttacaagatggcacaagaaccctggaacatacattcaaatttctcaatatacagagtacaaaatagaaataacacaatttgtacataggattctagtcctaggaatactctttgtacatttggtaagactgtgtgaactgtttatcttcattcacttcttttcccatttattaatcttaagagaatttaattatatcaatagctgaatctactacatgttaatacatattaatagcgaaatcggtatgtgttcttaaatttgtgcttgtgctctatggtttgtatacagaataatttattttttaagtaggagattgcaaataaaattacattttctcagatgatatcagattaagcctcaggtgaagaaaagctactggatatgagcaggttaggatatggtcaagctttacgtgctttttctcagcttttttcccccagtaagattaaggtgatgtccataacaatggtcagaggaatacatttgctctcagtttccatgaatataaactttaatgcttgggtgaataatgagaaatatatttgtaattttagaatgttttgcaagctgcatgtataaaactttgtcaaggaaatctatatcacataaaacaatcgtacaatcacgataaaagtatattcccatgaaatttagaaaagctaatggcattatgctcccttgatttcatattatcttgtcttttttactattaaaaattaaataattaaaatcaaatttggactattattgtgaacacaattatagtttcttacaaatgactgaccttaataaacaatttttttaaattttaactcacagttcaattaaaaactttaattagaactggaataaatttattaaattttctgtaacaaatatttaatatatttattgagtaaataaattaataacatgtaatattcatatagtttcagaaatactttgttttaatattaataggtaagatcataactagtaataatggctaattgttcatttattaccattaagtttatatttatctacatataatgtagaataacaatttttataagtattaaattataatctaaatacataaagtttgttctagaatgtgaaccaaagctacaaaattaattttactgatttcatccactgtattgccttattttctatgtgaacaaagagctggatcagcaaaacatttggatgagttgtagtttgtgttgccaaagaagagcatagagctaattagcctatataggaaataagctcatgcttttcaactctttagaactatagtctaaatactgagatagtaaaattgccaaacagtccataaaatttgcatgacatttatttaaaatatcaagtataatccatggtgattgagattctatttctcacccagaagttcttcaactagatagtaaaatacttggaaagtaccaacacacacacacacacacacacacaagcacacacatagggcgttctcttcacactgtcggtggaaaacacgaaagcaaaaataaatgcctaaaaatgcatgttagaagtgatgctttaaacgtagttttgttactggacttacacctgtgaagtcagaaaaacttcttggaagcttttgttacattttcatgtatttcactttttaaaattattacttctgttagcagatttgtgctaaaaatgtcttcctaggtaagacagcaaatgtgctcagaaagaggtgcgaatgctttggataaataaatgttaccagctagacaagcagcagctggtaaccagaaaaaaggaagttcccaccaggaaagaaaaaagatttttctgaatagaataagtcagaaaaaaaaaatgacaaggtatggcatcataggccttgttgaactaaagacatttcatgatctgaagtaatgtaattgtaagaatccatgagatagtgggacaacatgggagtttaatctggggtcagcaagctttttctgtagtgggccagatagcaaatattttagtctatgtaggctacatactctctgttgcaactattcaaatttgcttttgtaccaagaaagcagtcatacacattatataaatgaatgattatggctgagttccaatacaactttatggatgctgaaatttgcatttcatataattttgatgtggcatgaaacagtgttcttcttttgttcttttcaaccctttaaaaatgtaacaagtgttcttatcttatgggtgatgtccagatttggcccatagatcatagtttgctagcttcaggcctaaatcatcatagaactgcaggaaatccaacactggtggataataatagtacctttatattaatgagcctctttttaattgaattgtaagatgcttgcaagtgaagagggtaaaggtgctgggtgtacttattttcctttgttatttgtttatatgactatcttcacccagaagcataatgagagctcaaataaaccagtgtgctgctcttcctaaaatagttagggccttcaaaactaatatagtcattcaaaattacttaattgagcaccaatatatgccaggcactgtcctgggtgctaggaaaacaatagtgaatgaaagaaacaaattaacctcaagaagcttacctttcaggattgtgtcttaggacaagctccatgtaaggagaatctgagatgtggattcttgtatatgtgatgcaatggcaaagtgctctcaggaggaggggaatggggaagaaggacaaggcaaaacataaaaaaaaacctaaacaagaatatggacttagcttcagactaccgtcaaattgatcccatggagaaaatctgaagtagaaactgtaccacagttagctgtactctgaggcaagggggctggacttttgtactcctgtccctcactggagaggcacctcctatttggcctgagggtaatgcttccaagggagacaggaacattcctgagtggtcattagagagatctgggcataaaactaacatcatccactacagaagggtgacaaataataaatataaatattaaacatttttaatatgtcaggtagtgacatggctttgtggctagaggaagacagagaaagatataggtagagggattgattactcttttacatcaagtggccaaggaagtcctctgtgataatgtgaaatttcagaagagaactgaggaaactgagtcccagtcattcagttatctgagggaagaggagttttaaatcaagacagaactagccttagaatgttctagaatgtgtgagaagtgggatgtggctgaagtgttaaggatgagtggagaggtagaaactgaagctagatgaaaggggtcatgacagattacatagggccttgaagaacattgtaatgtgttcagcttttaccctaagaaacaaaagcaccaagtgctacaagtatgtgcattatacttgtagaacccagacgggctctcaaaaaccatctggtctaacttctcaattttagagatttgtacagtggaaaatctctttgaagataaaagacaaggatagagttctaaaatgtatggaaagtgacttcccatttaatacatttgaagaaaatgctgctataaatatttgaacagtttctacagattatgttcatttgtttaagtcctgaatcttaatgtcatcccatcaatggcaaaactgtgagaggatgagagacagctggctgatgcacagaggatgcatgctcactgtctgacgttggcttggcatttattctagctgtaatttcagcacgttgggaaagggaaatagtgataataatttcaagcaagtgagctgtattttctttacatgcagtggtcagctactgccaagatgactatagctccataaattgttatttccaccaaatccaatgcaaaatattttatgtttaaattgacaaataaagaacaaaaaactattcttggaagataatcattaagtagttataaagcaatttaaaaataacattgcatatgaattcccattaacaatagtggtatcttgtgacttctattagtttgaaagaaatattccacttcatgttagtactggacttcatagaaatatttattagtgggttcagccctctgttgttggtgttgttcaatgtatagtaactatacccaatgtttctaataattcaaaaatatttttatgttccaatgcaaagccatatcttgttttcttgaaagagaatttcttacatttccagctctaccttaaatggtccatatcctagctctgatgtcaattctcctatatgcaagttctgatcttaattctgcttcctgattctttgctattaaaaagttctctggggtgatgattacccctgacggaggagatgtccttgaaacagaagcctaattttcatctcctgtgtcatacttcttcttcctccttttaaatatgttgaactaccaatgacatcaaaaagaaatttaagccaaagtgaagcatttggaggaattaaaaagttttaactgaacatctttatatatcttagtttaattaaatctataattaaaacagcattgaagcatacatcttaaaaagatcacagatgaaaaattcagttatttcctgaaatttcaataatatatacatattctaatatctaggtgaaacaaatacatttcaaaatgtgttgtttaagttcactgaccttaaaaaagcaacatattgctgataaataacatcatgacatacttagcttaatttacataaataagcttttaaaaatatatagaatatttcagtgtaagggaacatttattccatttgcttacagttaaagagttatgtttgtcttattaataaattatatccattctatctgtatttagagttagtaaatttacctgtaaaattgtgtccattctatctgcatttagagttagtaaatttaaaaaaaaatgtaatttaaacatagtctggcattccctaccttaagaggtcaagtgtaaattcttgtgaaattacctgtaatataattggtgaagaagcatggcctacatctgcccaggttttaaatttcaaataaaagcaactccctaattgttactctcttctgtgcagaaacacttgctctcaacaggattctttaattaggaaaagaaatgtttctgtaaaaggctcttactgattatacagtaaaatgctttgggggaaaaattgctttaaattactgacactaaatacatttggatctgcatgtcaaatgcacatactaacttcattcttggatagccaagagctacacacataagtggacctaaaatgggtagaatataaaacttcagttagaatgtcatctgtcactttccctggtttccctgcacagcacttgtttgccccttttggtaaagagatctcaacttctttgggatgctacctgtcttcaatacacaataggaccaccaattaaagaactgcacccttctagccaaggtatggccctgtgactcaaattaggctgcctcaattctctgacctgggagtaaattttgaacagagttccatgaaggtggaaaacaattagaggtaattcatcttatgtacaaacaccttatcaattgtcccttagttcctgctcaatccttgatccccatttttttctggaatataactattgggtttcctttttgtgactgagctgacttgtatacacttaataaattttttttgtttgtttttttggctttagttagccagaatcaacttttgttacttacaaccaaagatccctaactaataacagctcataaaaatgattaaatattccatgttcaaaagcatttaaattgaaatgtttgaaatgtttctaataacaaatcagttaaaatcggcacataagatgaactataaatcttaagttgggaagcacagcaacaggcaggcaggtgattatgaaatggatgaatgatagcgtcctagctaaaaaaaaaaaaaaaggtggccgtttttattgcctagctgcagctatcagaaactacattaatattacagaaaaggggaagtgtaaagcctctagtgaaatgaagaaaggggtgcagaaagggccaactgtggagaatctttcatgttgaccccagaggttttcctagaaaaatttccctgaccaattttctttaatgatggttctactctctaggactatatattttgcttcgcatgtattctaagcttattgcattcctcaatgcatttataaactccaattgggaagggactatggttactattttttctatatctggtagagtgattgttcagaaattctattccattaacacctaatacacacacacataaacacacacacacacacacaaacatacacacacatatgcatacatctagtggcaattttatctctacaacttctcccagtgattagctatctgctattaagacatgatttcaaaagaattgggggtctcacaaagcataaagcttatcccccctcacccctgttccaccacctacacatgctaattcaacctgagagtgactaaaagtttacgatgagaaaaatattatttttactacaagtcttttataaaagcaactcaaccttttttgtcataatttcatgacagagcactgatatcatagcagccacacattttttagtcacataaaactggcttcatctttcactgtttgtttgatctgggataaaacaagcattctctctaaacatctagaaaaaacaaggtaataataacatcaacctcagaagggtttagcaaggatttcagtgagatataacagtgtctgatatattataagcacataatagatattactattattattatttaaaacaatgtgctgtacaatcataatatatctgcagtggtggtgtaggacattagtttagatatctgatttctaattgttattagtgtccaggaaaaaaaaatcagtgtttcataggacactttcctcagggcatttagatctaaaataatattttttattgtacaacttcatacagatgatgcaatatataaagtagatataacctaggagtattcaatgtgactcattcctcagtcttccccaagccccacgtttctcccagccaagattaatcttaacaaaaaaatcaagtagtcacataccttgccataatattagaagacagtgtatgacaatcatcattaagaacttgatgtcaaatatatcaacttgtctctgacagatttttctctaaatgagatttactgtccatcaagtcatatatttatgatcttaaatgtacttattactagtatcttatccccaaatctaaataggctagatctgacattgacctttattaaaattacaggtagttatgcttttgtagtttctccctaaaatttaaaaagtaatttctccttaatcaacaaaggtttgtctgacatcttagaaccccaggagagataggagataggaacactatctcaattccatattaagcttcaatttcccacagcaaaatcccttgaggaatagttcctgtattttcctccctttgccttctggaatgcaaatcaggacgctacctcaggcaggttccagttcctacgaaggaagttttatattatcaaaatattaaatttatgttccaaatcacctcatttcaactctcctaaggacaactcctcttctgaaaaaaaacaaaacaaaaacagttcaagggatgtttatgtaagcacgctgtgctaccttcatacaatatgatttttattcaaaatttctcttctgaagattcatgaggatgcattttgcaaagtataaaagatattaattacctgttcaacttgtcaggttcagaaaatacatgaataacacatcaattagcaatatataacaccaaagaacaggacataacctaagaatttaacctcctatgatctgcctagcttcaatttaaagtctaaaggcacaagtgcacatattaaagcatataagcaaatatattcagaaacctagtgttaagaatattctgtgtttttaccttgctgcttcatatttctctgctctactaactgcatgcaaaccctttaaaacctataattaatatctcaaaatgctaactagttcactgcactcttcctgcctgtatttaaatataaaagataaaggggacacagtttgccagtctacagaaaatgcacagccaacctgcacaagctgccacataatttatggtgaggattaaatgaaatgatatatgacacatatacaattagttcagacacagacagctgaaagaatgttaataagtcaaaagtcaatgaactttcttaagattcatgaaaacaatgaccaaatatgtaactctgtaaaaactatccatactgtggtttggggggaaataaatgaaatgcattcttagctgtcattatagtcacctattctgtcattggtattttaattctaacacacttcccaggtgtccatgaaaagaattacacttctttcataaaaaacgatgtcatcactttatagaacacaattatctatacacattgaaaagcttccagttgagtttattaaattcttgcaaacacaactattgtaatgcaaattagagaatataaagacactctagaatttctgtctacaaagcaagctcactgagaaaactctgcatattataatgggataattcccctttaagttgctttatatctgaaagcataaatcagagggtaaaattaagatacatttttccttcatgactgtaaataaaataaattgtaaatggtattatctgttaattttatctaaattatcagctaaaatgtttgagattgaagtacattttgggatatttcaaaatattattacttcactcatttcaaataatcaagctatctacaaatataagaaaagtgaaacagggaaaggtgactgtttcataagagaatattcccaatcatcttttggcttggttacaatgctctatctctaaatgtgaataatcttaagaaacaatgttagaggatttataggatatcttcttttaaaaggccatatttgacattgttaatagtgattgttaatcgttctacataaagtttccaaataacattgtgttatgcctgactgataatgtaaaagctctataattataagcaatgacaagatgttattaaattgcttatgtaattttgagccttctatttatttatttatcatttttataaatttagggggtacaaatgcagttttcttacatgaatacattgtttcatggtgaagtctgtgcttttagtgtaaccacaacccaaataatgcacattgtacccattaggtaacttttcatccctcaaccccctcccactctctcacctttctgagtctccagtgtttattatttcactctcttatgtccacatgtatgcattatttagctcccaattataattgagaacattcgactttcttttttgagttatttcacctaatttaagacaatggcctccagttctatccttgttgctgcaaaagacatgatttcatcctttttttatgactaagcagtatcccatgatatgtatatataccacatttttgtttacccagtcatctattgatgggcacttagattcattccatatctctgctatagtgaatagtgctgcaataaacataagggggaaggtgttttttgatataatgatttctgttcctttgggtagatagccagtggtgggattgctggatccaatagtagttctatttttagttctttgagcaatctccatactgtttcctacagaaattgtactaatttacattcccatgaacagtgtataataggtcctttttctccacaccctcatcagcgtctgttattttttgacttttaattatagccattctaaccggtttaaggtggtatctcattgtgattttaatttgcatttctctgatgattagtgatgttgaacattttttcatacacatgttgcaaattgcctatataattaattcagctttttttcagttatgtcagatcaagggaacaaaaataatatcataatttagaaaaacttacataataagattaggtctacataatctatatattaaattccatacaatgagtaagtttttttccccaaactcccttagaaaatacatacattttaccataatagaagacacatcaagaaacaatttaaaaattggagccaatagagaccacagtttctgatcacagtgcattaaagataacactaataaatttagaaaagaaacaaaacatattcccatcagtaggaaaggaaaaacaattaatcaattgtttagttcttttaaactgcagaatattaatacactgcctatccgaacctattagaaggaaaccaaagagttctcaggaaaaaattagggtcttaaaatccatgttaatgaagaagaaaaatttaaaataaatgagttaaacatctaactcataaagttagaaaaaatatataaacttagagaaagtagaataaagtattttaaaatgataaaaatataaattgataaataagaaaacatacattgtagagatgataaaggaaataaaagtaagttgaaagaaacaagcacagacaaccctttgaataatctaatcaagaaataagggggaggagaaagaatggaagcataaagtaaaaaagaaaaatgacaataggtaaataatagataccataaaaaccttaagaggacctagagtgctttccagtaatcaatactataaaaaaccttaagaggacctagagtgctttccagtaatcatactctataccctaatcatattttctttcactctcttaggaaactatttcacctcttctagactcaaacttccaagtcctctctcatattcactttcaatggatgcccttgctccctacttcactgaagaaattgagtcaaccagaagagaacttccaccaactccccaatcacatcttcccacctattaccatctctactgatatcctataacatctcattaactatcatcgaaaaaataatgtatttttctactaaagccattccatacttttcctctaaaactactcgaagacagtactccaggaagtcccatccctctctcataaatcacaaatgtatggttctcaaatagattatttctatcagcatatgtccttgaaaacatcctgatatctgtctggaggaaaagaaaactttctttctcttaaccccactttactcatcagctaccacctgttcatctcttcccatttttagtaaaattccttgaaacaaccctttatacttgaaatcttttctcctactcctcttcttttaaagtcactgaaacctggattttgtccaccttgagctactgaaaacttgcagaaagagggtaatatgctagaccctgtataagtttgggaatgttcatagttgagttagacaccagctttgcttctgagaagtttctaatgtaaaacagtaatcaccttccctagaattacaaacaattcaaatcaacagagaaactaccactaagtaccaaaacaaaacaaaacaacccacagatggcccatgtattgctattcgctcaaaaaagattatatggcctgcctcttattgtgtgaactgtagtatctgcatctggggtaagtgagctttccacaccattgcctttaagcttagctttggccaacagaatgtaagtagaagtactgctgtgatgcaacaaaatccctgagaaccattgaatgacctgccaattgctctttttagttcctactgcttcaagaatggcatgtctctgattgaagctactttttagctgggtcttagaataaagaagacatgtgggacagagccaaagccaaggtggccaatatggtgcaaaaaggagaaacaaatcttttttgttgcaaaccacagagatttggcttttgttgttatggcaacatattctagcaaaagctaattgatgcagcccaatttaatggtgcctgaaaagcattaggccaaggaattctgggttccttccatacatttcagaccatgtcatatcaaatcaaaataatgctatttttctccatcacaagcttatttatataactaaaggttcatgagcaccttctgaattcatagtactaggagtcagaaataaattcttttcaattgtatttaactttctattggctcatttagctcttctgttcgccacttcttggctgtttcgaacattaatttacaaaagacagtttttcactaaccatcaaaagaagaaaacttagaatgatagaaaagtaatataatttcattgccatttaatcctattaacatagttcaagtatttctccttgtttctatgctgtttctttggggatctctacttttgctactcaaatagtcaaacagaggcatctgagagcttgttaaaaatgaaggctccaaggccccacccaagacctactgaaacagaatctgcattttaacaaagtctccagctgagatgcacattaacatttgagaggctgtggtttataaaaaaacaagttctcctttttactagatgttctttttcatagatctggagtagttaacagccaggatcattttttctttttatgaaactttcaggtgatcctgatgtaagagatttatataatacattttgagaaaaatcaatttaggcttagctgagtatgtctgaatctccagttttgacacttagtactagttgcatggctctgtgaaaactacttctccaaaattcatttcttccatccatggtgaagttactacctatttctatttcacgggtttataaggttctatcagatagtgtacaaaatatctcactgttaactgcaaaggagactaaaacaaatgcaaagttgaaacatattaggaacataataaaatgtgttgattaatatgatgaatgtgtaaatgaatactattcaactctaatgcaataagaagaaataacacaaaggaatgatattaggttatgggaaaatactgccaaaggctgacacagtctctgctggtttggactattgccttcacttttggttgtttgttgtttgtatttgatatctctccaccaagtccaagagcaaaaaggctaagaatggttgagagtatcttttcttatagggctatttaaaatagtcatgactttcaatcacataaacataatattaaaaatgtcaatggcaaaaaataattcaatataaacacaaagtaaaaatcttccttccccaaacatctttatgctcagtctcactccccactttcaatcatttatgtttccaggttttctgttattttccactacagcataattttaaatagtgcaagatgagaaaattagtacaactatacttccttctacttgctatccccctctccttctctcagcttctattatctaaattttaataaaaactatagtttgttctgtaactatatctagattttccttgtatttcctatagattacaatttttaaaaataagaacatttaaaatgttataaaattactgttgttttgcagaaccaagaaaaaatattgaacaaacgcagaagacagatttccttgccattaaaactgctttttagtaaagcagttgaatttgataacccagaaaaagaattctaaggtgactaccagaaaaagagtaaacttatttcaaaacattctgacctatttaacaaaattcagcaatgtgatagatggtattgagagataggtggacagatgggtaaatgggatggaggaagaaaggacatttttaaggaaattctcaactcatctatctgtagtcaactctgaaaagataataaaaccacatatttataccaaaagaacgtacaattatgggctacatatatgtaaacatcaagacactttcattacgaaatatcaaaattgttttggaagtgaatggacccttgaccaaaaaactgttaataattttattaacttaaataagtattacaataaaaaattaggaagagaaacaaaagatctgtttttttatagggtccaaatagtgttatatctacatttttagaatgactacattagcattttcatcactgaacttgaataaatggactcatttaaataattagcacttagaaggcacactaaccatggtcacacagaaaaatttcataaatgataaaacattcaagaaatcgggatttatttttagagcaagtcctctggatacttttgaaatgcatcaagccctagtgacaacgttggacatactgaaaacaattgtctttctgtatcctacactgtactttgcagtgaattcctgactttgatattgtgaatagtttcagatatgcagcacatactttattattggagatatttttaaaagtagcctcaagtgcggtaaacagaacagccccccaaggatatctactcagtaatctgtggaacctgtgaatatgttacatacatagcaaatggaactttgcaaatataattaaggttacggaatttaaaataggaagaatatcctggattatgggtctaatcacctgaggccttaaaagtagcaacatttctccagctggagtctcagagctgcagcagaaggaaaagtaaggagatctgaagcaagggaaggaactgatcagaccattgttggtttgaagacagatggggaaaaattaggatgaatgcagcccacttaaggtattgaaaagttgcccaccatagccagtaagaaagctgggacttcagttccacaaccgcaaggattgaattcagccaacaagtggaatgagcttggaaagggatttgtccccagaactgtcagaaaagaatgtagcctttgctgacaccttaattttagctctgtgagagtctaagcaaaagacccagttggctcaaggtctacctgaacttctgacccacagaattgtgagataataaatgtgttaagccactaaatttgtgatcacgtgttacagcagcaaaaggaaaactaataccatatgttcctttcctcctttgcatagagaaagttctacacattatgctcctattttgaatatacccattttccatgataaattgagcctggctaaattaaatgaatattaagaactattcaaatccaagtgtattagtctgctctcatactgatatgaagaaatatctgaatctgggtaatttacaaaggaaagaagtttaaatgactcacagttccacattgctggggaggcctcaggaaatttactatcatggcggaaggcaaaagagaagcaggtaacttcttcacaggtggcaggacagagtgagggcaagcaggggaaatgccagatgcttatgaaaccatcagatctcatgagaactctctcattatgacaagaacagcatgggggaaaccactcccatgatccaattacctcaacctggtcccacccttgacatgtggggattattgggattataatttgaggtgagatttgggtggggacacagagctattatttctggtttcacaaaacaaacacttggaccagaatttattctgtcctcaaatggaaaagcaactaaccttgatatgtctgctatatgttagataacaaattaggaaatttgtaaataatattttatgtaaagttcaccatgttccaattaaatgttattaccctaaacctgagttaatctaactacagggtaatagttgtttatatgagaattggtctagaaggcacgaaaagtataaatgagttcttgttatgacaaaaaaaaaacctagaaatttctgagttaggtgcattagtaccctttataaagaatgaagaatccctatttaaaaaatgtagtagtttttgattaaaactgttacatctctgttgctcctgccatcctggtactgctgctcttattgcaactgccagagcttccacacactaacatcacttccactgctacgcactaccctactacaaggctcagttgaaactcacagccttggtcttcagaagccctgttttggatgctgttctatgggtcctacactggctgttcaaaatgctttgttctctttcatcccattttcttcttttcttgtctgaactcagcagttaaaggaaggctatatctggtctgtctggagagattgagatggaaatgtaactttccagtgttttttccatttctgcacataacagtgtgaaatacctgaatctgaaggtttagcactttttttgtaatttctcttggctatgaatgtgggtctcatttacttttcaaaaataaagatttgagacacagggaggttcagtgggttaaggtaacttgaaacccaaacttcaaacattgcgagcaaatgcattttctgtctcaagtttcacaaaagagccttactgtgcttatatctcaccataaaaatctaaacatttgcttttaaagacacttcagttaattaaaaatatataaggttgaaatagtattaaaagtgatatatcattatatgagtatatcaatttagagtgctggttaatgtgagggttcagaaaacagacaaccttgggtagaattggaactctgccatatactatctttgcaaactagagaaggtgagttaatccctctatgtcagtttccttatctgtaaaaggggaataataatagtacctctagtcatagaatggtggttcagattaagtttgttatatatgtaaagtccttaaaactatgcctggagttcagcaagctcttaaacatgagctatcaattctggttctgattctagtcactaaagagtcagcagtgcaggggtgggtggggagttctaaataattgtattaaagaaagcatgatgaaaagatgaaagttaattcttcaagcctatgtcacaggatgatatgagaaacacatgtgaatataacatggactgtgacaatatataaagtaattagaaaatatcatatgtgtaagggctcagaaaatgtatcaccactcaaatatctttcttaaaatgcttacttagaaatacattccttcaggcaaagtgatgaaatcaaatgtaaaatataaaaatggacaaatggtgactacaagaatgatagaatcattcaaattgaacatattaatagcatttaaataattgctaatagcttaatttcaaatctgaatgcaactttagactggattttgcagtaaaaataccgcataaaagtttttaataataaataacactttatgttaatacaaattggaaagtccagtgtggggaaaagagcaaggacagagaagtattcaattcttcctctttatatgttggaccagaagatggaatgattactttcctgattataccaaataaagaaatatggatgatgtttttttttaaaaaaaaaaaaaaaacactcacacacacaacaggttccactagtttagttacaaacaatgtgtatttcttacatatactgcagaagagaaaaggcaacaaaacccatttcaacagccaaagcaaaaaagcaaaataatatcaaggaaggaaaaagaggaaataaaaaattaatgacatagataattgctcatgatatgttaagtgaaaatgcagtgtataaaattacatatagtatgcttctaattttgagaatagcatctttctcttagtgtaaaagatgataaagaccatcgacctaaattgaactttaagtaattatagatgcagaaacttgaatattttctacaaagcacacaaaaaaagcagtacaaggaaacaacttccaagaacagacccaaaattaaacacagtcaatatgtaattcaaagtagaaaatcaccaaaataggtattataaactgtgttgaaaattaacttagagcagaccagtaaaaagcaaacaactttcttagttacgtctggccttgtatttttgataaatttattactgaaatattttataaattaatacaacaatcttttattgtctctatatagtagaaatatatatattatggttaagtttatgatggtaaagtacataaaattccagttttaaagtgtgagacatagttcttaagaatatctctctttttaggttttaggttaaataacttctccagaaatataaagcaactagtacgcatcaagtgtttaatccttgttcttgactttctttgactctaaaatcttaaatgctttaaggaagattgcgttttaaaagtacaatggatgtaaattttcagttatgcagtatgaataagttcaagagatctgctgtacaccattgagcctatagttaatactgtattgtgcacttaaaattttgttaagagggtagatctcatgttaagtgttcttaccacaataaaaaataataaaataaaatgagggaatcttaaatttaaatcttgtctctgacacttaccagtaatgtgagaataggaaacatacttttctgagattttatctatatataaaatggaattaaagagattgcttttacaactcttatgaagataaaacaaaatatttaaagaggcaatgaatatattgatcaacagatgcttcttcctattctactacactgagttctttgctcttattcattttctgtcatacttctatcattgtcatatttctatcacatagaagtgtaaatattggtttaatcatcagtcacctcaaataagctaagcattcctgaaagggagaagcatttttcatcatctttttttgtttctataagccatcaggataagcaacattttatcctgtaacctacatgttacattgccaccaggataacctacatgtctatcttttgtattctcataaactagataacgtgcctgctacacacatattttatttaaaacttctgatttgagggctgtgtcttctgaaaatgtgtaagaccaatgagcacaggaatgcagaagataatcagcacctgtcccagataatcatggtctcatattaccactgtttcctatttcagggtgcatattgtgcccaaatctgagaatgctgtggtgaaagtgataggtgctgtggagctcacagttggagtttgtctctaaccccaggtgaacctcttcaaacacctaacaattgttgagtctaaataaaggctcacacagcactgtgtttgtagtttgggaagatatgcacatataaggaaaaaatctctttgctctgagagattacattgcatttgcagaaaaaaaatgcatacaatcacactaagcaagccatcattaataaccagtttagacttgtattttaagttatgtgacagaatagaagaatacaaagggggagagaggcagattagaggtcaggcttgaagacataataagaagcttaatcatttattttccagattagcattttacaaatgtaattctatgaattacctaaggtgattgttaaaagtataaaatcaaaatttccagagaagatgtcattgtcaacaagcactttgagcaattctccttttcagtcaagcttgtgaaaacttctctaggtgattgggagccatggaaagttattttttaacatcttaattgaaaaataatttacatatcacaaaattcctttgtgtttagtgtagaatgctatgattttaataaatgtatagaggtgtgtaatcatcacaacaatccacttttaagtctcccaaaaagatccctacccatttgctgtcacttcctatgcccacctccagccgtaggcaaactttaatctcctttccatcttatagctctgacttttctgggtatttcatgaataaggaatcatgtaatatgtaatcttttatgatgggcttccttcatttagcatgatgatttttaaagtttcattcttgttgtagtgctgatagtttgttacttattgctgaatagcatttcattgcatgaatacacaatattttctttaccacctgagggatatttgttattatgaataatgctgctatgaacatttgtgaacaggatatacatgaaaatatgttttcatttcccttggttagatttctaggagtaaatttttttaattaaataaactactagattatttttatggtagttgtaccatattacatgccaattagcaatgtatgaaagttcttaattcaccacaatgtctctaattctgggtattatcttttgattataaaaattctagatggtgtgaaatgtggttttaatttgaaattcctaatgactacagagattgagcatatcttcatctgcttattgacatctatttaccatcactgatgaaatgtctatgcaaattgtttacccattttttaattgggttttcctcttcttattgacttgtgagagttctttataaattcagaatatatgtcctttaacagagatatgttttgaaagcattttctcctagttatcttagtatttttcattttcttactattttgaagtataagttttttttattttgatgaagttctatttataattttttttgtggattgtacttttagtgccatgtttaagaaatatttgcctaatccaaggtttcaacaatgttttcctattattttcttctgcagagtgtatcgttttgctcttacatattggtctatgggccactttgagtcaatttttgtgtatgatgtttggtaaggttctaaattagtctttgtgcatttgaatagccaatcatcctagcctaatttgttgaaaagactatcttctccacattgaattggtataattgttgaaaatcaattgaccataaatctacggggttattcttgtactctctatcattatacttgctctatatgtctatccttaaactaacctgtttactgtccttttagagtaagttttgaaatcagtaaatgttaaattctccaattttgttaatgtttttcaagattgttttaattatccttggtcctttgtctttctatataaatattaaaatcacctcatcccttcctgtataaaaggctgctgacattttaatagaactgtgttgaatttatagacaaatttgggcatatatgacatcttaataatattgaatattttaaaacatgaatgtctctacatttgtttagatatttttacatttctcttaaagtcttcactatacaagccttgcatgtattttgtttaatttactcttaagtatttcattattttagatgctattatagatggagttgttttaacttcatttttgatcattcttcgatactgtaccaaagtacaatttatttatgtatgtttatcttttatcctgtgaccttgctgaattggtttattcattctgttgggtttatttgtggacatagacgcattttaataaaggcagtaacacagtcagattttaataaaggcagtagcacagtcagatttgtattttaaacagataactctgcagctgtgaaggggatgcatttgaaggaggaaacgccggaggaagtaagagtttttcaacaccgttgggacaattactgacatctagaatactcaaaggaatatataacaagactaggagtacaccagaaaaaaaattgaaaatggtaactgcttattttgtcatagaaatggacatgtttattttaagaaaatcattttaagctatcttttctttgttttttagacaaagtctctgtctgtcacccaggttggagtgcagtggtgtgatcagttcactgtaacctcaaactcctggactcaagggattctcttgcctctgcctccccagcagctgggactacagacatgtaccaccacacttggctcatttaaaaaataatttgtagagaagggggtctcactttgttgcccatgctggtatcaggctactacatttatcgtgcttattaaagttgcagacttcttccaggaatggcagactgtgtaattgggaccagctctattgataagaacaactagaaaaattgggtaattttttaaacaaattttaattcacttttgaagtgaattaataaaggcaaaaaaaaacagtgaagattttagagtttgggatctagggaaaactaagccctcaggcatttcgacctgctttttccctagttgtggaaaaaggagaggctggctcagcacatttggcaacttcacaaggctgaagagatgggaattgagatcaagtcctttcaagatgcagtagccttaatgaatcttcctcacttggaggtgagactcctaagaactgtaccctagaagaaataatccctggatgacagatcttcccagggattatctggattgaggtaattaagatcactgtttttccagacatctggccaaaaaaaataaatgttccctctagatgaagataatattctcctagaactaaaatgacttccactgatgattttacaaatgagatgactgtcacacagtcaaaaataacaatgtacatgatataacttgacaaaaatgaataataattcaccaaaagacaaatgaaacagataaaaggaattcctcatattcaagttagcagaaagacttaaaatggccatgtttcaactgttaaacaaaattaaaaacaaaacaaatggaaaagaatgtttaaagatagtaatcacaacaaaatattaaatatatagactcaacagcaaattagaaacagcagagaaaattagtgaactaaaatttcagtacaaaaataaaattccaaatgaatcacagagcaataaggggatggaaaatatagaagaaagagtaagaggaatagaaaataaagtgagaactagcatataggaagtggcattccaaaatgaggggggaaacagaatgtgatgaggcagtatttactgaacaaaagtaaatatttttccaaaccaataaatggcagtaagtcacaatgttaatctctatggacactaagaagaaaaaaaggaaaataaaaacaaatacgttttaagtacattatagtaaaacttcttgtaaagaaaactctctaaagcagccaaaaagattaaaaaaaaaaaggacagtttactctcaaagaagaaacaattaaattgacacctgccttctcaacagcaacaatgaaagtcagaataaaataatatgtcttagtgccaagtgaaaataaccactaacgtaaaattctatctccagtagaaatacctttcaggaataaaggtgaagtaaagatattttctgaaaaacttaaaccagaaaaattactcatctgcagacgtacagtaaaagaaatattcaagtttatttttcaagtagaagaaaaatgatcccagatgaaaagccagaaagaatgagatccagaaagaataattggtaacataaatggtatacatgtgaataaatctaaaggaatattgcctgataaaaatataataatatatttcacatcctacacatggaagtataaggcagggaaagtatacattaacattacactttgctaaggatgcacattgtaatttgtaggttagcaaaagaatagcaagagtgtaaaacttctagataacagaggaaaaaaatgcaattcaaatggtggcatgaaaggttgatttaaaaaaaaaacacaggataggaaaaatagaaatcccttggtaaaatagtagactaaatacaaatatacaagtatttacagtaattataaagataccaaataatttaaagagaaagattatcagtctgcatacaaataaaattcagaaattgtttattatttgtgggaaacatatataagaacacagacacattgaaattagaaatatagaaatggcacacaatgcaaacattaacagaaaagaaatctgctctaatactattactactagtaataaaatcagattaaatagaattcaagggaaaataccagtccagaaataaatgggtcacttcatgatgataaaaggctcaactggccacgaagttatacatatgatatagtcaaataaaactgatagcagcctcaaaatatatgctaaaaataaaagaattgcaagaagtagaaactctataattatagcatgagacaataaaacttgttattattctaacacagaactttagatgtggaaatgcaaaatgaagttacatttttaaaaaaacaaattaaatatatttgacagttactaaaacttatgatttcagaagtcacattttctataaaaggaatactagctgaagagattttctaactcaagcaacatcaactgccacagattatttgtccagatggaatatagttcatagtactgtattctgatagcatgatggatcagacaattggctaacataacttttaaataacctttttataagcattttaaaataaacttttctatatacaaaattaacaaagataatataattttgatatttagaactgattttatctcctttatcttagaaatagatcatgaaataatattcttatcagggaaaactttcaattcaattaccaattttttaaaaaaacttggtcaattaatctattatcgatcagcaacatatcaatgcatcttataaactcttataagaattaataaaaaattttgaactatatcacatatcttaattgaagcagattacactaaaagtggacataaaaagagaaaatcataggtaagaataatacatgaaaattaatttaccgtacatagaacaagatagtgtcaaattctaatcacataaattcctaaacaatttcttccaggtaacatcaatattaacatgggcttatagatttaaaaaagaaaaaaacaaaaacaaaaacctcttcaaaacagaaaccttcttctggcaaatatcttaggaataactattagtctttgtacttgcctggaagacaacctggggcttcttgacctaggagggaaagcagagctgggagccaagagcaatgagatttcattttcttcctgtagcacctattgcaagttccagggccaacaatctcactttttgaaaagcaaaaatgatttaaaatattcatttttggggaaatttgttctaattcaaggcccaaggaagaaattgccagtcattcagaatcttactcaataaatttaatcatatttgagagaaaatagtagagccttattatgagtattttttaaattatcagtgtcacaaataaaactctgattgcaatgcaaattgtaacttaaaattcaagccctatgtacgtttggcctatgaatcttttcttaaataacttaattgttatgactcttaagtaatcaaacagcaagtagtaagggtttactaagagccaggcagccttagctaattcagagatactattttgtaaactgatttaattgcagagatcaatgcaaaggtgtgtgatctacttagagtgtgatagtcatgttttaaaagaagatgtccacaaccacagttctaaactctccttttcacaaactgaggaatcgtgatggttgttgctaccttaccctcaagctgtaaagctctgaagtgaactattcaggaaaagtaaatagtgtgaatttcagtgtttctgttactgcatatagaatttctcatcaaagattcataaaaataaatgaatcataaacatgctaatattaagtacaacaaattagactataaattttagcaaaaaatctcaggttaaatagaaactcatcttgataatactaatgactatttttctgttggtatcattccttctgacagaataacaataagagcaggccaaaaaaaaatagaataattcaaatataaactattccaaagtgaaaaactaatcaaaatattctacttttcattttgtccttccacaaactgaaagtcggatatagataataaatagtggtagcagtattataaagtcatataaatattcatacacttttttttgtgtcaaaagtggcttagtttaagaaataaattccttagtgaaaaaacatgaagaatgtgaaaaaaatggaatttcaaatccacagaaattgtgtcaatatctcttaaaaattccttcaaagcaaatcatatacattctgacctcagtgctatgattgtaacatattcaaaatgtcaccaccacctcttgatataaaacccacttcattcttgaaggggatttgaggtgcagcattaatgctggtctcatacataatgacactcgtgttgtagacacttgagccataaggctcgatgaattatatttgttttcttgttttcattaagatttttaatatatgatagttttttttttatgattgcatgatttgctaaacaagcatagagtagatatggagaatgtacacaacaagaaaaagaataatctttgttttcatttatttagtattttttttaaactccagctaaatgctagatattggagacagaaaatacagctatgaaccaaatataaaagaatcccctgactcaagcttgtccaacctggggcccacaggccacaagtggctcaggatggctttgaaggcagcccaacataaattcataaactttcttaaaacattatgagatttttttggtgatttttttttttttttagctcatcagctatcattagtgttattgcattttatgtgtggcccaagacaatttatccttccaatgtggcccagggaagccaaaagattggacacccctgcctgacctcagagagcatagagcccaatggaggaagaaagagaaaagtaagataaagaaataaaatatacactatactaggtggttataagtgctttggaggaaaagtagagaagagaggttgggtgtatgaggaagagggatgtaataatttcataaatttaagcaggatgatcaggcatggccttactaaataaatatttgagtaaagacctgaaaaggtaaagaaagcaagccatatggttatttaggggacaacttttccaagcctagagagcagccgcagcagtccctaaggcagttgaatccctgacccgttggacagcaagaacaccaggatggtgggatagaatgagtgagctggaaaacagtaagatatgttatcagataggtaaaggggaattgcaaatgttaacattgtaggcctggttaaagacctaggcttttccattaagacattaagttatttcagagatttgagcagatatgaaacaaactctgacttactttttatccgaatcagaatctcttttatggctctgaattatatcgatgagctacaaggacacaagcaaggagaacagttaggaaaatttcatctgattcgggtaagagatggtgactctgactaggatggagttgcagaggtacttatagtggttcaattctgcacatactttgcaggaaacactgagagactgctgctagattgcacagagaatatggaagaaataaaacactgaagttttgggcctaagccaatggaagattgatgttgctattaattgagatgtcaaagactaagtgaagatcatgaactcagttttgtacacgttagacaataagtgtctgaaagttgaaagaatgtctggagaagaggtgaaaattctgaagtcatcaacatttagatgatatttaaagccagcagatggatgacattatcaatagtgtcaatagagatagaaaaagacaaggttcaggatcctggccctggagtaatcaagcattaagatgccaggaagatggcaagtgaacgataataaagactgaaaagtggccaaaaacaaaggaggaaaaccaggcaagtgggctatcctaatgccaaatgaggtaagtgtctcaagaaagaagggggatccactgtctaaagttgctgataaagtaagcatgaataaagactgagaagtgaccgttgcatttagcaatgtgggagatattgctaatcttcacagagcagtttagatgaagttgatctaaattcatgttctcttaaatccactccactcagggtgaattcaggctgaatgcctgaacccaggagttgattcaagagaaaatttggggagaaaaataagaacagacgtagccaattaaaaaaacaaacaaggctgggcatggtggctcacgcctgtaatcccagtattttgggaggccaaggtgggtcaatcacgaggtcaggagatggagatcatcctggctaacacagtgaaaccccatctctactaaaaatgcaaaaattagctgggcatggtggcacatgcctgttgccccagctactggggaggctgaggcaggagaatcatttgaacccgggaggtggaggttgcagtgagccgagattgtgccactgcactccgggccacagagtgagactccgtctcaaaaaaaaaaaaaaaaaaaaaaaaaaaaaaaaaacttttgctgtaaagggaaagataaatggtggggtggcatcttggtagagtggtgggggggtgttaatagctttttttaaaaaaaaaagagaaatgtaggtacatattttaatgctttcagttataatttattagagatggaccaattcataatgtaggaaaaataatgcaaacgttttgtccaggaatagcaaggagggatgagatctagaacaaaagggaaaaagttgaccttttctaggaacatgtacagttcatcacagtagaggataaaaggcaataagatcactaaaaataacagccagtttcactgaatttacaaatacatgtgacagccagcagaatttaggcagtgccttcttatttgccattatatattcctagaaaccataattgacaagataaaataaaatatagatagcaactctatgccataagcatagaacctgacacagaataggccctaaagtatttgttgaataaatagtaattatttatgaaatggttatgataaaattaatacatctaaaatgtttgcccttcataatcatttaaaattagcaaaataatacaacagattagagagactataattcttttgtatgtaagacaatagaaaatagtaaattcttttgtatgtatgtaaatagaaacctcagaagttcagtggttttccaatgtcacaggttttagcaaaagttgaagctgaaatccaagtgttctactttctagttaaataccctttcatgtaacctacagtttctggctgataaaatggatcttatagtctataaaatatgctcagtgcataaaaaggtaaatttatagtatcataaatattagactggggatccttaagtaattaaattcagtataattatatgaattctaacaatcatttcaaatttcattaataataatttgtttgccttactaaaacttagaggtagtcatgagaaatatgagaaatgctttcttttttttttttttttttttgagacagagtttcactattgttgcccaggctaagtgcaatggcacgatctcagctcactgcaacctctgactcccgggttcaagcgattctcctgcttcagtctctcaagtagctgtgattacaggtgcctgctactatgccccgctaattttttttgtattttcagtagagacgtggtttcaccatgttggccaggctggtctcaaactcctgacctcaggtgatctacccaccttggcctcccaaagtgctgggattacaggcatgggccactgcgcccagccacaagaaatgctttctattgtccatgtcttttaaacagggtttccagaggactttaatacttcttttaatctagatgaacataacaagatgaagaagagggctcagggtaaaaacaaaagtatgtcattaatgggatcctggtgaataccacttacaaattgtgtggtgctgaagaagttacctaacctctctgttccttagttttattatctgcaaaatgggaatagtaataacaacagcctcattggaatgttcggaatattaattgagatgatacctctacccagtttaatgaataagctgaatttagtaaccattttatctcctctgattccctcaggttaagaaattaatatgaaacaaaatttcagacagccgtcctagcttctctagcatgattagacaataaattaattatcttttgttttataatgaaaaagtctagtctagactaatgattttatagttttggtttgaaataggattataaaagagacacagccctaaggtcccatctaacctaaagtttctccccttacacttggttcaggcttacttcaagccctgaagtctgcactggagggtaggagtctggtggtctctctttattctcacttcacccactcacagcaactgtttctgaccacttcagactcagggcctgtgaaaagaaacttggaggggaaagaccacagtggcatgtggctgacccttgtgtcaccactgtctgggacttctggaatggcaaatgtggaagcaatgaccttttttttcttcttcttctggagtgcatctgtggcattctcaaagaacccctctgtctgttctcttctctggaatcaatcctccaaatttgttgctcataattcaccaccttggaacctgggcttctgcgagtatactcacctatgggcttaagataaccctaagcaagctcccctcatgaggaccgcagttgctcttcaaacattgccaacctttttcttgaccttggagaactatgaggacttgcctgccttgaaactccttcatctgctatatgggcatccacagccactgtggctgcttttagattttagactctatatcctttactctctaaaggaaacctgttaagctctctgaatgtttttcccgaagctcttctcacttggctaaggtgagcaggaactgctctcatttctcatacatggagtggtagactatgtacaacaaacaaacagctttccaaaacaaaagtatttctcttttagcttttccaactcaatctttgtagagtccaaatatggagtttgagttaagacaaaacttactggttggactatatcttagcatctcctgcaaataaagtcttgtgcctcacttaattagcttcatctccaacagagagagagggaaacactcccactttaatatctgggtgcttaaataaaatactgaatggcatagcgggagtgttcagaaatgttagctattacaattaatcttatctttgttattgaacacttaagaagtaactacataaggaattggccacaagaaaaaaattgagaggaataaaacaaaatatttaagaactaaaagagtatggtatcatgaaagttaaggggataagattcatttatccattttttttggagaagcgcagtgtcaaataaaacaaacctactacaattattaattggttattggtgatagcgaacattctgaacagggagttagaggaaaaatcagactgcagtatagaagtcgaaaaaattgagacagtgagagcaagtctggagaataaacttggagaataagtttatagaaaaagaaaaaataagttgaaaactaaagggaaacacagagtcaagggacttttttgttgttaattgtacttgtcatcattttaattttaagaaatatatttgaacatcttgcaaaatagccagcttagaggaaaagtaattgaagacactagagacagagggaaacaataatcaaaagaggaggtaaaagggagggttcagggatttagagataaatattcatataccagaagggcaatgcttaagactggagaatgtaagtaaatgaagacaagtatgggtatgggtaagtgtgtgggaggaaaataatgagcattgaaggacaacatacctactagcctagaaagggaatgtttatggagaattaagagcatgggaatttcaacatgaaataattaatagcattgcttaacacaaagaattcaagggacatggagaatatgaaagcatcactagatttgcaaaatattggtgacatatatgagtgtactttattttaggaaaacaatgatgatagaagcctgattgcaagggttaaaaaaagaaaaagaagcaatgagcaatacagaaagcaagcagatattttatttggccaaaagaaaaaataactagaagagagaaatacacattaagaaaataggatggctataacaggaggtaaaagatggagcatgcttctcttttacaggtaagggataaaacagtgtgctggtattaggtttcacaaaaaacaaaggagctaaattcagttataatcgcagcacaataggaagggatgttgtttgatgtaatcaagggacatgtgtgactggccatggtggaagtggaaaatttaggaaaatttagttaagaactttttaaaaagataaatcaaaatacctttaaaatttgataaagattgaagagagtaaggatttttaatgctctcaatttgtgctagtgttcattattacccagtaaaattgtgcagttaaggttggctaaagataatgatgacaatatctacaatgataatatcagcaacaatagctacatttaacatttattgagcatgtactacctgtaaggcatggaattatcatttgacatattccaactcatttgttcctcataacgatcttatgaggcagtttctattattatttgaagtaagcactttgaccaaggttattgagctagtaagtagcaagtccaattatacctaggtagtatgcattcagaataaaagggctgtcagggcataatctgttgctctctataagatttactcaaatagtttgaattttagaatgtcaaaagatatatatgtcctccataagtagcctcttttaatttctcatcaagatgtacaccagcacatcccaaattatacatataaaaacctggtattttaaaatgctcagggtttctgaaacacattctcatacctcctttcaatcactcttaagggtagatattatttactcttttcaattaaggaaacagagtttgagagaaatcaagtgactttccaatggtcctccagttaacaaaggaaggagccccaattcaaattcagatcttctgactcaagtccaaagccttggccattcaggacattacccatccctgaccattctttctcttcaatagtctttatatttcaattatcttttctagttttctggtcacatttctatttcaaatctccatacttcaccagaaggttatcacaataagctttctctaacatgaaaatgaccaaaatgactcttttagtaacatttgtgtaggtcagttgcagtaataatcccagtgtttcatttatcctgtagccataccctttgccatttaattctgttctgctttccactctctctaggtttggccaagggacattaccaaaaatgacttaagcagaagtttaagaagcatctgcttattcctatttggctcttactcctcttccatgatcatgagaacctgccagggctagcccattacaggattagacacatggcatagaggtgaatggccccagttggctcagccaaggctgtcctggatcagaatcagacaacagccaattgacataaagctgacacagccaaccttcagctagccagtgacataaagttagtccagccaagatcagccaattcaagatcagctgaatcccacaaactcatatttttgtatgttattgaggtttttgtgttgttatatagcattatttaagcaatggataactgatgaatattatgtaatccatccaaaatcaagattgtaaaataatttttcttcatgatctggtcatcagttcaccccaaattctccagattataccacatagaaattcctgtctttattttgcaccacacataataacagcctacgcttcacagccactatatagaacttcactttcatcctataacctttcatcaaacaaatctttttttcattattgattgctatttaatcttttaaaactaaacaaacaagattccccaaagagtcttctttgtacaaagtagggaccctaagcctagcctgggaagcacagcatatgctgaattttggtttcccatatgtccttcagcaaagttctatctgcacaactttcctgccccacatggaatatctcagaatctttaccaatcgtttctcaaaaatacctctttaatatcactttccacatgaaactttttgtagtgaatcacatatcaacttcatagttcaaatactttcagtacttctataatcttccagtactatatttatttgggcccatttatgtattttttccaagcaactctattccctaaactgtctgagagccaaacttttttccccatcccctttacaaacatatgtagctatttaataatgcacagtggaccctcagtgtatgctaaaaaaggtgatgaaaacaaattttaaacttctacatatgacattttgcaacaggaagcacattccctttacctcttctccaaacattcttaacaaatatattaataactgacaattattcccccattctcaaaaatgtgtaggattattttgtcaatattcctagtaaattactctaattatcctaatgattattcacatatatgtatagaaatgatcatcttttagcattctggataaaacaaatgcaagtaattccatatttaattttttatacattaattagtttttatttgcctcatattctttaatcatcacaagttaccctatgaggtgttagtattaaacactttttgtagcatggaaatctgaagttctgactcaaactggtgatgtgtagttgggtcacagtacaaatctgatcttcctatttcaagtttattgttctttctacatcaaaatgcacatatatttacttctccatttactttaaaagccttttttatgggcctagtactttggcagttcagagggttttgcattattgagatctgctccttttctcaaggagcttatagattaggttggggaacaggcacataaacagacaatttaattacaatatgataaatgataagagtaaggcacacagaacaaatgtacttagggttcagaaaagagttcctgaaagagataaacttttggctgggatgggaaattaaccagacaaagacattgaggaaaaacattataggtagagagatgaacattaatgaaggaaaaagaatggagtttgctgggacacaccaaacagtgtcgtattattcaagcatataatgtgacatatttacaacaccagaaatgttaggagatgcagcaaagaatttcagggtcaggtgccaagaaaaacagaagagtagagagatttgagaattatttaagaggtacaaaaagtgtggcccactgaggactgaatttagagaaggaagaaagcaccaactataaggacccttaaggtgcctaagtaaggagttagagcacacttaggttgtgaattggaggtagatgatgactgggtttggagcatgttgaatctgaggttctgtggaacataaaaatggatctgtgcattaataagttagataattgagggcatagctaagaaacttcaggcctggaggtgtggaatgatgtgaaattatcagcactttttaaacgcagatatacccaaagacataatgaaaaactaaacaatacagctataaaataatttacatggttaaaattgttaaaaattattgttgcatacttttataaagaaataataggagagaaagtgactaaagtaaagctccaatcaccaagacctaatagcactgaataggcaatttaagacatctatgtcataaagtttatctctgctttcaattctaccctgtgtttgctgaaataattttcatttttctgttaccctagtggttttcaattttacatgctttatttctgccccaaaagtcacatttatggtagttattttcaccttccagctaaatgtcaagtgcaatgccaccaaacagtggcacattatttacaaaatattcataaagtttcaacaatagcaattgatgaagaatattcctctattacttatagaaaacttatagccctaaagatacagagtaggttattaaacactttctttaaaaaaaaaagatgattatcactgtctaaggacctgtggatttctaggggtactcagatatttataatagcaacatacaaattgatattgaaaaagatatcctcaaagtatttttaatttagaatggaactatagccatctaaatgtataggctcataatccctaatctacaattccaaaatccatacactctgaaattgatatttgatttgtgaatatgtaatgaatttgacgggtgggaaaatcagacctatacttatcatgagactatttacagtctttttttttttttaccatgcagtaggaatattcatagaattatcttcagaaaaatttcagaaatattcagaaatatgggtgctgcccatagtccttcaggaggattgttctataatatgctacacacacacacacacacacacacacacacatatacagagagagagagagagacaagaaacagagagtaagagagaaagagagagagagagaaccagaaaacttctgagctccaaaacataactggtcccaagggatttagataaaaggctgggcagtatatttaaaaattaaaacttaacattttaaaggcaatcataatttagatactccatacaattgaatagctagaaataaaacattttcattcttgtacctttacaaagagatttacctccacaatcagttacgtataaaaatatttttcagttttctcctttttttcctgaagtatcttgttctagtgctttatttttacaacatttttaagtaaaatagtcaccttttttttacagaagaggaaacatttaaaaatccaaattactttcagatgtattttggtaagattgggatttaaactgaaaacttcaagcttgaataaaatctagaaagacaaatgtaagagggattcatgcagtcttacatgtaggatcagaatcaacttccaagaagagtggaagggaaatgggaacacactgcagcatctatgcaagtcaattagaaacttcagttgactgctgtcccagtacacattgaaggtatgttgaacttgtctccaaatataataaaatcctagtgtaaactaatgaaacactgtatccagaagaagaaatgattgccccattttccacttgttacagtagataaggaagagtgtgactggttctgggaccactttaacaagagaattaactaactcaaataatcctccaagagagtaagcaggatggtgatagttctagaaatcaccttatgaagagcaattgcaaagactaaaatattttccttaaaaaatataatatttggtgtagctatctagctgccttttgaaatgagtcaaaacattttgtgtgatgacacaaaccagggtaccaagaagtgagagttattaaaaacattatttcatctcaatacaagataaactgcctgaaaacgaaaaggactagaatggcagttattcacacagggttatgggtttacctatcaggatgtgacaggggattcttagtgatcctttccattttgagagtcataaatatctctatgagttaatagtacagatagctttagaattttatcaactttgaatatatagttttcaatatttataaagatatctttgctacaagccataactttgtggagagaattcaactctttaacatttagtatactgtcttttaaggagcgggccaatcaaccttgtatttaaaagaaagttttagtttaatgggggtgagtatcaaaaatcccattcatttttatgtttcttctcatacctaaaagaggcacaattatgcttttcattttttttttttttggaggtggagtctctttctgtcccaggctggagtgcagtggcgtgatcttggctcactgtaacctctgcctcccgggttcaagcaattctcctgtctcagcctccccagtagctgggactacaggcgcatggcaccacacccagctaattttttgtattttagtagagatggggtttcaccatgttgcccaggctggtctcgaactcctgagctcaggcaatccacccacctcggcctcccaaagtgctaggattacaggcctgagccactgcggccagcctatgagtttcttaaacaagtaaattgactttcatcattaactttgtatataaataggctggcagttcttaaaatatcttaggattttttttttctgtaaaatacaaagattgacagaaatatatttaaatatagctaacaacgttaagttagtgaggcttaactttttccctttcaccaatcttcaaaatgttttaaaaataaaaagaaaccagttaaagtgtttttttttcccaagggagaggataatatattagtaattccaagaattttaaagcagatattaggcatttaaaaaaaaaaaaacaatagttggacacgagacttccaaagtacggtcattttcaaagaccacacaactgaaaatgaaaaatacatatttccaaatgtcaatattgtgtttaaaaggtaagaaagataaaactatctccacattctggtcattaaaagctgatccacaagtggttttctacctccctaaaacacataaatacaatttttaacaaagactggataagaactcttgcttctcacacaaacccccaaccaccatcagtagtccatgattttgtttgaggcaaggtttcaagtgaactaatcatctattcctaagttgttctcaccaaaacgtgtgtatcacatatgttaagtggaaaagtaacattaagaatgggagtaaagtgaatcttaacaaatgttcaattacaataggagaaacaaaggctaccaggaagcatacctgtggcagggctgaattgagctgtctctggagtgagtctcggtcatagatgacatcctgaagtctttgctgggcaagtgagaggctttcctgggtctcccgaagggtgtctagaagacgatccctttcatctagcatattcaccatcagctgctcaaaatgggagtctgagtccgagccactgctttgggaccccctttggctcattggggtgtcctcattaatcgtgggcatcacttcacacatcattgcttaaagaaagtaagtgggaaggagtcttagtaaagaaatgatttccaataatttcatttggagagcaattcactaaatatttttcagcttattagcctatttgtctctatttcccctacctgttgccccaaatccagccaagcaaaatgttttgacctcaatgaaatatgatccatttacttccttcagcctaagtgctttctctttccatgacatcacatttatcccacctcccatatgcaacttggtttcacctgtttctcaaaattgttgttcatgatttatcccacctaattcaatttacataaacatgtgatttctattattatttcatcacctttcttatctgcaagtttacaaatctcttacagcgaatacttttatgttacccttatttgttattactgtatattattaatggcaagcacagtgtctggcatttaacgggtaggaagtaaatgacttgaatgacttaggtaattcaatgatttaaagtttactctttcttgtagaaaatatacaaatcattgagtatttattttatataataatcagcttttactttgttttttagtcaaccgatttttttcaaactgactagttttaagctttctgacattacattttccattttattacttttatatgctctctccctgaattcctacgtggtctacccagagcagataagtgatactgactgaattagaccaaaaccttatgaaataaactgaggtatataaatttgtttagagcattatactcatcattacacttaatattccctttttcctgttaactgcatggtctggttttcatccaaacaatacaaactagcactctttcaaatattccgcaaaacagatgtcataaattatattagctaatgtagtaacttcacatctcaaccgccaatcacaagttctcagtcatgaaataaacgaactgttttcagaatatttttaaatttgatttaaaatagacaaaacacacttaggtgcatgattgaacaattatgtggcaacttaaaaatcagaaattatctcattttctctttcatcctctagctaatgtttcaaagaaaagtcaaactcatctcaattttggttgttgtactatggccagcagctattaattagatggcttggttttgcaaaaggctgatgtaaagaaaggcaggtttggctgttgatcctgaagcactgtttggttttataatgcaaggttaattaatttttctgcctatacattcctgtccttggggaaaatatttctggtgatattttcaaatagaatgtcaagatttaacagctcaatatttaattactttttatgtgagtcttcatataaattgggttattgaggagcgaaattcaattatctgtgaatgatctggtcagggactcctgaaaactaagaaaaacttttaaaaagtatgtaagtaaagtattttgtgattgataacctatattaaaaaattaagggggtcattgaacattaggaaagttttaaacgctttgaagttttgctcattgctcataacactgagctacctgaaggcaggaatttaatttgttcaattttgtatgcacactaaaatatataacagagaacacacataaaatgaatataagcacatacaccctgatacccacacttgatactactgttacacacttaatggataaaactgtttcttgcatttatctcaatttgattttcattcaaagactatcacaaagatggaaaatacagactctttttagatgcttcaaattttctttatattaattgaaaaggaattggaaaacaacaaaaagtgttccaacacatttgattatttaaaacgattagttagcaggccatgcatgaaacctacacattgagccgctatgtcattctgagaaatgattaccaggagccaatatgtttacttttgacatttaaggttaaaacaaagtactgggagagcaaatcatagcatcatgacaatttgtgcccaaacactcacaacgttagggttacctatagatttaaattcttaaatctatattttaaattacgtccttcttgaatgaaagttattaatccctttccaccctgaatcactcagaacaactttaaattccaaggcaaagcataacagcagtgaataccccaatataattttcacctgaaaataatatcctaacaatccctcattgttaccatgggatataaacattcacaaactttagggtcttaaatcaacattaaaggtagtcttcgatttagtcaaaagatgctatgatgaaaagtggcttagggacttagaaagtctattaaatctacactcaaaagaacttgatttgattccactcctaaggcaggtgaaccaggacaagttactttacatgttaaaactttagttctctctttcatgaaagagggccaataatctatgcttagaggaaaaaaaagaaaatatataataggttacctgactgagaacacacagcaaaacatataaagggcaattacaaatgtaagtattaatttctattataaagtgatcaacattaatctttgtagaaacaatattttacctttacgactcattctgctgctgtaaaggtttaattctagtagatacttttgaactcttcaaatccaatttataaaaatcaaattatgcaaaatttacttaggaaataagatgaatatatgctgcttataccttgcagtcaacccaaatgagtaaatccaaagtcttcttatcaaaattagaaaaaaatagtctacaaaaaaataaggccactttcatgaactagcttagtttctttcattagaattcagattctaacataaattacaaaatatttgattaatccttaaaatgcagtataacatttcttaaatgcacattttgcacattttaagtattaaaagcaattaaagatatatattcaatataagagttaaacacccttttaaaaaatggatgacatctgaagcagcttgcacagtccggaaggctatggtcattcaatgtctagtgcgtttcacccagatacatcacttttaacttttataatcagtatcaatactaaaaactgcattcatcacataatttctgaaaagccagaaagggcattttaacaatttgccttgatatttgctttttcatcattcccccctcaaagtcaatttgatatataaattatgttatcttcatctagatattgatgctttcctcattaaattactgaaggttttgaaacctagtcagagacattgttaattttgttgagaaagaaaaaaagtaataataaatctgattggcttaattatcccagtgcttaaatttagccggaagaattttatatcaggaaaataactcctttattcttagcacatagccttgactgtcttttaaatttctcagatttcaaaataaaagtttgaatgcccactggagtcctcactcaagggctttcaagatccaatgtgttccttaacaatatatgccatccaagcagtacctcttcagatatgagagtgctacaaaaagctttttttcttttttctgtcaacaaatgactttatttaatcatatcactaggaattcggccctactagaggtaagaatgtaattattatccatagtgagtttcttctgaaaacatttagtcttaagaaccatcccagctccacctcagttaacctacaaggagtaattcagtgagagaaatcctagccattgtctgattacattacatgaatattctccctcctatttaactctttgaaagcctctgtcctcgggaaatatgattatcacctttaatggacacattttacactttctttaccctagtgcatttacggacagccagagccagctcaacccacactactggacagttatctctcagccacaccccccaccaccttgaagaagttgacttcatcatttccacactaaaattgttcatcctgcccaacaggacacagccaagtaggcaggaggtagagagataggagatggagaggatgaggtgaaagcaaaaggcacctaacggtaatcaacaaggaggaatttgcatctcatcttccctgggggcggggtggggccggggaggtggtcaaaaaatacagcgaaaggagacagtaaaactcaaagacagcttctgtacctaatgtctgtgatttcgggtccttgcttcttcaattgatcaatgacaaccgcagtctccggcttgaggagaagggaggctcacacccagcactcctggaccatttcc

SEQ ID NO: 1487 - DNA, 500243 bp, Homo sapiens; identical to SEQ ID NO: 1486

SEQ ID NO: 1488 - DNA, 499754 bp, Homo sapiens
gaattcagttttcacaaaggttttcactgctcgtcttcttagatggtagtgcactttaggtagagtagactgaaaagacgccatctaaaatatacaatggatagcattagttcactgaaaagtcccagactgggaaatctcattctactcctctgtggtgtacctccacgcagcctgcttactcctgtcctagaagatcatgagaaggaaatcatctaggatgtagccaacagccgtatgtaattaacatttgcttttctccaatttggtgcaggggagcttaacaaataatagaatttgctcaactttgtggaaagtatggcagtaatgtaaacaaaggtagttatgcaaaatgttagcatgccttctgaaaaatttacaacttgctaattaataaattgggttgaattgacctatttcataatgtagatttatattctagttcatatattttagagttcttaaaaaatacctttatttgttacaaaaacataacgataataagtcacctattgtaaacgtttgtgtcagtagtatggcattgctgattgttttcagccataatgtacttagaaaaagctcacaattgctattactgacacaaaagaaacagcaagtagtatgctctggattattttaatatcaaaagtgttgttgtttcacccaaacaaaaaatggttgtcctagattgaattattgtaaatgaatactgttatcccaattaatggtaaaaactaggaaatatgaactagaatgtcatgcacaaaaaacagattgcaaatagagtaactctacccatcacttaagagctaagaagcaagcactattgaacatattaaatagtcatttgtaaattagtgaagtgttcatttcctgaagaaattataatgctatgtgtagaatctaatataaacagtattttgggagacctcttatttagccaaattattatatactttaaatcatgtctaattaggtgccaaattatataccataattaaaattttaatgtaagggttgtacattctgaaattaaatctcttatcgggatgcttttcattttatcagcttcaaatagtgatccaaataaggcagcatatctgctcccatcctaagcccaaaagaccaacaataaattgtgtggcacttttagttcaaggcaatgaaaacagcacaaggtgagttgttcctctgtctataactgttttctcttaaccctgtgcacacattttgttctaaatatcgctcttaaaaagtatttttctaaaatattgattcatcgaaagtggttaaatattttggtaaagcatagttttaggttgaaaaaaaattatgaacatttgacatttataaatctaagaaaccacagttttactattaagactgtttttcaataaaacctcatttttatatggattttaaagtagctttcattaattggtatttccttaaaatcaaatgcttggtatttatggttacataggaaggttttgtgctggtcctattctccattcttaaagtaattttattttgttcctatatgtcttaaatacttaaaatttatatttgtttttagcaagtgtaaatcagattgataagaaacaatgtaataaaggtttgaatttttcacagtttctactatttatttattgatttattttaagacggagtcatgctctgtcacccaagcttgagtgcagtggcaccatcgctcactgcaacttctgcctcccaggttcaagtgactctcttgcctcagcctcccaagtagatgggattatgggagtgcaacaccatgcctggctactttttgtgtttttagtagagatgaggtttcaccatgttggccaggctggtctctaactcctgacctgaagtgatccacctgcctcggcaagtttctattttttaatatgaaaccatctctaaatcattttcctgtctgttgctatttgactcggtgaacttgcttaaatccctatccgctaccttggcttccttatataaaatatacacttaaaaagataggattttttaaagtgctgaattattatcaataaaatgctaagttactcaacaggaaatggtactaaaaagtagaaaacagtgtagtggcaacccattgatgtgtaataatacagtgataggcctccaacaggcagaccttaaaccacaggagacagatggtgataggaaatgctagactaagtgttacaatatgaagatttctttttcccctgaagcaattcaaaagggttatctcatttctgtactgctagggcataccaaagagtatagtgtatatttattagtctatgtaggttccatttttttgtctttttttttttgtcagccaaagggaaactactcacagcaggtcagtgctgcctcctttgagtggctggtcaacatgagtatgtgcgaacagtggagttgtctaacctctgcagtcttgatgaagcaactgcaaatggagaaaagggctttagagggacttggatgattgagtacaagatttcagatgagaaagatttattttccctgcatacagggattccgaacatattagtagaccttctttctctcagatataagccactcacattcctcttctctagatcaagttcctaatgaaaatttatcccaatgtaaatgacctgagcttttgagttgttatgtattcttccttagataaaatcggtaacaagagcagctcccgagggtgcttctgattttgatatggagattgctcttagagaactcattatagtggattttttttcctttccaagtattgaagaacttctacactaattgtaatgatgttaaattcctcatgaatttcgctgacatgttccaccgtattaacaagttgtaagaaatgtagatcaagatcacagtttatgttggaactaaatttgagttataataactgtgaccttgacaagaaataatgatgctaggtgattatcttaacaaatagcatgggactatttttctttaatgcctcccaaacagaaataattttgtgactactatttcaaagttgtctctcctctggaatgacttttcttttgtaaattagatagcttaagtctaatgtccacagaaggaaatagtaattgggaaattactgtgttttgtgtttctttaattctcttctcatgttcatggcttgtttatttaagggcttctgctttggctagagggaaaaatatttgatgagtgaatttctaagatgacatataaaactcgcagtatttaaacatgtagggagacagtggagttaatttccatttactatggatctttagtccaagtccaacctctaacttaaacaaattgttaattttgggaatagaagactaaagaaacacaaatcctgccgatgtttattgttcctcctagaggtggacattaaccaaattgttctttttgggatgttataaattattttgaaaatgtgaataaagtgccatgagttcatgcaatagcagtgtaaaaaggagtctggtttgtgatgagagcaaagtaaatttcaagcagagcaaaccaactcaagaaaataattccaaaaagcaaggtcagagaattatactagctttggctaaacaagctttttgcttgataagcagcaatgcaaaactactgtaccatctgttgtcatttttcttgactgcccagaggttgtggttaacctaaatccagctggtaatgtttctgaggacccaggcatcatgctgattccatgtacttcacgaggaggaaactgccttctccaggttgatccacgtctgaagttcttgtcatcactctgccagtacagttataaggtgatgttatgaaaacaagtaaactagtccatgtgcttaaagctctgtgcttagaaacatgtaacatagattatttacatttagtctgtcaagtatacgtatggaatcacgctttatcaagatagttagttctatgattccaaaacaagactataggagatttgatatataaatttttaaataaaacttttcatacaatttcaaatttaaggtctgacatctatacagtaaatatccttgaaagcctaaaataagcaaccaatgttttccaaaataaatattgtatatacattgttccactttatgccgacgggttttatggaaagagatgatatacttaattgaatcagttgttgagtagactacatttaactcacacacttgaatgaaatgacttctatgtacacaaatacaatgtaggtatttattttggggaaatctatatttgagatggcatggctaatatgagacactgtagcctattataatatctgtacaagaaactctaaatatgtgatttgtgaagttttaggtgacacagaattaacttgcaatttgttgaaaaatctgtgtagcctggacaccatcctttcaataagtacatgtggtctttgggtaccaccgaaagcataatattaccctggttacattttaataatgtgtattttaatatacacagaggcagagagtcacatcccatttaattggcccagtagactttttctctagttcattactatcaggaagcaacatcataccccacataggctagtgtctctacttggacagatcctagggtgaatccacattttagaatgtagcatagcaattacattttaattctggttgctgattttgttatgccttaataaaataatctcttccttctctttgtgtacataaagtacttttacagacataattattttcctccaaattggcaagtagcaatatataattcagcagtcaatgaatattctgtgtctaattccaaggaaaatatgaatcattccacataggtcttgtcttctcatctcactgtttcttatctagggaaggactatctatgccatagataggtatagccaagtatatgttgtgtatcctaatatctcatttgatttcattctggcatttggaataataagtctatattcactcaacatagtaatttgtgctatgttatagtgaataattctataaggtaggctttgtagactgctatattaattaagggacatttaaagtcaatcagggaaaaataaaatcatttttatataataacatatatccactgtttcaatccttatcatcattaaaatctacattttgtttcagtgtggtagccattttgcacattaagagatgtccgctactcttcccaactgctgtgtttttcattgccctagatctccaaatgtgtgtaaatgtagaaaagaaacagaatttcacagttgcagcctctacgacttcttgattcttggagaagtttttgcattaagcataaatagtcttcagttttataaaacactatgttacactgtagagctacacaactccttacagtgtcgtagctaggggcttaaaaataagccagttttggctgggcgtggtggctcacgcctgtaatcccagcattttgggaggctgaggtgggcggatcacctgaggtcaggagttccagaccagcctgaccaacatggagaaaccctgtctctactaaaaaatacaaaattagatgggtgtggtggcacatgcctgtaatcccagctacttgggaggctcaggtgggagaatcgctggaacccaggagacggaggttgtggtgagccgagatcacaccattgcactccagcctgggcaacaagagcgaaactctgtcaaaaaaaaaaaaaaaaaaaaaaaaaattgccagtttttagagttaagcgtttgaattatgattcctgacttctgttctttcaacatattgttactgcagaaagttgatagaactataaacaacaacatcatggggaaaacttttcatgagatagggttaattcttttaattggggtcaaagtctgtataagcttgttgacacctctcagattatttcagtggaatctgaatgtgatcagcaaaaccgcagaaataagtccactactgttctaagtaagttggctatttttgctcacactaaaaaataaaataaaattgaacaaaagagactagagggtttaaatgacaaaattctattttgtgcttttaaaaataagaaaaagcagcagcatagtttaaagacaacgagtcgcatctcgtttaattggctcaatagacttttcttctagttcattactattaagaagctaccccacacctggacagctcctaagagaatgtagcaatatgacaactcttcaataattttttattagaaatttttgcaacttataagtaagaataattgtattttaagatgtatgagtttataagactacctttttgaatcaataatttctagtaaggatttaaaagactgtcatgcaacttataagacgaggcttttaaaaatattaatcattatgctgattgaataagagcatgaatttatcagaagttagctgagttcaagactgtagaacttatctctctataatccccaccataaaggacagagtggattttataataccaagattatctgtcctgcctatttgaatatagaatgattggtccatatttgaatttgctgaggtcttcacaaaataattttaatcagcttgtctttgtagtaaggaacacctgtactttgcaacacagaattatgcatctctttattttctatttcatgctcaggtttccttcccacttcttccagaaagaccctgtagaaaaactcagaaagactattaaaatgtctacagtccacagcatttgctgatatcccttgtattcattcatctcgggaggctacttacatgtttattattttccaaataacttaatatgcacatattatatagcgattcttatattcaatatagctttcaaattctatgactgttaaaatgttattaatctgttttgaaggaaaactcagtatcaatatataaaataataaaaagctttccatttattgaagcaagttttatcctcattttaattttctaaaatttcctggcaagatatactgatatttaagaaatacacgcactctttattaaaaagctgaatttatcaacattagtgttttaacttttttctaattttttaaaataatgttgcccaacgttttgcagtcacgactcataaaaatgttttgtaaattactgtttagtatctctacctgctgaaatgataatatttatgaattaatatagctctttccaaaattaagtaataagattgaatatttaacaacaaacctggagaaaattattgattctaaccatagaacagtcatttgattaatttccaagcactattccttaaaaacaaagatgttctatcatttttcttttactctctcagatctcttttgaataacaggtggacttacttcatccagtcgcctttcagttcccagggccaagaggttattgtattctctttcaagaatctgccttgcctgttgacgtcaaattacagttaccatcaccgaaatcacattttattttaaaaatcaagtagcttatatttatctgataatgtattataaaccatactttatttatgggttttgaagtttttagccctccatgtctgttattagccattgtaaattttaactacaaaaaaaacagggcttttttttttttttctgtgaacagtagagagacagtcttgcataaacatctgaggtcaagaggctttggcctcacttcgttactatatttcaattgagtattttgtttaatctctgaaatatgtaaaaacaaaataaaaagtgaaacgagactgccaaatttttattgaatctatgtaggtagttctcaaacctggccaatgattatcatttgaggaaagttttgataataaagattcctatgccctatctcttgacaactgatgtcttaggactatgatgtgggttggaggttttattttttattcataaggaactatactgattcaaattattatccagttttgggaatcactgacatatccaatgctaagagtctgtataattcatacatgtaaatagaaatgactgcctctcagagaggcagagactgatggccatctgtcagggatttcatttagtggaatctggcattcaggtgggagactgggccacataacttcgaaatccctttcttgtttaattgtatgatttttttttttttttttttggctagaaatccactagcctgaaattaaaaccccagtgacatatttcaaacattgagttaactttcattaacaatcatgaatacacagccaatttttttctaaaagtttagtttatcattatataaaccagaacacattgagactacagcagaaagtgacttgcctgggtgttctgtgttggaatctgtaataataaagctaagctgctgtagtcaaagttttcatccagggctataagtgagccatgcacaccgctctcaagtatattatttgcatattctcgaagtccaattgcttgtatccagcgaataactcggtcattgctccacaccaacacgtctaggaaaagagatgcatcattttaggatgcattatttttctttcttttttttttttttttttttttttgagacggagactcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcgcattatttttcatagtagaaccactggctgaaatgagccatgggtatctggccaggtcacatttatgctgattcatccacactctaatccatctggctcccttcatttgtgtgtagttactgttttaataattaatcttttcgagtctctatttaaaaaagttgttatttttcagagtgtttgttatagctaaaatgacagcacttcagtcgcgtagaacacgatgtctgtgtttcttgttttcatactagagaactaggtgtctgtctgaagttcaatatttttaccatcagagggagacatttcttatttgtgtcttgatacacacctcttcagtaaacagcagacgagattgtaatactgtctttcatcagaagtgtttgttaaccactacctaaacattggcatatagactagaagattttttttcacctgaagtaatatataagaacagaacggtaaaataatataaggcatcaacagatggatacttaccttagtattatatttcaatgcatttttcccaatcacatgctaatgcaaaattcaagcactcagtcaaatgtcaaaaattgtttccactctattgaaagtagtattctattgaggaaaaaatttctttgatttttattttctaaaaataaaactttcagagaaaaatgccgtttctttttttttagataaaaacatcaaattatgttttatcatttattttcttcaatatcttcccattaaaagttgacagaatgctatataaaatgagtaaaatagtccgaaggactaaaattgtccatagaaaagaaagaattttaagaaacttaaggggatatgagaaaaaaattaaaacatttttactacccatagaaagggaaaggaaactataattactattaaagtaaaagtaagttttcctgtccattttttttctttctaatgaagtgcctagctctttcagacaaagtataaaaatctttcaggaaatattcttcaactttaactgttttaaatacctgtttcaataagcctttgaaaagcatgttctaaataattattttgatgagtctttgaaaatccttatttatcttattttatccatttataaccaacttagatgttcttgtgtataactttgaagcaatacagtgatagcacagacccacagaggtcccctcatgcaacttctcaggcaccattctcacctaacagtaaccaatattctgacttctttcattacagaatcgccttgcccgatttattttttttagcttttcatacataaaatcacccaatatgtacttttttgtctgcctttcattcaatatggaatttatctacgctttagcaaatagcagtggcgtgttcatgatcattgctatctagcatcccattgcatgattatgctgcaatgtgtccattctactgtagatggacatgtgagtagattccactttgggttattaagaatagtgttcctttgagggggaaagggtgggggatggcaagggataaaaaacaacacatcgggtacagggtacactgcttggttgatgagtggaccaaaatgtcagaaaaatcaccactaaagaacttgttcatgtaacctaacaccacctgttccccaaaaacctattgaaataaaaaaacaataaatagtgctgctttgaatattgttatacatggattttgttttgtatatttacatgttgcagtagaataaataacaaggaatagaattgttatgtgtttacttgttagcagatattgctaagcaaattccactctcacaatttaaccttgcattattaatgtctgaacatcttcatctttaccaatgctttgtatttctcatttttgttcttgttttgtcttgctttttttagtcattatggtaggtgtggtattatgggttgaattgtgttccccaaaattcttgtagaagccctaacttccagtacctaagaatgtaaccttacttggatatcaggtctttatagaaatgatcaattaaaatgagtcaatagagtgggcccaaattcaatgagactgttatcattcttgaatggcaaaatttggaaatagacatgcacacatggagagcattatgtgactatgaaggcagggatcgtggcgatgttcctacccgccaaagaacatcaaaaattgccagcaaatcaccagaagtcagggggcgaagcgaatagcagattcttttcagtagcaactgactctgctaacaccttggtctggaacttctagtgtgtaaaagtgtgagacaacacatttctgttgtttaagacacacaatctgtggtactttgatacagcagccctgacaaactaatacatggggtgtctcattgtagttttaatcagtaacacccattatgaactgaaaacgtctgctacttttaaggtttgtcagtttttactttccatattttaaatctacatattagatgtatactaatttgctatatctttccttctattatttgaaaatagccaacttatttctagtatgtttcctgccttaaagtttatattctgatattagaagaatcacagtagctttggttaatatttgcatgtatacctcatttactaataagttttctatgttcttatattgaaagtgtgtccattgtatacagcatatcattgttttttaatctgtccttaaattgaagtagttagttcttgcccatttaatattattactttgatatttgtgctgaattctaccatctatttgtcctatctgttctttgttctttttctctctttcttgccatttattgttttcttattttattctaccactccattagctttcttttttcttttattttttgagactcagtctcactcttgttgcccaggctggagtgcaatggcatgatctctgcttactgcaacctctgcctccaaggttcaagcgattctcctgcctcaccctcccaagtagctgggactacaggcatgcgccaccacacctggctaattttgtatttttgctagagatggggttttaccatgttagtcaggctggtctcatctcctgacctcaggtgatccacctgccttggtctgccaaagtgctgagattataggcatgagccaccatgcccggccctctattagctttttatatttacactttatattattattttagtagtgacacttaaagcttataatatgtgttcttattagagtctactataaattattccttttattattttctagataatgcaaagactttcaaataatttaatttcacttattcccttccttttgcattatagttatgtattttaattctatgtaaaatttaagtcctgcagatattatttttactattattatgacatttacccatacatttttcagttctcctccatcatgtgtgcatttttttattatctttatgatcatttccatctgcctgaatcacttattctaatatttcttttctatttgttttttttctggtgaaatagtctctcagattttgtttgtctgaaagtttattaattctctctttactattgatggacatacttcaaagtaagttagtttgattcagcattttaaggtaataattccattttcctctagcattatttagttgagcaatatcagttatattatgttgcgccattgaaattattgtggagtttactctggcagattctaagattttggggtgtgggaaatcatggttttcagtagctctattgtaatgtgtttagacgtgtttttatttccgcttttatttttaatctcacttggggtccatcgagaaccttgagtctgtggtttatcatttcaattattttctttttatgtctccaccagtatcttttcaaatattgcttctttcttattgtctcttacctcaccatgtccaatatgtctctagtgatgttttatatcattcgtcctttttgtttcttgtcatatgtgggctagatgttttcaagtgatcttttatttcactaaactctcttctactgttaaaccacctattgtgttctcaatttaagtctttatacttttcacttcttcaaatttccatttgattatttgttaaacatattgattccaactatattaaattctccattttctcacttatattccttacatattttttaataaacactgtcagggtcaactatggatatgtttcttttttctgattttatcatcgtggttttcctcattttggccattatctgacatgtctgaatttttcttttattggctctcacataatatgattgaaaaattgcagaggctctgaatgtcaacttcttcttaaaaggacttttatgtttttctgaagttataataagggcagatcaacttaattccaattaaagattgagataaatcaatgctagatttcaattttaacatttcaaaataaagcttaggaatctccttcactatagtaaccattttactacctatatgtgttctgtaatatgttctaaacctcaaatatacataataaaatttatttttaacattaatagacataataaatagcctgatctgtttaagtttaccctagtcctacggtgtgttttatcagagacctcaaattaaagcatatttggtggttatgacctttgattttttttactgtattatcatgagattacaacagttctctttctagatttattaccctttggcttcagctttctgttcaatttttagattataattccatccttcttggaagtccacaaatgtctctagaggagtattgtataaatggtcagtcttacttattttattattactatgttttacacattctttgctcctgaaggcccggcagttttggcacctctaaattccaatccccaccaccaccccactccgttccctgcttctctgttagatagaggaaaaacagaagagaatgacagttttactatttccttacatttttcttttttccaagatcataacctctcaagtcttgtccctcttaattggtttctactgttttcaaatagctctttattaccatttattgatttatctatcctttctatttcttcttagtggaagattggtctgacttaatatgctccaatctatcagaagtagaagttcttcaaattagttggtgtcctttctgtctgtgccaatccacagtactagcaaaacatttgtatatgaatctggaagctgaacatgtatcagcctcacatctctctacttaactccttttgtggatagaatgatctcatttcaaaagaaaggtcctagatctttctttggatttagataataaggaatatgagaggaatgcccacatcccacagtcttattattattagctgctccattcaaagcagaatgaatttctgcccgaagaaggacatttattgtcctcccctcagagttttgcctctttctccccgcccccccccaaaccggtctgcagcaaagcaaaggatttccttaatattctttactatataaggaaattttatattatacatgttaattgtctctctgagtcagttctgaagtgtagcttttcctccgagttttccttagcctattccattgaggttttcagacctcagaaaatgggatgtgagttggttagcatcacattttggctatataatcagctgctgctgatagttactgattcattctaacaactggttaccctacacttgaatcccaaaagctaggcaagtgcttgtgggtggcagcaacagttctccacttaattttattaaacacaccgttttttaaaaatgaacgtgacaatgctctcaataataaaaaataaatccagttttctttgcactagttggatttgtaaatagggagtatttggtttttttctagacttaggtttatattttgatagtctaagacatattatgtggtcgtgatatttctgcaaatatgtgcccatcaaaaattccatcgtcacacctgtagttaagagtgatcaaatatttaaactgatctgtttatgaggtaaagacaaataaagcattaattcaaacgtttcctcctcagaacaaaatacttcttttttttttcatttttaaagttagatctctttccataaatctgtttccaagcaatgtatgcactgactttaaaactgtgtagaaatcttcttgacctaaacaataaatggctagaaatcagtgttgactgcttcttagcaacaaattaaatgttagtaggttcttgatattcacatggtctcttcacttcagaaaactattcattaaggtcagggttaattcacacttcagataataagagacccctagtcactgttgagaattattcctgtaaatgtcaccagatcagtcataggaaacaagctatttatgatctcattcacagctatttatcagatagagttgtgtgtgatcataatgaatcatggcagtttttttttcctcagagctacactctaatcagcaattgccagatactaatataacatttggtatagggccaactgggtaattcctctcctttagatctatctatatgtgaaacatttcacgtggtgagctgaggcataataaaatctaattggataaaaatacttcagaaaggaaactacaaagtggtatcccatgggtaaaatctacctgtgtgctaagacattcattgtgtggtcacatgcaaacttccttctggggtccatctttggtccattaattcccaaatttcaattcaactgaacagcaatgcactgaaaacaacctgcagtttcctggggcccccaaataaagtgaagtcaaacaactcaattttgataatggaaaagcactttcgtgcttcgaagtaatgcatcaaatgaagtgttacaagaaatccattgtgagtctgtctactctccgatgagacgtacgtagaaaactatttttaaccaatcactttcacatgcattcaagcccgttccattagaactaatgtactttccaagacctgacaaagataaaagtaatttctgacattgtttatcaaaaatgtaaattatagaaacctaaaaaaaatcttaagaataaaacagcactaaacgttaatattggagaatgtaatatatactactttcttatctaaattaagccttaaaagaagtgaagatgaaaacagagattcatgcctacccttgaaccattaatgtaatgtagaaacacccattacatttgatgtaatgcttgcacatatcaactcttggataataggaaatgtaaatacaactaataagtattttaatatccaaaattttccttaaaagctttggttatattttccttaatattttcttctttttttttttttttcttgagacggagtcttgctctgtcacccaggctggagtgcagtgcagtggggcaatctcggctcactgcaagctctgcctccagggttcacgccattctcctgcctcagcctcccgagtagctgggactacaggcgcctgccaccacgcccggctaattttttgtatttttagtagaaacagggtttcaccatgttagccaggatggtcttgatctcctgacctcgtgatccgcccgcctcggcctcccaaagtgctgcgattacaggcgtgagccacagcacctggcctttttcttctttaaacaacaaaagtggattgattatttttagcaaaaaaaagcccacgtattatcttaagtgaaacaattcagaaacaaagtcaaatacctcatgctttcacttacaagtgggcaataaataatgtgtccaggtgaacacagagtatgcagtgatagtcattggagtctcagaagggtgggaggctgggagggtggcgaaagatgagaaattacttaatgggtacaatgtacatcattcaggggatgggtacactaaaacccagacttcaccaccacaaatatatccatgtaagaaaaccgcacttgaaccctttaaatttaaaacaaaaaaatacctttacctatatctttttccaatcatgtatttttttccttcaacaacaacaataataaaaatagaacggtctctaagaatagaatctaacatattcctctttgaaattattctttctcgggtatattaaggtacttctcttttgaaattattctttcttgggcatattaaggtacttctcttttgaaattatcctttgtcgggtatattaaggtacttctcaacatttagatgatttatttttaaatatagtattttttctaacaaacctgcaatatggagtgtcttttcttgttattcaaataaaacatttttctgcacataacagctgcagcaatttacactgttcctgataatattaccagctaaaattattaatgaactagtttggtttataggggaaaatccttatatcattcctgcataaaatcaccatataatttctttaactatacagtgttacaaaaataaaattgctggggcactggaataaaattaaaatgatataaaccaaagatgaactgccataaaaatgatataccatgtttctctgaatcatactgagaatgttccattaaaagtctgacaaaaatatctacatggagacatctttagtataagcagaatgtataattaataggttcacataaataagtctcaattcaaaaactcaagattactccccaaatgggatattcaccctataatatggagatacctgtttctgtattttaattagaaaagaatggaaaaaaaacagtaacaattctagccaaatacttatgctacttactgaccattgtaacacatataacattttaggttagtaaaagtgaaagctaaaaaccccagaataaaggcatttcatatgaaagaaagatatattaccttttatttcatgttggcttgcttcccgtcttctttctagttcttttctgtcataattcaacctctttaagcacataattccatattgtaaacttgttcttttttttttattaaaaaaaaaaaaacacagtgagtctaccttagcaggtggagaaagttttgtgattagccatagtcaacactatgcactgcttcttagggcaacaagttaataaattacatttgcagccaaatccttcagtattggagggaaatacatttataattattctaagcacaaaatgtttcgaagtaatagaaaaaaagttttcaaaataagaaaaaacagttttaaaatcatcatggattatattgttcatctatgtgtctttgtctttcatttagctattcctacattaggtgcaggcaaattaatattttattcacttgaaaagaatttaaagtccccattatggagacagtaaggaatttataagaaatggatactctcttcttaagctgatgagaaaaataacacaaaacataagtaagtgaggtaatagaagaccaaatactaaaatgagtagctcataactctaaatgatacagaagtatgtaagaagaaccagtcagcagatattgaaactgaatgaaaaggatatgtggaatgagcagaaaattgattgatccttaaagtatcaagtagcagagacaggttgactcaggaaaatggagcatcatgaacaaaagattgcagatggaaatttaaaggtgtggttagcgagacacacattccagggctgaaaacccatgctaggaagtaaggaggaatacaattatacatggagaaaagggcatattaaggaaagccttaaattgtgtttaagtatgaaatacatataattgatacagaattattggacaattttcggaggaggaagaggtgacaataaagttttctgtttggccaggcatggtggctcacgcctgtaatcacagcactttgggaggctgaggtgggtggatcacgtggtcaggagttcgagaccagcttggtcaatatggtgaaaccccgtctctactaaaagtacaaaaattagctggctgtggtggcacatgcctgtagtcccagctactcgggaggctgaggcagaagaatcgcttgagcccgggaggcggaggttgaagtagcccagatcgtgccaccgcactccaccctgggcaacagagtgagactccatctccaaaaaaaaaaaaaaagttttctgtttaaggaaaagtaatctcatagcaaaataggagatggagaaataagtaatcagagaagatagagaaatcaattcagggttcagttctgccaaaatagggacaacagccatgagcttgaaaggaaaatcgataaaccaggcatgttctgagagagaaaatgagaaggtttagtgacattatgtataaagatgcagaagatgtgataggaaaaaataatctgtagacttcaagagtaaagatcattgattatcagtgatactttacatgtttaggaatataagcaaatttagacatacacattggccagattacacttacttgctagatgcatttctaagccccgcattttaataaaaacaatgttgagtcaaatatttcagaatcagagaaaaatggaaagaaaattgcattaggcaggtgttgtgggttgaattgtgttccctaaaatttacgtgtggaagcgctaattctcagtacttcagaatgtgattgcatttggagatagtgcccttaaagaggtaattgagttaaatgaggccattaaggtgggccctaatccaaactgactggtgaccttattaaaaagagatttggacacttggtgacaacaggtatatatattcacagagaaaggattatttgaggacaccaagaggtgaccatcagcaagcccaggagagaggcctcagaagaaaccagacctgctgattccttgatcttgaacttctagcctccggaactgtgagaaaatgaattctgttgtttatgacacccatctgtggtcttttgctgtggcatccctagcaaactaattcagtgatatactagataatactgatataatcactatcacagatattgggcagcttgagattaaaccaatgcttcttggtcagtttctgccaagttttgatatagaatacaaaattatactatacagaggacatataatattatgaaaatgtctgtcagatggaaaactgtgccgaaaagaccataggatgcaatatacagtcaggtactacttgctttaagttggagattagcataacttaaaaatgaagcttgggcatttcccagaacaaacaaaaaccaagtcatttgagtattttttttaatttgatcattatagaaaacattttactaaagtaataaaacagtattaaaagtcaatctagtgaagaacggaaaaaccggaccccaaaaatctaatgcaaacgtgaaatatgaagccctaaacttcccgtgacagggagctcactcactacctcacaatgtatacactacaaggcagctgagagtggtacaaagttgtttcttctattaactagaagtcactcacctaggatctacatctgtgttaactaaaaaatgaggtgctcaacagagaaaaaataattcttctatcacataataatgatcttaaaacctaagaaaacttacttatttaaagtcttccttcatccaatttaaatgtatttaattacttcaactttaccactggacttctaccaccttataacaatttgatacccacaaataaatgcaatttctttttgttatgtcactgtatggtagcacttttgttgtctcagccaataaacacagtctaaacatgccttgtcaagccattaaccaaaatggagagtttcgtgctaaggataaattccttatctttttcacacaactttctgttaaattatggattctccatccagcactttaatgggttttttaaaaaacactgttatatttatctttaccacatttaattcaacagtgtcaacaactgcattaaaattcaaaatatcaccataagttggaagcaaaagccccaattatcctctatttatcctaattttatgtcatcaacatatctaatttttataccatcttcactccagccactgattaaatgttggacaggagagaagcaaatacagtctcccaagccaaaatcatctatggttatatttattaacttatcaccacaatcaactttatgtgaaaaaaacaaccaaaatccagctgacattgcttcacctaacataaacatagcatttatgatatggtattataacagacccctttttatctgctggatggtaaacaacttgaaaaaaagacattgccttttgttcaactgcatcctcacagttatctaacacagtattgtttttgttctgaaattaatatacaaataagcaaactcataaaaagacatagaaaaataaaaaaacacaaatatgtcttagaagaacaatttcttctcaaaattttccctagaatgttcctaaattataaaatttataaccacatatttgtgtagagttgaaactatgaatttgtttattcttcctaattttctaatataaacacatataactataaaattaccaacatggaattttcaaagaatctcacaaaaaaatagatgtatgctctatgaggagaattttgtacacatatatttccataaactttgggcacataatatgcacatagctctaaattagaaagtccctgcaatttgctggatgaaaacatttttccaagtagatgtatacaaacgatgtttcaaatgacatatattttctgtcttctagacgtccatttttgttttactaaagtataggtaatatattgtttcattttaattattctttggggaaaaaaaagaaaaaacacctaccgatggaaactatccaccatttttaaatggacacggagatctttttttgttaggtgatctaacattcttgcatctaccaagcattccataaagtaacttctgtactgaggtaaccccaagctgggaagccattcatttccaatccactcatgattcatatctccataagccagggtctgtagaaaaaccggacactagaattgttttatagcagtcaagtttcttaaccaatcagataagatggtaattggataatattacctattattataactgatatttaattactatgatatgtggaaacaaagcaaaaataatattcagatagcatttgattcgatttggtataaaatggaactctgcatacatttattaaagcatctgcctattgaaaatgattggctatttactttgtattctcaaaaggaattacattttgtccaagtatgtattttattaataaagaaattattatacaaactctgagctttaagattctgtctttaaattgataggtttgttttatttgtatctgtcatttccctcttgtcaatgcacttattgccatttcccacttatcaatgccactactaccattgctatattgtaatggcaaatgttgatgtgaaatgggaacctcagtaaacagagaaaggaataaatgttttggagagacagaattttgaagctttttatggacattgttgttacttagcaaagcaggtcgtcagctttccaaaaaatcattggaaagaatcagtcttttctagaaattaatcaagatagactctaaaagaagcaggacaggatcaaaaactaagacagataacctaattctttaatataacaaacaaactattcttaccaatactgttcaaaacagctaaaatgaaaacccaaatcaaccattaccactaaaccaatattttaaaagaactattactctctattatttttacagaattcccatttagttccttatcatgccctaatttctcaattctaatatgcatttctagggaaaatctaactgttcctcttcttttgtgtgttctcaagaacaatgaaatttttatcaaaatcaaaatcaaatacaatcctactgtgtgtttaaatacaggtcctaatgtaactaccaaattttttcttatattgaaaggtttcaatcagattgaatataacacaaattttctcttttggtcatccaaaatgtggaaatgtagaaaaaatgcacagcttccttgcaaaagtatatgtctgttccaagtatagacacctgtctcatacaaacatctcaataaatgctagtgactctgtggtctgcaacgccaacacttgctcctccaacctctcttcatacactttgcattatatctgaaggcatgtgcaactccaaataagtcttttctttctttttgttccccctttagatccaacttgaatgcttcctgattaaatatatacaggagtgatttcagaggaatttaagttttggatcattcttttgagaaagaaagaaaagtacccttttaaaagaggtaaggtatgaaacgtcaatcatcttattttaaaaatatggtaacttaaaaagacatataaagtattaaacataatctacatttacctatacacatcagcctaatattgagctaagtgaaggtttacaatattatgacttatgacagtttcttgatttatattctcattgcctactaaatgatattaagggtcttaaagcatatgaatctcctacctgggcccagcttccttcctcagattctttctgtgttagcagcaggaaatgattaataaagcaggtaaatataaattaatttcaaatcaatacagtaaaatttttctagcagaagcaaaattgttatacaaaatattttgtataacaggtagaataaacacacagattcatagacccacagtgatcaattttgcagttcaaaggcaattaggcagcaactacatcattttcaattaattctaatttaaatgttaaattcataattttgtgaacatttgatttggtcattacaaacctttttttaattcttaaatgagtgtaatttttaaaatgtaatgtgctataataaaaacttctgatgacaaatatatatatgtatatatgatagagaaatcttatacaaagtaaattagtgaagtgaaaaaactgtatccctccaacaaagctttgtgataatcaaatcgatttcaacaacagccaacaaaacaaaacaagacaaaaaccaagtacaacaaaactaaactaaaaatgaaattagtacatgacattggtgtttttatccttaacaaacttgtagataatcaattttcaaataaggataacactgaaaagacattaaattaaaaagaagttgataaagataaaatatatgatatgcccaactttgttactttacatgaaaaaatgatttttatagcattttatttttaaaagtgacaaagagtccccaagaaattctttaaaattgtgcttttcagtaccaaattaacataacacttttttggttttttgggggtttttttggtcaagcttgtatctaagatggtaaagcacaagaaaccacatgatcatattaaaaatgaatattcaatctaatcttttctattaccaatttaatttggtttagaaacatgttacctgtgaatatgtccaatactaaatatttgttacaaaaacttccaatgttgcaacatgaatactatttattactttcttccttattgtttgtgtactataagctcttatgatattagccacaatctaacactatttcattaaaaaatttcaagagagtgcagtaaaagaaaactgtaaaaaatgttagttatcattgcatgtaactataaaaacacaccctattactctggtctattgtaaacagattagtttcctcatccaaagagcagcaaagtcactttccttcaggttcaacaaagccattaagactaaccgtttttgctggagctgcaagattttccatttcttcatgagtcacccaaacgttgcctgaaggctagtgaggaggcccagagggaagcagaggaatccatgggaggcaagcagtggtaaagaagaaaggcagcacctctgtgagttaacagcaacacagcaataccacagtgcccttgcccctaccgtgtgcatgaaagagacagcatggctggtttgctcagagctccctgtttcttctactcaaaaagattaactagaaagaggcattctgtgaagctcttggggatgtagatttaaaatgacatttctgcaattattaatcagaaaaagagcatcatcaaaatttgcatttcaatggtatgtggctatcagatcaatttttgtaataacggtgaactgattaaatttgaactgtagaataatgtaattttaattttttactcagaaaacaatggcacatgcactttgttgtgttattatcaaaatttccttcacataattttgattctcgatatcctttgaaggaaaaaaaatggttgtcaatataaagcgggaagcattatcgtaacttatctggaaaccagcatcagcttttcccaaaagattccttttactgtgtgtgattcagtaaatagtaagtgtccctgaattcttgcagctgagaaagaagtgaaatgctatttttaatttaataaaatgtattttttagccacactaataactgtcaaattataaaatccatatatttcctaattctccaccagtatctgataccattatagagaagaacatagtgtaaaataattttttttctctagcaggcaatattctattataaagtcccatttgctttctaaataaaacaccccttggtattagttctatacacttaataacgtacagtttcgaaaccaaagtccacttagtaacatacagatcaggcatatcattgaaggtattggcccctggaaaccacttgccatcaaattccatcatttctttatgaacattgcaaggttttccaagcacatcaatgaaatttacatcctatatattatctgctacttgttttggggagggtccaatctttaaagaattggtgtagcaaagttgttacccaaacattacaagtcatcaccataattcactttgggtttttctgccattcacctagtaccataacttttcctgtattaaaaacaaatgtaactacatataaattgatgagtataatttgatgtaagtgaaatcttatatatgtatatacatacatatatacagtcatgcactacataccgacattgtagtcaagaatggggtgcatgcacaacaaatggtctcatatgattataatggagctgaaaagttcctgtcacctagtgatatcagagccattataccatcgtagtgcaatgcattattcacatgtttgtggtaatgctagtgtaaacaaacctattgcactgccagtcgtctaaaagtatagcacgtgcaactatgtgcagcccataacccttgataatcatcattaatgactgggttattggtttatgtatttaccacaccatgatttttaaatcattattttacagtgtactccctctacttttgttttttaaagagttaactgtaaaatagccccaagtaggttccttgggaggcatctcaaaagaaggcattgatatcctaggagatgacagctccatgtgtgttactgccccaatgacttttcagtggaacagaatatggagatgaaagacagtgatactgatggtcccgatcctgtgtaggcctatagtgatttttgtgtttgtgtcttagtttgtaacgaaaaagcttaaagaggggaaaaaataatgaaatagcagaaagcttataggacaaggatataaagaaagatattaattttgttcagctgtacaatgtatttgtgttttaagctaagtattattttaaaaagagtcaaaagttaacaaaaaaaaagatttataaattacaaatgttaccataagctaaggctaatttattactgaggaaataaaaaggtttttttatgaattgtgtgtagtataaagtatagtgtttataaagtctacagtagtatatagtaatgtcctaggccttcgtattcactaagtgccctattcacgtgtaccattttttatcttttatactatatttttactgtaccttttctatgtttagacatatttggatacacaaatacttaccacagtgttacatttgcctacagtattcagcttagtatcatgctgtgcaggtttgtaccctggagcaataagttataccacatagcctaggtgtgcagtagtctataccatttaggtttatgtaagtatgctctatggtactctcaaaacgaagaaattgtttcatgactcatttctcagaacatatatctgcattaagtgatatttgattgtatatatacttaagtaacaaatggaaatgggtggtaaagattcataattataagcaaattcgaggcacataaaaattccacaggctagacatcaaatatatgtatagaatttattttcttctactgttttggaatttagagtacagatgatgttttttctataagataaatctgtgtacacctattaaataaatttagaatataaaagtcatttatgtccttaaaagtcccttccttgtattccctgcttctaacaatgatgctcattataaacagaaagttgcatatgagtatataaatcattacattacttggaataaattgtttttattgactttaggaggagagtgctgtgctgaaaagtactttacatgcatctgtcacattccctttacactgagttatcgtggtgctttcttgagtgggtatactgttggttcaaagtgagtttcagcaatgattacctgagaagaaattcatttaagccaatcttaaatggcttaagcttgcagaacagtgtaaaatcaattttacactgatttgtgtagcttctgctttgaatcgtaatccaaataatgaagatctcattacttctttaagaaactacctgtattaattatctcatactagaatagatacatgcatagtatctttcacagattatctttaagtctgtgtctgccagtctgtcaccatattctgggatgtggaacatgctggaagctatggttttatctgtttcattcctcacaaaataagcatatacccaggacaattttctgaagtatgactggcaaactttcagaagttgtatgttagttgtttctgtttgatatgcagttttacttgtgaagaccactgccagccctatagtcttgtaaaaagccgacagaaatagtttctacacaacctagtcaagtagacattaactgaagttttaacaagtttattttataggcaagctcatatgtagtaagtcaattattcaatcagattgctctctctccaccaccactttaggggatggaacttgcatctaagtacattgtgacggagtaatttacagcatgagagtttcagagcaaagcatccctacaagatagctagattgggaaactgagcaatcaaagggcataaagatatgagtaccttgggattgaggatacagtacaaaaagtaggttggaaaagcataagaaacaaatattgtataacttggttgtggttctctgagatccccttaaaattatctactcactgcccttggtagtctgtgctgcaatctcccccaaaaatgtgcgagctagaaaatgcaaaccaatagtcatttttttgtggctaatatcatctgagtctaacatgaaatttataaaatttcaattatattatcaaattagaatcaaggggcttgagttatacagtagcacttactaatgactactctaggacatttcctaagcctgtctaaatttcaggttctgcacttcttaagtgggactaaaagtgcatgctccagaatagaaagaaacactaaaaagtttacattatgatacaacatgttcttatacagggctgggactaggatgaggcacatgaggtcctgggaggctataatttaaggaaacattcactttcagggttgatatctgacaatgagagcctctttaaattttatgcttgagattatcttgcttgtctccccttagtacccatggaatagaactttgagaaagtatcaagggagaaggagaaggaaatttctaaaaaatgatcagaattaaagaacttacctaatgaaatcattctggaaagagttaagacagaaaaataaatattacaatgaacttaagaaataacttgtgaaaattaatcaggtgaaaataatgagtagtcttgctgtcagagatacagtataagtaaagcagccagacctcagaataatcctaaatcttacctagttaaagtaacttttgttactacctaggtcatttaaagtgttttttactttgtaatggaattacaaagtagtaacttgaaattacttttcacattcaaatggcctggatccacatttctcccttatctgaatttttgtctctcattataagataaatccttctcattataataagaatgatatttacacctcactctcttttcaataaaggttaaggtttataaaggcaattataccacaccctcttttcaataaaggttggggcttatgaggtaagtaataatgaaaagaggaatcaaacagactaaaagaatgctataaaaagaaggaaaactgatagagtgcaggaagcagaagcaggagaatgtgcttgttaggagaaaacccacataggagtatgaccttaggtgagtcagtttacttctttacattagttttgcccatttgtgaaacagctataataaaagtacctttctcatagctgtagttgtgagagtcaaatgggctattacatgtaaagcgcttagaacagtccctgacagtgagcattctgctgatgttggctactactgtaattatattagatattctgttaggtagtctccattcaagcaaatctttaattcaagaaatactctgtaggtctctgtattacactgagctgactaatgcctatcttacaccttacatttatgtttaatcttgttgaattatatggttatcaaaaatcactttgtttaaaacttatttatttccactgcacttgcttttaaaatgtttaattcatcaacttaaataaatgttacataaagcaaaatataaaacaaatttggctcctatataaacactaagttgaattagttggaaaaaccagagataggcaaatcttgaatgaaacacactatcaataaaatacaattttgtcaaagtctggggaaggcattgtaaatgtccagaaggattcctcattcaaatggctttttgagttatcttgaagtcgtcactttaaaaagaaacaccaactagagaaattaaacatgtttccagataagattatctaaaaggataatgtggaactccagacattggaaacatacacaaaaatagttttaggtgctccatctaaatttgcaattctttaacatttctgtaatttttacctgagataaagtattcaaagaatgcacttatttttgttacatccttcttcaaccaaatttcaattaactggtatctccatctctatcctactaggtaagagactttctgtagtaatagtagcttggagaaaagaaacagaaagctggaaatttagggctggctcaaggtaatcatatatgtgacatttaaattttcctttttgatggtccagcccattatatctaggcaggaaaggaggctgaatcaaataaagtagtagaataaataaataaataaaagttaaaaataaaaaagccccgaagcccaagtaccttgtctttttctcctcagaacttcagttaataaacacgaaatacctggctgaggaacccaagcccaaacctcagtgtgcaaaataacttgtataatctaaacaaactgtagtgttcttgaagacatgatagaataactttgttaaaaaaaaaaaatctgcctttgtgttttgtaagtgtgaattctaatacataatgttaggttatgactttatgtagtggattcattaatagtgatttatgtggaattttcatttgcaatgcaaattgtattggaaatatattagaaatgagtaaatgctaccatgtagagtgagtagaaggaagaggaaacatttagtagatacttttaaagcctagagacacaacttaacttgtctcatagaatttgcatcagtatctggcaagaggtacatatattccgtgaatacagagctattacacattagtaaaaagatatatattcctataataataaagataagttgggaaggttatgaatagaaaattaatataaataccagattaataagaatataaaaatttgcacatttagtagtgatttttaaaatgtaaattaagcaaggagataaccaatgttgacaaagggagaaaaaatagcaacacaacacaatttaacaattaaagtttaaaagtattaagaatatgcattccgtatacacaaatatagcaatggaaataaccacagtttatgcaacaacataattacaagcacatattttacacacaacaacaaattgtgttacacaaaacaaagaaaatgtccaatactaggaatttgattaaataacttatcacatttctacaaaggacatattcaataactaaaagtgatgttgcagttgcatatttaataaaatgaagaaaatgcttacactacattactaaatttacaaaaaagtacaaattaatatattatgtgaaataatccatttatataaaaagataatgaaaaaagaatgacaagatcttcatcaaatgttttcaatagtgaaaaaattaacattgattatctctaaaatcagtattttttaatgtttttaaattattttgttgtcatctttgtatttttctgtattttacaaatgttatacaggatcatgtattagttcaataaacatataaaacttaaatgctataaacaatatattttttatgtttcaaatgttcatttttgtctgaagccttatccagcttgtagtgatttctcctttcttgaagctccatcacacttcacttctattgcacattttggagttaatctatataatcctgtactaaatctaccagtcaacatgcttattttccttagtagagtttccctttctgatctcaaggccacacgtttcttatacttcagcagagtatatgaaatatgtgggtagagtgatctatacaatgattattttaaggtgaatatttacataatatctaaaatttgccaggcactattgctaaggcttggggttgatggaaacctgatgctatctttatttcgtctagtgtgagataaatgaagaaaagaagaactgtaaaatgttgtttataagtacatggagtggtaactcaggaaggaaaccaaacccaggctttgggggctcagcaaaagcttttcagaggaaatatgtaaaggaatcgataaatgaataatgaattggagaaaatatgatgactttgaagtaggatgaaagttttgggcaaagggaagaccaactacaaaagctcataactgaccaaaaggaaagatgtttgaaaaactgaaagtagttcctgacctgggaaataaagccttcgaggtgaactgaggctagatcataaagctttctttacttctccccattctttaaacaattgaatgttaattaatatggtataatttaaattccttcaggttggttaaatagttttagaaaaatggttttaaaattccctattgttcattaagaaatgaattacactggtaaataaaaataataaaatgtatcatatttttcatctggaagttgggacttcaaatttatttttgcaagattcataatgtttaataattttgtttgcatttgctcttgggaggaaaatgtggatataaactatttatgatgcttctctctcagctggaaattactcagcaaactcttcatcagacttaaattaaatttacaataactattttaatggtcttctcagtttcttattttaaatatacaggtggctcttgaacaacacaggtttgaactgcatcattccacttatacacagactttcttctgccactgccactcctgagacaacatgaccaatctctccccttcctcctcctcagcgtactttcaacataaagacgacgaggataaaggcatttatgatgaactacttccacataatgaatagtaaatataatttctcttccctatgattttcttaataatattttcttttctctagcttactttattgtacgaatggagcatatatgtgtacatataaaacacataatacatgcttatcaactatttgtgttatcagtaaggcttccagtcaacagtaggctcttagtagttaagtcttgggagagccaaaaattctagctgattttttgactgtgtgtggggggtcagcacccttaactcctatcttattcaaggggctattgtattctaaattgtcttttagcttgagtcataatccaggtatagtgaaaaacatttgtgtctatttaaaaataatataggtaagaattttaaaaattatatatttttcctacatgtcatttaggaagaacttaaaatggagttatgtaagaattatataagccttttaaatttgaccttttatttctggcattagaatctagtatactgggaaggaaaatgtgtaaatagaaatgaaacaaactattcacaactgtttaagatcatgtataaaaaagttatacttgttacttttctgcctgaaaactgcaataaagtaataagactttttaatattttacctattgctaaaatttatctcattctcccatattttattatgctatataagatatgagatttgggaaatctagtaattatcagaaataatatactttataaacaaaatatataatttaggaatggaataaacaaataattaaatactatttgggagtttttgggaatttgtcgtcatgcatgccttttttgtcacattttgttcttttctaggattaggataggtaaaaaattatgagatgactaggaatttataactgaaaaacaaacagactttgaaagaaaaagatattccagatattccatttggtatctgtaaaacgtcaaactcacataatttcataattacagaaacttcttaagaaatagtgagttacaaaagaacacatacaagtgtccaacaaacatataaaaaagctcaatatcactaatcatcagatatatgcaattaaaaccaagtgagataccatcccacctcagtcagaatggctattactaaaaagttaagaaaaaaaaaagatgtcggcaagggcacagagaaaagggaacacttatacactgttggtgggaatgtaaattaatacaacctctatggaagacagtatggagatttctcaaagaactaaaaatagaatgagcattcaactaagtaatctcgctacttagtacctacccaaaggaaaagcaattgttatatcaaaataattcctgcactcatgtctttatcacaacattaatcataatagcaaaatcatggaatgaatctaagtgtccatcagtggatgattggataaataaaatgtatatacacaccatggaatactatgcagtcataaaaaagaataaactaatgtcttttgtagcaacataaatggaactggagaccattatcccaagtgaaataacttggaaacaaaaaaaaatcaaatacaacatgtcctcacttgtaagtgagagctaaacaatgggtacatgtggacaggtagaaggaaataacagacattggagactccaaaagggaagaggttggtagggatgaggtttgaaaaattacccattgggtacaacgttcactatttgggtgatgggcacactggaagccccaaaatctccattacataatatacccatgtaacgaactttcacatgtaccccctgaatctataaaaataaaaaatattaaaactaaaaaatgtagtcacttaagccttgcatctttagtaatcactaatgcttatatcttatcttctgagaaattacctgagggaaagagaaaggaaggaaggaagaagggaaggaaggaaggaaggtaggtaggaaggaaggaaggaaggaaggaaggaaggaaggaaggaaggaaggaaagaaggaaggaagggagggaggaagggagggaggaacaaaggaacgaaggaaggaaggaattgaaaaaagagtaagctcagggtcttgtcgcttgggagaaaaatctaaacttcagatgctagctcaaaagtctgctatgctagctttcacgtctgatatgaatcatagttcctcatttgaaaacctattaaaagtagcagcaaggttaataaagagcaagcttaatctcttgagaataattcaagctgacattgaaatgtgtgctgtcacaattttgctctgtagacttagacacacggctatttgcctagcactgaggaaggggaggagcagaaactgactcacagttcgagatgttggaggagctgaaggacttgttagggaaaccatctcctggattgctaatcgaagttttaagcgatgcagtggattgctgattccaatttctctctggatctcagtgtcagataaagcagacatgatggcaccactcttcacgttggctcggcaggctgccacgtaccacgcaggcattcccaaccaaagctgttagataggaaaaaatacactaacaaattataataatagttatcattttagtgtctcatatgctaggaattattttatgtatcttacatacatgacctcaccccacgagataaaatgttatcattattttccctagaggacatagatgcacaaagaaattaaatgatgtatttaaaaacaccagggaggcagggatagaaacaagatttgaaattgagacatgctagctccagagactctattttaactaattcatattactagtggtaaaagtaatggctgcatggcaccaagttcccctttgtatgtagggaccagaacggctacaagccacatttgataagggactcaattaatgtttgcttaatgagtggcttcaatttataatgcttctttggaattctgagtgaagagaaattctgtcacagaacgagacagctgtgccacatccagccatgtgatttcgatcaaagcatgcagtgtagctaagccacatttccacctaccttcctacaccatgtgaaagatgtgtgaacttaattagatgctatatatgaaaatgccttttagagagtgaaatgatgtgctaagaaagaagttaaaactcaaatcattgaaaaactaaagaaagcaacaaaattaataatgcatcagaaattagagattttaagactgggcacagtggctcatgcctgtaatctcagcactttgggaggccgaggtggaaggatcacatgaggtcaggagttcgagaccagcctggccaacttggtgaaacatcataatactaaaaatacaaaaattagctgagcatgatggcgagtgcctataactccagctactcgggaggctgaggcaggagaatcacttgaaactgagcagcagaggttgcagtgagctgagatcaggcctttagactccaggctggggacagaatgagactctgcctcaaaacgaaacaaaagaaaacaacaacaaaaaatgaggccaggcgcggtggctcacgcctgtaatcctagcactttgggaggctgagatgactggattgcctgagcttaggagttcaagaccagcctgggcaacatggtgaaactctgtctctactaaaactaaaacaaacaaacaaaaaaatcagccaggcgtggtggcagatgcctgtaattccagctacgggggaggctgaggcacgagaattgcttaaacccgggaggcagaggttgcagtgagctgagactgtgccactgcaatccagcctaggcaacaaagtgaaactctgtctcaaaaaagaaaagaaattagatattttgatttttcaactttgctgtgagactcttgaaagacaattaaaccagcagtgctatttacacagcacaggtctcgtgcacatctcaagcactgggtgaatgccaatcacgggcattatatttcagcacctgaataacatcacttaaaacaggaatattctcccattttccctccatcattagttatgagtaagaagtagaaaacacaacaaaaaattagcagcttacatatttgtttttgaatgtccaaaagattgactgatttttttttctatttgttgaaataaacagattgaacaaaggagagaattgtgagagtgagaaaaagtgagacaaagaagaaaaactataaatcagcaaaatacagtgccaagagctctggaccacaaatcagaagacctgagccctaattcctttccagtcattggtgagtcatgtaacccatctaaacctcagccatattttcctcatttgtaaaatgaaggaatcaagcttgattatttctctctacctcctgatatccgttcccttctataatctccttcttttgggggtaggattggcccagtgatttatttctaataaatagctgatgataaaagtgatgggatgtcactttccagtttaggcaataaaatgactgtggtttcattcctgctagtcccctcccgctgtctctttccctctgagctctcactctggagtaagtcagatctcaggagccctgtggagagtcccatatgacaaggaactaatgtttctggccaacagccagcaggaaactgaatcatgaccctgaccatatgaatgagcatggaagtggattctccccaagtctagccttgagatgactgctgccctggctgataccttgattgcagccctgtgagagactctgagcagaggccatcacaaagctattcccagactcctgacccatagaagtcatgagatcataaatgccaaatttgggggtaatttgtaaacagcaatagctaaccagtataaacatccttttagttgaaaaattctacaatattaaaagactatttgtctcttttgaaaaaaaaaatgccaacaacgaaactctttgagtcagtgtggactgggttgtgatagagataagagaaaagaaggggaagatctaagtacaatgtgtgactgtacagattatgctttcttccagcaggttaggcacaaataattgaccttgacaggtacattatatatgacagaagatagtacttgactatttagtttataaactcaaactgttcaaaataactaaacatctaaatatgtcttctttggaccctaatgatttttttacctttgtcttctaagatatttggatttccacactagttaacatcacccaaatgcctgccaatacattgttaccaatgtcatccataattagaccttaaagagtctttgatgcggataaatggcatgtgaagcatggaattctcgcctacacaaaattcttaacaggctgtgcactcaaggaggaacgaaaggagatgaagttaaagtttcattcattggatcactcagctcattcatcttgtttattccattttataatttaagttgcattaggaatcataggcaatttctgtgtactcagaataggtttaattagcacaaacttcactgtctgtcatctcctatcaccttaatgtcagtaaatctgtttcttttttctttttatctgaaggatttgttcgtcgcttgccaaaatagcagcgaactctctgtcaaactgcaactcattttatcggagcaaaaactgaacaaagaactgctatcatttctgaggtgtgatttcttaagcattttgtcttgtgattgattttttaaatatagtaattttaaagacacggttgaaagaagcagctgatcgctaatatctgatggctaatatgctaaatttccctgtctgatgtgaaagaataaagtaaaagcaaaatacaggcatttttcattcagtgcaagaaaaaatacaaagcgtgtttctagatctatctaagtctatttttaaaactaaaatgggctttaatgtttctttattatttatttacttagctctggctataataaaatgaagacggataattttataatccaagaccatttaaaacaacatgtataattacctctggcaggcaaggaaagcctggattcttctttgccctgacacaggcatatcctagcagctactagcagctcacatagagaactgaatagaaggggcagtgaacagtactgttaagtgacatgaaacagcccttcgtagtcaaatatgtagttccgtcaatgtcaaggtcagtttctgctgcctcctacactgttcagatattcccttatttttccagaacactatgttgtacaggaaatgctgaaaatagttcttcttttattgtagcattcagtttggacacagaagggaataaggtgtaagtcttctgtttaatcccaagtgtctaaacctagctggtccataggctttagagaactaggttcaggaactaaattacaggcaaaggaatgtctctctgtacatctaggtgatcttactaccttggattacagaagtgttgaatatggagagggtcttctctgtaacctgctaatgaggaagggccctggcctaatggatgggaatggatgttctcttgcaacaataaaattttgtttcttctcttgctctagaaatgaaaagggtgtgatttagagacacttccttttatcccactgcatgatttcttctactacgatcacaaaaaagtgtcagcataaaatcataaatttattccctagtaagcaaatagtcccttatgagcaattccagactaaggggatgctgtgatttcagaaacttgccgttacctgtctcaaaaaaattatcaacttagtagtgattgattcaagggcctcctagtttcattctcttacctctagccatgcgaccacagttggcccatcccactgggcaaaaggtaatccctttctccgagcttcttcaagaagttcatgcctgaagtatatagcaaagattattaggcaggtatatggaaaaatatggctgtgattatttttaatgataatattttaaaataaccaatcatcctttacaagattttttatgatacaatatagaataacagaattccttattcctttgagtaacacacacacatcatccattgattttattacgaatgaagcattgacatagaaaagtaattttccccaacatttattcatgaaaattagaacattaagtgctaatggaattagaagtggaattatattaccagcaaatatcttatccctttaatgagaaaatggcccaaatgttcatattcaagtatgcattatgggatctaaatgtggcttccaccatctgccctgccctctttgccttactatctccatggcaaagaaaatgcttatatagagaggcagaagataaatttggtccttttagtcacattctagtgatgtggttgattttagtatgccctgtgggtccagggatctatcttaggagttagttatttgtctagactataaaactacatctcacttggagaaaactccaaggtaaattgatttctaacactcgaaagcaatgtaaggtatcaaattcaatggtacacttgcttttatctataatcactactgttttaatgaaattaaaatatcttaataacaacaaatggttgttttgataacaaaagatgcaaaagaactctgaaaaatgcatctataatttcactgaccctcttactgatttttagaattgacatccacttacaaagccaatttgagatcactcattgttaagatagtagctatgtgctttcactgaaattcaaattgatatatacttggccaggaatatattggaaaatacattctctttactttagtatgccttgatcttacacatagatgataaaaacatggtataataattgctttattttgaatgcgtatgttttatgcttaggaatatttcatgaaaatcatttatgaactcccaaatggataatttgattattttctactattaatcaattagttactgtggtagactatattaatacattaagatatataatgaataaaatgcctttcaacacagagttttctgtgtttgtaatagatgcaaccaaaaattcattaaaaaaggtgcaaaatacaaatttaagttatagtggctgaagagacataaatcaactgctgtttcatttgaggggatagaagtgttaagttctgcatgtaagctattcagcacctgggaaagggaacagcgatactcgtgctctgaatctaaaaaagtagaggcacttcttcacctggcttgctctatcatcctccattccctcaggtctcccagtgacattcctttagtgaaaaccagtttcaaatagcttagcctcactgtgacagatatatatatatagaaatggattgaaggatcaaaaacaaataacctattaggtacttattgaacacctgttgtggactgagacttgtgtttggtgtggaaaatagatatgggtctaatttcccaggatatcctgttagatggacaaaacaaacacatgaaactgtctgaaaatacaatacaatacaatataatacaatacattacacaaacagctgctaacgtgaaaacttggtgatgtaccttgtgaagtatgtcattttagaaaaggggttaatagccattgaaggtgttgtgaaggcattgtggcaatggagctggcttcgaagggcaggtaggaaagaggtggggatggcattccaagcaggagaagcactaatggggaggtatggaacttaacatgaaatacgtggaagaaaatttagggtaggccttcacagagttaatgcatgttgtaagagttttaatgttacatccaatagggaaagcgacacttctagttatgtcataggtttgtgacattaaaagggaagaaataaatttacatttacaattagtttttgcttcacatagtaaaaaagcaagtaaatatgcactaataacctaaggagcacgtaacattttcagaagtgtattctatgagttgtacaaaagctatttttaaatattagaacgctttcattttgaaacttctgactagttccctaataaaaatcccactagaaaggccagagtgatccttttgagtctgatcatgtaacttttctgttcataactctccaatcacttcctgtctcactggaaataaaagccaaaacagctgctacaatctatcgtacccgcgccatctctctgactaaactcccatctcagtcagcaacactggcctccttgctgttctttggaaacaacccagacctcttttctgtctcaggatcttggcagctcacctggaatgctcttcccctctatctctacatggctaactctctcagctactttaaatctttactcaaatgtcacctgttctctgaatgtctcctcccttactccctgaaaactccaataaggaatttcttatccccattgtttgctttatttttctccaaggtattgcccttctaacatagtatattatttactcctcattctgtcatctgccaataaaatgtaagctcagggaggatctgtgttttcatatgctctgttcagagatgaatttgaagtctagaacaagatcaggcacagaagaggtgctaaataaatacgtgtaaatgttaaacaaaatgccaatcagtgtttatatttaggtgcttcttgtttcagtaaattgtgtcctataatgttttgtttttgtagtccaaatagctttttctattttaccttataaccatgtacaacattttgtattttaaagaacaaatttttttcttgcatcttacctcctcttgagcttttatttcccactttctcacaatagtactgattctagctgatcccaagagtctgatctatttgggattcctggtgagaatttggttaagaggcaacccaatgtgctcaaatagttctgttctatgaacagaagtattgataacacaattgtttgggaaattattgagcaatctggccactgaaaaagttttattttcttggtttttgttttgtttaaatcacaaactctaataacaggatgactttagtaatagcagtctaagaaaatgagataagggagctcaaatcctttggtttccaacagttagggcaaaatctctagcatctgtcttagggctgacatacttgagactgtggaaaaacggatcagatgggagggatggctaggttttacaccaggactgtgtgctacatgatggtaactccagatgtgcttttccttttgagagaagtaacaattatttaaaaaagaacagcattgaaatttacaaagcaatattgccttgcattattatttttaattataaaataatcggcaccatacaaaatttataaaaggcatatatctaggcatgttggtttgagagacaagcaatgctagaaaaataaagcaatgtgggcaatgctataatacttggaaataactgaatttaatacatgatgatatgctaatagattattaagggtagcactaattacataagggcatgcttattctcatcaagttttggagttactgtcagaaaaatagtgatctgaactgtataagaaatcctaaatgacaaactgatttggcacaaagaagtcttttggatatactgctgttctccgttcaacctgtcaatgtatgtaaagggatttagtctggaatggattttctttgtagccagaattcaactttttttaaaggtcaagtgacagttcatccagaaaaagaatgtgatcacttaccccagtacaaatttaactatgaaaattactctctttccctgttggcctgaagaataattttagtgtgtttttaaaaataatttcagtcaatcaaatatttgaccatcttttcccaaaggatcacccgtacatcactaaatttcggggcatacatttcaggtttaagattcagaatagattttagagggcatcagctgtacttccttttagaggaagtgtcaggcatggaggtgttatcacttgggtcaaaacacaaacaagaaaagtactaattgcaagaaacagttattttgagacagtacaacttctgaatcattgtgcattttcaagaaacactcttcaataaagaatgctgttagtatcttccataggcctcaggttctcctattattgatatcaataagttactgtgactagaaagtgatattttaggaggcccaacatgtggtgagcactcaggtctgtgaataatttgcaagtccgtatctaaatgtgcagagggaagtctgcacttgctatgcctgaactgaagacaggagcaaacaaagggtgtgcagtcaagaaatgacgagactcaaaaatttctagataaaagaccaataggttctagaaaatgtatataaattagaagcattggccaagctacagatttccaacttttaatgcagactaattaaccaggcgggtgcaactctggttgaatgactaaatccagatggaaatgcctggattttcattcttaggttttaagtttctccttagcgattgttgttgtggtctaattggtatacgagtagagtctctggctcccatctcttgcatttgcatgccatcacatgcctccctgccttatctccccacatactttgtcttgattttcatgattcaacaaaaatgcttcctttctatatccatccttctcttgccctggaggcattatctaccactttcatacataggccccatagtactaagcaattttctctatagtatcttttatgtttcattgaatttgttggttcacaagttgtgacccctgactccatgggcttgacagcagagactttgtacgctctgtgtctgagttgattagggggtcagtcatctgatttgtatagacctactatatgccaagttttgcagcaagcaaagaataaagccaactgaatctctgacctcaaagaccatacattccagtgaggaaggaagatttgtataaacacatatacacatacataaacaaaataagttgagccattgatatgtgttctacaggaggtaaaatagactaaggcagtaaagtaggcaatgcttatagtgttctgggaacatagatgtctataacgaggcaacatttgagtagaaacatgtacgttgaaaagtggcagggagtaggggtatggtgggaatgttttaagcagaaacatagtataaaattcctattaaaggagtggaattaaatgtttgagcaactgataaaagccaagaagggccagtgtgactggagtgaattgaaggacacgggagttggtggtggaggaagatgaaattggagacgtagacaagagaaaagcaagaacatgttgggctttgggagctgaagaggagtttattctaaacatagtaagaagccatcagagggtttaagcacaagaacataaaataatttgtacattataaaggcatttctggctgttgaggatagcacggacttgagtcaggccagagttgtgatctaaggatacaagttagaaggttgtttcaattttcaagcagaagataatggttgctttgtcctgagctgtggcagcagaaatggtgagaggttattggaatagggattcaggcacacagcatacattcaataaatcataactgaatgaatgaatgcatggcaaattaacttcttaccagctatgtgttttttggctatgtacttaatctctttgagacttaattttcccatatttgaagatgattataaattgatctcaatttataagaactaaataagataatacttacaaaagcacctagcagccaatatgtattcaatagataactaatttccgttctccaattttttcttattttcccaaagcaattcattgtgtgtgctaccatcagattaacctccttaaagtaaacatttattagcttactatataactcagtaaacatatttattagcttactatataactccaatttctataatggcttttaatttactattggaagaatggcctttaaggtcattcttgatctgcccctaaattgcatttccagatttacctactgtatctattctctctagctacaatggatactcaccattctttgcactttacctcttctgttctactgactttctctccatttggaatggcctttcctcaattcataccattcaaattttctctatcccttgagtgatgccactcatatcatgtgcaagactctggtaggccgttcaccgtatgtacacagccttatttccgctacactataatctcctgcaggcatgagccatgtctcaactatttaaaattacttattagacaatcctttccataaatagctatcctattggcaactatattggaatggtaaaacttgaatttgttagtgtttatatttgcaattctgaaaaatgaaattcattagttactcaaaaaagtcacagaccatagggaacagtatgtctcctcctcattcttcctactgtggatggtttatctctgtcagtgaaaagagactttattcacagacctctcactttagcatgctattctgggatgccaatttgtggtatgactgtccaaataccatacagcactgtcccctctgtcactcatgatggccatttcattcaccttctatttgatgcctgtcattttccccttcatactttctaatgtatcttcctttactttctattgtcactgctaccacagtttttttctcagcctttaattggtccttctctccaggcttcttacactgacattaaagaaaaaaaaaatctgcctggaagataaactttatggcagagtgggtgagaaagtggctcccaaaatcaaattgcttgagcttgattcctttgcctgtccttttgggctgcacatccataacaagtcactgtattttgctgtgattcagtttcctcatgtggaacatgaagctgataacccatctaatagggtttttacaaaggttttgtaagaaaatatgtgtaatatgattacaaaagtaactcacacaaaaggcaatggtcaataaatgtgagcttctttcttactgttttttgtttgtttgtttgtttgtttcgttgtttttttttttttttttttggcagagttttactctgtcttccaggctgcagtgcaggggcctgatctcggctcactgcaacctctgccttccaggttcaagtgattgtcctgcttcagcctcctgagtagctgtgattataggcacgtgccaccatgcctggctaaatttttgtatttttagtagagatggggtttcaccatgttagccagggtggtctcgaactcctggcctcaagtgatctgctcacgtcagcttcccaaagtgctggcattactgacatgagccactgtgcctggccaggttttactttaaataatcatagcactgtcctctaaagccccttcagtctttcctcaaatgtctaaaagattatttttaatcttcattacaaagagattcctggtttaatcttgatttaattatctaattacctttccttctaaccagaattgaaaagtactttcacagtttgtgcattaccaattccacctttgcaaataccacttcccagagctggtaagttgatcgctactttttcaactatcaacaaccttgtgtttacttaactcctggcttcccttttatatgaaatattttgtgatcagcccaatctacaattatcctcttctcctttaaaatctggaagcctgtagtgtcaatctcactcatagagatcactggttaccaccatgtgcccgcagcctcatctccaacccaagacagtaaaatcctggaaataagagtttgttcttcaaccgtatcatgcatctttctctggatgttctagtcaagaacatcttttgaatgactgctaaattgtaatccaaaaaactcacaatgttgacaatcacctaggatccttgattatagggcatttttaaagtattctatatttttataacttccaactgttcattgcatctcaaaaagaaataagaattctgcatcacagttacccaggttggctgcagaaaagattacaatgttatatctaacattcagaaagacattttctagactaactgaatactgccaaagcttttgtttaagccctcatcaattgatgatgatggtgatgggctcctagaatctctctatctctcatttggtaacttgtcccttccaacctccactgagaccttcctaaacacaaatctttttgtaagactcacctgtttaaaagcctccctgactgtcctcaaaataaaggccaaatatcttacacaaagacgcttcacaatctggctgtctccctggctttttctgctcaactaacacaaatatttgctattacccaaatacctcattcgattttacccctccatgtcttgctatatgcccttttcttctgccaagagcatccttcttcacatcaccatcataacaactttaacttatccttcagacagaactcatgctttatttttttctattaagattctaagtcctctcccaggcagaattaactctctcttctatgcaaataccataacttgtatctattatacttgtacttattatactttcacttaaaatttaaaatgtaatctaaatataattaaataaattgcattacaatttaatacagtaagtgctataattgagatacatctaatgcgctctcctgttcatctgaaccagttcatattcttataagatgaaatatagtggtttgaaagagcaaaggttctggatgcagacaaattaggctttggatcacacaaaacagtaactaatgtgcatttatcacttactacctatgaagcactatcctaagtgtttttatgtgtattaattcatttaattttcataataatccaataagatacatattgacacacatttgcagatgagaacaccgaagaacagaggccagttggagtcatggaaccgtcgaggtgcagaatcagaatttgaaccccaataacctgtccacagagtcagctctcttaacctccatgccatctcttagccaattaacatttctgaaatttttcataactgaaaaatgaggataatagcaccttccttattgtaagtgtaaaataaaataatggtcccctacttttctttcttttcctatggttcatttgtttttagaagtggcatacatttatttgacttcctggttaatacataaggtctttaccttcttattgtcacacatttcaatcctcagcattataaaagaacaaacgaactgtggcttttcttttcttgttattccctagtaatatcaggttgtacatcttggccagagaaaagttagcctagtttaaatgaatgagatagaaaagttgaatttgttgccattcatttcatttcaattgattttgtaataaccatacaaaataattctctgggtgaaaaatttaccttcagagctactgatttactatggcacataagaagtacttactgataaaaccagaagaaatacatatgtggcttgataagaatgaagaataaaatataagtcaaataatgtgacaatgcaatatacttaattttgcatcacagaaaataaatcttccttacataatagtagcaggaaatgtacacagacttcacactattattaattgtaaaatgtatattgtttcactaaaattcagctttcaagagggtaaataggatgtaacctcctcaaatttcaaccaaagaatggacttattattcaggaatccatacttgattaagtctgtaaaaactaaaactacatatttgagaagctagttgaaattctggtcagcaaatgcaaagtatggtgccaactcaattattttttttaacatctgcaagctgaacatgtatatcttagttaacataattattctaaacagaaatatgttacaaattccaatcagttgcttcagaagattgattacctaactatacatatttagcttcataaaattaagagtttcaaattcaacattaaatttgacttgatttgaaagcaaagcatactgtgattttgtgtatgtgcaagtgcaagcgtgtgtgcctgtgtatcctattattgcatattttcacatttggtgaaaatgtatgaaaatccatgacatatttaagtagtgttttattcagattccagtaaaacatgctaggctgtttagatttcaaataatttcattacattggaactaaaattcattcatatttaaaccgtttatcttcaagcttctctgaaatatagggcatagtctcaggaaagaaatgtatttgggaattgagttgcgagttatgtaatctccttccttactgtattttgaatttaaatattttcaaagccattaaaaaggtataaatacccccctgacacacacacacatacacacaaatatgattgaatcatacaattatttatgctgttattgaaaatgagaggggcttatattcctccccattaaacaatttcacttttgcaagacaccatagtctgtactttccagtcacttcctaatagtaattggggacctactggagaatattgtaatttttcaggttatatgaataccacttagattagattgctctagtgtttcatctaattttaagccctcttttacccagtttggaagtgtatagtttgtatgcttctgaaggtacagacaagtagataataatattagtaagtacaaagaatatgtcagtcactcagggccatgtagcaagtaagtggggaagatggaatttaaactctatcttctgattcctaattcagtgttgtttgctcctcacatcttcctatgtcatcttcactatgttgtactatcttccctgatattatattatccaaagctttcttttagtaattgtactagggaaatggtgttaaggtcctaaaatgtttaagttcgaggagcatgtgtaagacaataagaaaccgaattgtagaatgaagtccattatatcagtttcttacagtccattaataagaatgcatcattcattcattgtttttcaatatttaattcaataaggactcaggggaattaagttttatttcttgaaattattttcctctgaaaaattaaaaatcattagaaaacagaagacaatttatatgatgacatgaaaactgtgttttaaaactcaatgtctataatatttgttattttcaaaaagagcttacaatattcatttggccaacatggttgacgagtactctaaacaaaacctgccttgcatttttaagaacaccttactagagcttttcttaattcctcaatattgtaaaacatcctaactgaagcaaataatacatcaccaagtcattttggcaatggcaactgtaacttaaaattatattaaaaataatataaaccttactagttaataaagtaatattacaaagtacaagaatttgtactggcatacaaaatatttatatagccaactagtaatatgtttaatagtttcctggataattgtatctcattgcagtcattttattgataaaaaataacactgctttaaatttaaaagcaataccttcttctcagtccaaagtgttttaatgagctcaccatgttacaaatgcagtagtctacaccaatgtaaatattatgcatattttattttacttttttactttgaagtcaaatttctgttaggaatagataaatactctaattttagctcaaagaaaaggatttaaaatttgaagccattatctgagtaattcaggtttttaaagctttagaaatcaaccagtagtacaggaaacaatgggaacaacacacattcaaccaaaaccaaggattattcttggctctctatatgtaaaagctctccagggaagaacagcatttaacccttttcagatatgtgccgttctattcattgatgaataagtttgtctcttgaacataacacaggtggaacattaagaaaggtagaggcggcccggcgtggtggctcacgcctgtagtcccagcactttgggaggccgaggcgggtggatcatgaggtcaggagatcgagaccatcctgactaacacggtgaaaccccgtctctaccaaaaatacaaaaaattagccaggcgtggtggtgggtgcctgtagtcccagctactcgggaggctgaggcaggagaatggcatgaacctgggaggcggagcttgcagtgagccgagatcgcgccactgcactccagcctgggcaacatagcaagactctgtctcaaaaaaaaaaaaaaaaaaaagaaagaaagaaagaaagaaaggtggaggcaattcagacaggcagcacaatcaatagtacctgagtggtctcaaagtatgacttgagcctggctgcttgccacattgaccctttagggaattacttgaaaactagagggaaggagtctagaatgtcttttgacatgtgtataataaaactgaagaaatacaagtgcccaaaagcttacataattaattaaaatgtgaacatttctctgaaccaatgattccttttactgtgtggaaataaatatgcttcatgattttcatttcaggtcagaggcagtgcagcttgtgttacaactcaaaagagtaatactctgaaaaaagaaaaaaaaagatggcgctgaaaataaacatgttcagcagccattgtgattcaacttacccagatgtgcttttcatgagatggagaaggacggatggaaaagaaaagcacacaaatgttaatggatacagttcaatccaaagaaaaccatggaataaaacaagagcattatttaagatgtgagaaagctcaggtatgagaaagacatggtgccattttgtatttcatcatgacacacatactcactgcgtcgaaaagcatagtcaggctgagggtagttctaatagttgaccaataagtctatgtcttgagtatgagccactctgaaacatgcatgaccacattttcccagcctcgagtacatcccaggaggaaatcaagaaatcttggtaaaggacattctttacctcaggccacttccatgctattttaccagtagaaacaataacttattaattggcacttagatttttatatagctttataagcctactgctaaggcccaagaaaaaagaacagcagacattagaatgggcagcaacttgaagtgaagaatgtccttcctagtttgaggatctgaaaatctagattctatttctcatacacagtttggtcaaaattattagcagattctgatcttcaatttcctcaacacaatccctggcaatagaaatgtgtaaagtccattccagatccataatgttattattccaaccaatgctgtaataataattactattttggtaaacatatatggctagtaatcagaacataagaaagtgtaaaaatgttctattcctcttcttcggtggccatattacttccttctctatttgactggcaaaataaacatcaagtttgtgtctattgtggctctttcagtggtagaaatatttaattatttgaataggtgtttataaatgttgtttttggggaaacatccataaattatattggttcaccaatattaccagaaatcatcactaaaacgacattgatacacatatagcttttgaagaacccacttgctccctggatgtagtagaggcattgagaaaatatggaagttaaataattcaacaaaaattcatgagagtattgttttaaaaatatattacaagcataatagcctaattattaaaaaataaaattgttactacaactcataaaacatgttcaatataacaaaatagaaagcagaaattcctatgtcagaaattaggcaagttagagcatcttcttttttatcgcacaattattataaagaaaagattgatgtgcaatggaacaccctgcacatgcctcctctcaaggcattcattcagagaaaccgtgtactttttattaaatcggcactttgaaaaaaatgcatatttttggccttaactccacagcatctgtgggaaactccttagattttcacataaacaaaagcagaaatgttcataaacactggcactacactgtcccaagaaatttatcatatttttcacatcatacaccccacagaaatgaaattaagaccaaaaggagatagtttttagattttaaaatgattttcttgtcaacatacctgtgaactctacgatgagctctgaaaaaataggcaatttctgagctttccaggaaaattgccaaaagcatttgggactagttatcaccatggacaacataatctttctgagcctactagctatctaggaatcacttccctataaaacaagttgattaaatttgcacgtagtgaaacctaatatttattagatgttccttgatcattttttaaaatagaaaacttacacagtataaataccttaaaatataaaatataagataaaatatgaaaataaacagaaaacacaaatttaaaagatactgctcaaaaagcattgcacaaatttctaatatttttgttatcaattcgtataaattatctgatttctcatagtttttatgagctttcttctcttccatagtaaataaagttaagaactatttcaagcagctatatcactttagaatgttaagaatttcacctcatgactttcaaacaaatgtgttctgcaaaagacaaaaatctatagttataaatgacccatattttgtgctaatatattataaacttcatataggaggtaatatatatttgcagagaagttttttctgattaatttttcttattgtaaatattgatacattcttttctacacatatttatttatagtagcatatagcctcattatttttctctccatgtcagaagtgtcaaggctatgttaatagtaagaaagattctgtcaagaataaatattcttcagtgaaagaccattgtgagtaattggcaagtaagttttaattaacataaaaaaataggttatgttaccatctaatgaatgagatcagatccaattattgacattatgttttccttgccaacatcagcatatattcagtcaggagaagaagaaatgaccagcaaacatatgtcttatatttcaaaatgagagccttcaacttttcagtttcctcaccttgatcttccagatctcctacaattgaatgaaccttcttctgttataaactagtcaattctggattgaaaacttcaaataagaaacaattcattaaatgagttttatatttggaatataattgactcttgctttgtaaagttcaagttggtgattcagacatatttttaaattagttattaacatcaaattgagtagttaatggctggtaactgaaatggaaaagtaaaataaataaatattttttttaataggtgaaagttgagaatgtttaaatgctgatgggggaaaaaaaaagacaggagcagaagttgaaagcaagggagaattccgcacaaaatgactaagaaaatggaaagggatgatctgagtaaaagaatagcctagttttctacaataagacagatggggcaagtgttagtgtatatttggcatcaagcaattcagggcacttggatggtttctctctctgtctctctgtctctctaagctagaatgtaaactcatcagcagaagattcaagtttgaggagagtggaggtttctaacaagagttgcagagagtagaacaacactaatgaaagaaaactcttgggattactaggtaatgctgaatttcacaatgaaactatttctaatttctctgctgtaattttctccaacagcacagatgtgccaaaatgtacacatggagaaagaaaattcatcattgggtgtggttgttatatgtagatgtgaccaaatgaaagtggagtgaagaaatttaacaaattttgagggtgttgaaattatggacgtgatctaagctaaaccaggagagaggggaaaacagaaaggtgataatgcactggaaaaggatagaggttaaataaagatgatagaagaaaaagttcataaagcaagatcaaaggtgggaagactgtgattagcaagaaatgagatgcttgaattggtaagtttgaaagaagcatgatttgtggtgatgacaagattcagaataggaccatgaagagtgtctgacttggggtaatgaacaacaatggaagcaataaagttgtaaaatcaaaaggttagtttttgaatgggtgatctatgtggatatcagagcatacgagggtgacatcaagaactgcttaaaattcctacttaaagacagatgatggggcctttaaagataaatatttaagcatgtttctagtgattcttacaaatgaaagaaatggttcagaagtttaaatgtggttcctcatcacattaaatataacttttctttaagttaatattgacttcaaataactaaaatatttgagactacttaaaggagtttaagaaatctttattgctctaagaattttgttaatcatctgcctagcaaacctaatacagttaagcctcaaattaaaatttcaattatggagaatctgaaccaaagatatttaattttatgtttgtgtgtgtgtctacgaaaatatacttaatacacacacacacacatatatatgtatgaagtctttttgtattgaattttttgtctgtaaaaccccggcaagagagagactatacgtaattactgcccttcttagaagtgtggagacagatacatttacttcatgaatggctcatttgaaataactatgggaagaaactaaatctccaaagatcttataaaaaatactatacaaagcttatatgagattttatattaacaggaacagatgtggaaaattctagattaagatgtcagcattatatttaaatatactttaatttgatttttttatttaaaaagccataattattcttgctattagacactctcttgtaagttttactggaatgaataatttagattgattcaagcacacatttaaattccttacatggtttatttattagggaacattcacattattatatcttatatcaaacattggaacattatgtgtggctaattatatcagaaaaagtcaattttataaaacagctacatctcgtgttttgaaatcctccccatccccactctttaaaagcatgactggtttgaatacatttgttgctcatttttaaggatagggtaggggcagataagaaactaattattctctagaggaaaaaaatatgctaccctttccagagtataaagagactggggaattcttcattcactccctatatagaccattaacattaaaagttatataggatattctaagtgcagttgagattggactacatattctttaaatcacagccctattcttagatactaaataattccaaggaaaactgggctctggagatctacatttttgtataacacagtgcctggaaagctatatttcttgatgcataaaagaaaatagcagtttttacattaaaggctttgtgaaaaatattagagataacacatgtaaaatgcatagaacagtgcattgcctagcacattacaactaatcaatgtgattattatgtacatattacatataaaatagataatgtcattagcatgcaaaggatgaggaaaaaaatgaagcagaatatatgcacacaaggaggtaagagtaatcaggaacaaaacaaatagatattaggtatatcaagaccatgaagtgcaagatgggaagcagagagataaagctggtgagatacacagggagcagataatgtagggatttatggactacataaagccatttgaaattaatcctagggttgttagggagtgattgaggggttttaggcagctaaaaaataagatttagataggtctgtttagcttaagcgtgactaacggattataggaaggcaagactagaagcagaaagactattgtagtatgatggcttgagctggaaagaagaaaatcaacagatttgagagattttttttaaaaaatgcaattgactacatttggtaatagtacatggacgtgtgtagaggaagaattaggacaaggaagagcagaagcaaagaagaaacccaggtttcaggtttggtcacctgggtagaaatcactgccctaactcctattacattttctcaggttttcttctttatcctagagttctttccttatccagcttctgtttatacattcaattatttgagaaatgtattttaaatacttacaatatgccagcatctatatgttaaaaattcaaagattctcctctgttcagttctcttctgaattttacagaggatcacagaatctcagggcagggacaatttaaaaagcaggtagttcaaactctcagccaaaagttgaatcctcgatgcaataatcctactatgtacatatgcctgtcaggtcaatattagacataattatggtgaacaattccctttcaaagtggtcaattctttcttcctacctctgtgattgctaataattctcctacagtcagctcaatttatctgtactaacccctgacttctggcctaaggtcttatcacaaggccataaagaacacgtttggttgttcattctgttggcagcatctatatctttgttctgtatataccacatattcctatttctaccagtctttgaggacatggctttgtgtcatctcactagtatggtcatgttcctctgaacatatgctggttttaatccactttaagtaactttcccagaaatgaacacaatacccagctacaatctggtaaatgcatcgaattttgaccctgttactgctattacggatattgaaaaacattaaattatttgtcaggcattgctcatttgcctaccttgtagaaagttttttcttaggagctacaggtaaattatatatgttcccctatatagaggaaatcagtaagtatagtcctaaagctggctgcagtattataaaaattcctctataaaatttcatcttgtcagatttggatgcctctgtaaaaatcatccttaagtatattctttatctaaaaactgagctatgccttctagcttcacactttgacaaatctgatgttcttatttaaatcatgtgtgaaagtgctgggttatgccaccttctgtttcacttagtcatcatcaattcatttgtgaagcccctttggttatttgtctttagctgggagaatgtcttgtaaataagaacattagggtgcctttgagttttcggcacttttctcattctccacaaagatttaaaaagtgatcatgaaccctgaaatacttaaatgcaataattagttttcatgtccatctctctacaagctctttgaagaacagaactacctaattcaaatatcagtaatttaaaacatttcttgggacatactgagcaaaagaatgaaaaattatcattttcatgttctattaatattaatccaggatttacatcaattaagataaataagaatttatttagaaaatgacattatcttctattatatgtaactatcttgattttaatttttcatatactaatttttattttactctttccagatcaaaaatgtttctcctggcagaaattatggagccagcacagggcttctgttctactcactttgttaatatattaacattgaactgctggctcaaaacagcaactctattccttttgtgctgttttccttcctctaaatagatcaaatatatctaaatatatctaaaagagaacactttggttttccttagctttctttttactaacaaatttcagtgcattctgacccttatccttgggatattattattatttacgttcagggaattcttataattgtctttggttgaaggtaggtagggctatacatgatcacatggcaaagcaacagcagctctattttagtgaaaacagagaagacaggcttctggagttccaagtaggaaactgggacatatttttccagagaaattttgaaagcattggttttaggttctaaaatgttgtatattattatattcattgaattagttgccgaggaattttcctgcagtaattgtgtctgtactaaataaaccctcgactaaaataaacaaactgatccaagcacaaatatctgttccaaactaggccataaaaggatttcatctaaggacttcatttttggaatgggatgaaggagaatatatgtgtttgtgacaagactgggaaaatctctcatgatctcttattgtcaaagttttgggaatatcttggctctattgtttctgtaatctgtgagatatcctggctctgttgtttctgtaatctgtgagataatctaatatcatgcaagtgaatccttctttttgctttatctacccagagacagttcctactgcatgcctacaaaacaaatttttgtgggggaagcacagacttttactttctgtgtatatagaatactcagatgggaaaatgtactcagagcttctaacacatcttataaattaagttctggaatacagttcatttaaaagtttaatttggcatataggcacttaacgaatatgtattaaatgaaagaatattgtggagtttctgtgataccttcacatataaatattttccatatcatttattttgcttacagatatgtacactctgaacctgccaaatgccaaagattaaaagtgcagtctcaaaacacattaaagattacacactgaaggagaccctcaggattgtgatgggaataaattaagtaaatctatagagcttaacttttatgtctgtgatattctaacataaagatttattggtagtaattaagtgtgactgctttgctccaaggataaactgcttctcgagagaggatgctgctgatagctgagtcggggtgttaatttcattttaatgatattgaaaaatttgttcacatatgaaatctattttcctttagcagtgttaaccattcagaatacatagaaaagtctaacatataataatatattatctttattgtaactaaagattgaaaatgataaattagtatattaacattcgtatgatatctttcaacttaagttacaaaatagagaagatttcagcatggatatatgctttactaaaaaaattatataatgttacgaggcaagagaaaacattagcagataaagaattaagctaaatatttcatcatttatattgctggagataaataacaattcaatggatattctatcaattttaatatgttcactgcctattcaggatggtcttgagaattagagaggtgaattactgttgaaacagacatcctcatctttaatcccagaagtttctataagactaaggttcttggaatgaaaattgagtgtagaaatgtgagtcctctagagtaacagttgtcagatagtccagcataacaagtcttcagtttgaaagaataaggtagaaaaatgaaacaaaacatttgaatagacacctacttacggcatttctgaacaccaaagataaagcaaaaataaataaataaaacagagagagagagagagaggaaaaagaaatcctacatgttatatacaaaagaatggcaatcaattgatcattagccataactagaagcaagaagagccataacttcaaaggtctgaggacaaattatttttaaccaatagttatatgtttcaggcaattatcaactgatgttaggtgtgacacatattttcaggtctctaatgacttaaggaatttgccacttgccctatcatcacatttctagagatgctgacatgtgaaactgacaactaaatatattccaggggagaaaagtaagaaatttaatgagatatataataaaaatataattaacactgatgattcaaaacttgcttaagcaagaatgttgatgacattaaattttattaattcccttgtaagctcatagttcttgattctaaagtaacaaatttatcaaattataataccataaatgttatttttaatattatggggggcttatacctgtgcaacttgaaagtctgtgactaaccaaatctttctgtgtcaggtagatttaactatttggagcttccagttatgctttttttttccccactatttacctaagccatgctctaccagctttactggaaatatggctgacagtttgatttctaattgactattttgttagtcaacaaataaattctgaacttaggcaaagaagagagtttctatttattgtgccctaaaatactcaaatatagtctctaagtacaatttggtgagttgaaccttattcagaaacacaggaattttggggggcaggcccatgtaggttttaaatctgaagggaccatctatcattccatacagtgtaattgtagctcactgtaaccccgaattcataggctcaagcaatcctcctgtctcagccttaggagtagctaggctacatgcacatgccatcatgtctgtctaatgtatttttattttttgtaaaaacagggtctcactctgctgcccaggctgggtctcaaatgcctaggcttgagcagttctcccacctcagcctccccaagtgctcggattacaggcatgagtcaccattactggcctgtgtggttggctttaatcggctatcctgaacttcgaagcttttaggttaaaacataggctggaaagctaagaatgggaaatacgttcttaaatatgagggcgaaaggtataaaagaaaaagagtgaaattttcaggtctggttgttctaaacgtaatagtaaaagagaagatatttttgttaaataagaagaggtgcctggagttcaaagaaatccaacagagagtgatggataagatctcagagagtcatggcatccccagatgaagtccgcattgaataaactatgaagaattataatattaatactgaaactaaatattgagaataagtgactcaccccttaaatgtcaggagcctacagagaaactgctcaaattttaaaagggaaaaccaataaaattactgtgaagcattcaaagaattacaagctgagttttagtttgacacaattattataggttaactatactctacataaacctgctggagaaatttatggaattgatgctttaaagaaaagtacagcaaagatgaggcatagtaaaggcaaactaggcagagcaacaatagattgactttaggccgaggttacgtgttactctgatgaaacaacaacagcaactgtttaataattatcaggaaggtaaagatggacaagacaagattttcatgactagtgggtggtttagcagattcaatattgttgatttcctatttctcataataagacaatagagagaaatataagcaaaactaatgcctggatcagaaaacaaagaaaaagtaggattaaagtaggaaaacaaatcttgtaagttgttgtaacctatgtgtgttaaatttactggatggtaagtgtgcctcaaattaaacctttgtttaggactgccaagttacaaatttctgaactttgcaaaaatttggaatgtcttaaatgctgctctctgaaagtaactcccccatatggctttttaaaaaatgtaccataattaactcctctagagatttctcccaattaaatttaaagttacagactgtcaattctaaatagctgctatcctagcaaatttgaaaataagatattgtctagttctggctatcctcacaaagactaatgaatctctgctatgaattatgggatagtgagcatagctctgttaagtactaagtcttggaaacaccattttgccagtccaatggatagaatttagaaacaactgataggatagcacaggttgcaactgtgtacgtacgatctgtagtgctcaacattatgaaaaatgttgcttcatttattgtttttatttatttttaaataaaatttacttaaaattatttttcatcctgatagaagactagcaaacatgaaatcggaacccagaaaagagtgtaactcattaaagtgcactgaaagaggatacggtttctttaaaaagaaagaaaattggaattgtttaaatgaaattttaaacacttggaaaaatccaagaataggctgtcaacatttaataatattaataattaacaatgtaaaattcaatagaaataaaatttgaaaccatgtaatttaaaagtaaattgtctatctctaataaaactcattatatgaagacaacttactctctggtaatccagaaatcaagccacagtggcatgcaaattccgaataggtgttaacaattattcatataagtcctttgaacactgattgcatgtttatgctcacagggctattgctatgggataatcaataataagggaaatacttttgtgctttcattaattaactctgacttgccttgttaaatccatttgaacctaaataccattaatccatgggaaataatcgtactaagaaatgttagccatttttgccttatagaatgttcttaatattcttcttaatattaaaagcaagtattctacataacacatcttacagttacattttgccaatacatgttgcaaaataaaacccaaagtcaagcatggtaacatatttaagggaagaattagtatttttttctgactgtgagggtacttagtagttgagaaacgagtctataaaattattatcaaatcaacccaatagtgtataaggttaatgatagctaaactttaaatatgttattttaaatcactgtataattgaaatgtttaactttagtagctatttaaaaagatatttcagttggctccatcaacaactaatgaagtatgcaatgcactgcctcaatatcagacttatatgcaattgtgaaagctgttcagattgccattctttgtcaaatatttgtctgggagaaatgagaattaactttcaagggaaataaactgagtccattagtcaggctgggttttgatcatttatatatttttagactggaaatcaactgcgaacatttaaaaatcttaacaaaggaaagtattttttagaagaatgtttttctcaataaatagtcacgaaatagagtatatcattaattggtaggactaaacaaaacgaagacatttgaaaaagattatgataatatttaaatatatttttgagtgatcagtaactaaagaataaatatatattattgattatggctgagcatttgattgtatggtagaaataattatgttctcaaagtcatttttttctggacaatattcctactgaattgggatatatgtacataatttttagtaactagcaaactaataaacaattaggttagtgagttgttctgcaacttgtaagtatatacttccctattattagtaaacatttacaaagcaagtgagaaagcaaaatatgaagtcaattgattagcctgtatattataatcctaagagcctatctgttaccaaatgatgatgagagcagtgaatattctttcataggaaagaaggaaaatgtgaaaaccaaaaacacaatgtaaggaatatttgagaagaaggaaaagaaataatcaaccaatagattctggaataaagagaaattgatttacatttaaagaacatgtcctaaaggtgccattttgtcaatgaaaatgttactatgtatttttaaaatgttattttgggaactacttgctttccaacagctgctgcaactcaaaattggccaattttgcaagtcatttaaatgtcctatattatatatgaatgaaaagatacactatcaatttcctgacagatgcaaaacaatctgctctgagtctaaaataagtttatattcaatcagtcagagaaatgtttctcctttactccatttcaaagagtagatacttataattgccatgagagaaaacaaagctagatggtataatctcattttatcaaaccaatcaggttttaattttgaacatcaatagcattgcattacttgtaaggattttgaaacaaatctatggatggttacgttgaagaaactgcttatttcaactacaggccaaatatttttatactcttttaaacagtagctcattataaccaggaaacataagccctgagtgttttaggtagtatctggaaaatattggcttcaatatagttcttttgtttccaaccactctctttttaattccctataaataataataaggaattgataaaagttagaaaaagagggaaaaatccccaaacctactttttctttagtcttcgatccttctcagcttgagttccgagtttgcctaaccccagggactcctgagctgcagcttcagtctccataaagcctcctgtgaagagaagtaactaagtattcagattatgttgcataggttgtgtcaattctgaagtcaggttgttaaaggtttagttgagcaactgtttagtatcacatttaaaaattttccttatattactaacccaagatgcataaaatggcatgggtacatacataaacatacactgagaaaatgaaaacaaaacaaagcagtacctatggggatataatttgttgcacccagtggcaacataataaatgtggcctgttcactgacaagacacttaaatatactgtccccaagtcttaaagtctgtttttatacttttcttatggaaaataagagcaaatatctatgcagcgtgtgagatttgtttattttttcaacacgttaagtatttgcaatatttcacatataatgggataaatgatagccaattgggtaggaactcaagtatatgttttctattacaagttgagagaatggagaaacatttgctgacttctaagagctcttcatagactgctcctggaaatttgttctgctctactggctgactcctatgtccttcactataaatcttacttccagaactcgatgtgttctgggcaggttcttgtgttgttttttaaacttcataatattttttgaaaaaattctaaatttcttcaaaagagcttgataaaaatagttatcaccaagtaggtcataagttctcatttagtgtcaatatataatatgtataccttatataactttgtaataaaaggaagaagaaagaaaagtatgatgtacattaaacacatatcacaggatttctaaacttacaaaattaattcataaattatctgttgtaattgaaaaataaggacttactcctatgttctgaagtcgagctaaatgaaaatgctcactatttttaaatgagttaaggtatatactttttttaataaaagaaaattaaactccagttaaggtcaagattaggtagaaagatttaagctaatataaactctcacaaagactatgcaagaaatttcatcactatatcagtaaataactattgaagacaacttttgctcttctctcattgtagtggacacttccttacttaacatttgcaggactcgaccaagatatggtttctctttagcaaagtaaaatatcttaccaaggtgccaaaagcaaattttgatgttactgtttttaatactttattttaccaaataatttataatactggataatattaacttgggaacattgatataaataaattaatctcattcctgataacctttttactgaactatataattttttaaaagtctcctttaattaaaaacacatttattgctgtatagatctaattcagagatgtggagtttgagggccaaaatttgttttagttattattcacatgtttaatgaatacgggtacttaaatctttttttattatgaaagatttttcttcttggtatggattaggaaagccttctactggtgactaaagtactcttgggaaagaaacattttcaaatgggaaattttccattatgtacagtgagtgcatattttcattttatttctctcatctgtatatttgccttactgtatatcaataaattattattcatagtcttcaaataataataaaaatgttttcttgaaatgtaaatgaaaatgaatgagtcacttaaaagttataaaattcttgaatggtccatatagggacatagagattgatgaggcagacatattcaataaacaaggaaagattttcaaccaccaggtggctagatgaatcaggcttttattcttctgagcaatataagaacatttaaattatgatttaaatttattcatatacccaaaattttaatagaaaaaaatcacatttttaaataataaaacttgaaataaaagcaaagaaaaatctaggaatattttgtgagttaaatctagacattttattttctcataactataaaataaaaagcatgaagaacttagaaatactcggagtattgcaaaatctagtatcttttttcaaagcatttgatagataactggaactacatcctactcaaaaatgccaagtacaaatgggacgtaaggccattgtaagtaaagctatttttaagcaacacattcaggccagtgcgcttaaccaggagaaaagtcccagcaagtgcatattttcagcccaattaaaacacttctgagggaggacattttttcacagaattgacctagctgcttcactcatctaatgtttatctttccacatacttgataaactagctggtaagggtgaccttagccaaaccagcttactaattattttactctatggatgattatctaaatccagtgagagtctgtctcattcttgtctaggcatcagtgggctcatatggctatgtgaacttcagaaatatctatttatctataccaatattttattcactccctacatgtgactattaagctcttgaaatgtgcctaattcagatgatgtattgtaagtgtaaaatacacaccaggttttgaaaacgtggtagaaaaatacatgtaattcataaattttaagtgatcatgtgttaaaatgagattattgtttctatatcaggttaaataaaatataggattaaaattaatcccacctatctcttttaacttttcttaatgtagctaccagaaaatttaaaattacatatgtggttcacatttgtggcttatattgtatcaatgttggccagcactatataccagagtttctacctggatacagtacatccacagagggaatgtaaatgtttgtgtatgttgagggagggtgcatttttttgggtattataatgattggcacatattggacaggggacaaggattctaaacatccttcattaaatagagaaactgcagcttgtttcttttttctttttttctttctttcttttttttttttttttaaacagggtctcagtctctctcagactggagtgcagtggtgccatcagagctcactgcagcctcaaactcctgaactcaacccatcctcctcccaagtagctgggactatagatgtgtgccactatgcccggctagtttttctattttttgtagagatgaggtcttgctatgttgcttaggcaggtcttcaactgctggcctcaagggatcctttgactttggcctcccaaagcactgggattacagatgtgagccaccatgcctggcctagcttgtcattctcaaaatgatgagtgcctcagaggagaaacactggcctgtggaaactaggggttactcattcttcaggaggtctattaggaaactatgtggaaagaacacaatgaactccacccctttcatggcctgaagtgcttgggcttgaaggtttgagtcccatgattcagcagactacttacataataaattgtttatcaccttgtcagggtccgcctagtggttgggcatgagcaaggcagccttcttgccctcaaagttttcttggctatcactcaggcatctttacttttgtgaggccttcgaggacttggaattattgagggcaagaccactcctaaggtgtgacaggcacagtcaaggatttttttttgccagcccctcttcctgtgtaaacagttttgaaccaccaaaaaatcagtgggacaacgatctactgattcaatctcatacaataccattcttgccagtgggagcgagggatccaattgccagaccaccctcttgaaaacagggtcagaccactgtctcaggatgactccatagatgcgactcactaggctccctggggcatctggtcgagtgcatgcgtggcgtagagtgtcaaagaaaaccctgaaggggagaaacagggacccaggctcctgctgtttggctggatcgggcaacatgtccagatggcactacttcccttctggtcccagtgtctgaacggtaactgagaacatttcgatgcttccagtgattagaccccgggtccgggtctcagctgggggtgccttgcccagatggcactgccagccctgaactttcccagacatcagagggagtcttaaaatttttcaaggaagttgctacaaaatgtagggcttgcgaaggctcagggctcagggcacaggaaggaaactcacatgcctagatctgtggatggaactagttggaggtatctattcatttggattgtgaaggtgtggaagttgttagaatcaaaatggagtcactattgttaagaaaatcctggcaagtagagccagggaaggccatgaacagaggattctcatgctcctacgcacgatagcaacaacaacaacaacaaaagaccctacgaaagccacaaccttgcacgaaggccattgcaatcccatgccaaaaaatatttttataggtatatctgtctggcaattgcctgtccaacctctgactggtggcacgcttgttattaatttgagtagccaaagataattatttcaaaaaattatgtaatgttcttaattttttgcctttaaaaatctttgtcttcctttccttccctgagtatacacatagtttatagtttactatgacatacatattcttatcacaatgctctattcctaaataaacatcttttcttttagagagcatctctatttggtatttaggtcaacaaagacaaatatctccccatttcccagtccttaaatttcattcaaaatcacttatttcatattggcccttgagatacaagtctgtagaaattgcttgacaaacccatattgcaaggcctctgtccttccatttgtccagcagaggtctctgtcattgtgtgaaaaagagatctctaactactacaatctgctgatgattggtggcttcatctttctttcagtagaactgtcttcatcattaataaatagcacatggtttgtattaaaacacatttgaatttataaattgttacttaattgttcaacatctgttagtctgttagctatccggagactgtatctatacacagtgcctggctcataaagggtatgtaacaaatacagtcataattggagctaaatactactttatttaaagaaagaccctttcactatgcagagcatgagtcatttctaatggacactttgtggaatttacattgtaactattggttccttagcaccaaggaacaatctaagttttggcgtaaaggccgacacagacacccaaattttagaggtagaaaaatacagtcatgcgccacataaagacctttctgttaatgatgggctgcatttatgacagtgttcccataaaactataatagcatattttcactataccttttatgtttaggtacacaaatacttaaccattgtgttacgattgcctacagtgttcagtacagtcacatattgtggattttttatagcaacaggctatacctatagtctaggtgtgtaggtggctattccatacagcctgggtaggtagtaggttatattatttaggtttgtgcaacaaaatcccctaagggatgcaatttttagaatgtatccttatcattaaacaatgcacgactgtacttgtgaaatgatgctggtgtactgctgaagctgtgtttttgtcactgtgaaattatttttttattaagcctattatagtaggtcaatgagttcagacaattataatacaaactggcagataaccataaaagaattgccatttagaggcaaaaaaagctctttaaatgtgtatattgcttttcatacgcatttaaaggaaacttgctaaagtggccctaacctaataatatatgcatttttatacatgcaattgggaattctgcttattcatagttaacgtgcttttctgttttcattatttttttcatagctttgttgttttggctctatttgatcactcccttgtcttgaatatctctttgtcttagatttgtttcatcttttgctatgcctgtcagtagcctcttctttatcctaaccattcactattgacatcagctaagttggtcagatgtgttcttgtttcttcattgtaattattagtagagctctgtgaagactcaaaagagttggtgtttctcaggtggcaaacaaatcagtatgttaagatggtatggagcagttaatttccctagaaatagtaaatgtttaaatatttctgtctcttctccatacactatcatcatttttctaagctgacaaactgcctctggaaaacagagctcgtttgctctaatccttaactctcacttctgcttggatgcttgaccctggaactcagatcatcttatttctgtggttggctctgcttcaagatgctgcctcccaatctctgcagttccaatctgtctgtggctgggtaacttgatctttggtgctaatcacttcctttgcttcataagctggcatcacacttctgacccagccagtacccacttcctatttaaccacagaaaacgccatttccatgacattctctctggagcttgctgtttaacatagtttcaatacccttttctcaaagataggtcccgtttgaaactctacctttacaccttttcaaatacgtaggaagattgcacttagatgatcctagtagaatcaaacatatacagggagagaaagattaacccagaactctctccaaacattatgtctgtatcttgtattagaaaaattataatgtttctgtgtgattttttattgttgccttgagttattatttattcatttatatgggatatcctcaagatgttatatacttcttgaataatcgtatttttaatttctttatgtgcccacacttgttccacagggataggaactcaatgaagtattttttgattgaaataatcccaagagtttcctttccggatcatcagaccaggaagtaggagccaggattcactatcaactctcttactaagtagctgctctgtcttctgaaatcatctcagtttcgatatgtatagaatgtggacaactacatgatcctcacatatcttctagaatctttaggcatacagctctagaagtctgtaatcttaaaagcagaaatttattttcatagtaaatattttatggtgttttagttgtataaagaagagttgccagagaaaagacttaaatgttagagattcatagattcagtattcctagggttgaagtagatcttaaagatcatccagtccaatcagctttccaatgcttggatcccctccacaacagctcttcctagtatttgcctagcttttgctcggcaatttccaagtgacaaataactcactacctcataagccagcccattttgtatagaattctgacaccccactgttctttcttacatcgagatgaagaataattttgtacaactttaatactttggttctagtttcgtatccttacttacaatgaaaaggacaatagctcttatacagaacaactcttcaaatgttgtgatcagctacttggtagttcagcaaagggaataaacacaccattcacttatgttctccgaacgtgattccaatcctctacaggtgcctaattttctcctccaaccttcctccaggttgatgatgtgcctttaaaagtacagtaaccaggatggattccattgcttggctgttcttttatcatagcagagtagagtagaaaaaactttcatatcaactcttatgtctgttaatgtggcctaaacttattaatcaatattgactttagagtcacatgaattttttattttttttctttaaaaacttgcttccaagaactatacttttagagtaggagaatttagatcccacttacatccattctttctatttttggtgggggggatagcatttaggggtaatactaatcttttcacttaggattcctccccttattagtaatccatcaatcagatacctgagctgtggaaacattcatatccaagtgattttggatgtgctgatcaagaacagagtgagtcctaatcatgccacgagaaactttgatcccaggtgacgttactccactcatcagtgggcaaggattatttaaccagttataaatcccacctaactgttccagcactcaggccccattttgacatcttgtccccagggatgtcatgagtgatggcttgctcaccacctttcattatctgttactaagtaaagttgccaaacaaacaaaggacattagtctgacatggctatttttaacataggttaatttactttgtttcaaaatagattaatgccttcagataaaattaaaagtcaagctagtcaggactgcaattatttatgcatgatcacagatcttagggttcatagccactgttcctagttctgacaggacagacaatgtagcagataaaacttttctgggccaaaaatatagtgaagttttagttttaagtataaagtttgtatttgtttacgtactatctttgctaaagtgaaaactcctcgatgccgatagccatgtcttagtcattttcctaaagtccataattggtactctgcatttaagagtggttcaatatatgtctattcactgaaagtaggaataaataaattattttggattatctatgtcttctctccctccaccaaaaaaaaaaaaaaataaatctcctcaactctgggtcataaatgccctcttggtaatgcctatattctggttgaactctttctcttcaagtaaacagatagaaacaaaaatgagtttttgaatggttccacttatttgcatattctattcacatcagataaatcttcatttcattcattttctctaaatttatacattactaaacaaaagtaacaatatagattctataattctcactttggtcttggtgatttttccaattgtctgtctgttttgatggatggcattcctgccactgcttttacatgtcgatgccacttgcttctatctattatttgtcatattctcactttccaatttttgtaacaaatcatttcatgtctgttttaggcagaaaactcccatttcagatacattgcttcttccttaatccacatcatcataaatataattgtgtgttaccatcctctggaattgctttgacagtacacagcctttggtgtcctaactacctttccatgttagttaagactgcacctatttctagcgtttcagtagcagtgtgtttggaattgatgctgtggtaggtcgtaaagtgattgacagatgaggaaagaaaaaagtagtgaacaactcagtcttgtacattaaatgcagggtaaagataagtcaatatttggagataatggcaagatcaagtgatagcttttaaaagtgtgaattagacatgagcatatttgagcaataatgaaaatatcagagatgcattgcatatggatgcataaattgaggggtggggagagatcatggtcattgtgctgtcaagtcttaacaggatgctattacatcctgaatctatgttccaggaagtcagcagaagtacatatcggtcctgttgtcatggggatacaaaccaaacctgtttatttaatttttcatcctgggatttgtgacattgaaagacaataaatggccaggcacagtggctcatgcttgtaatcccagcactttgggatgccaaggcgggcagatcacctgaggtcaggagttaagagaccagcctggccaacatggtgaaaccccatctctactgtaaatacaaaaattagccaggcatggtggtgggtgcctgtaatcccagctactagggaggttgaggcaggagaatcatttgaactgggaggcggaggttgcagtgagccgagattgtgccactgcactccagcctgggtgacagagtgaaattctgtctaaaaacaacaacaacaacaacaacaacaacaacaacaaaaagacaatgaacaaaaatacaaagaaatagaaatgactctaaaaccagatccccgagtaagctagaaggaatgcttcctctgttaggtgggtttccctaaattcaattgtggccttcaggtaaacttggcttaaattatgctttatttttcctgaatagtacttacaaatggaatttgaattctttacatggaagaacaaaccctcactgattcatttgagtctacatcactcctatttattttctgcccatacactgatacacatttcagttgggaaatcttgctcctacattataggtaataataatctaaataagaactgtaaaccctagtaagaacagaataattttttcaaaagatatataaaaacttgaaatctcctattagtaccacagctttttctatcctacttttgtaatttgagtgaactaaccatttgaaaaggatgtcataagaaaattttaaaataaaataattttggttggtttctgttaggtttattcaattgcttttcaatacagtgcttcctttgagttttggggtttccatactgatattgtctatgctagtaatacattagtaagaacagacatattgttgcacatattgagtttgattcttcatgggtaggagttatccatacaatcacatcgactgatccttcctatctgaagtttatgttattaccctagcatttcgaagtattatataaagcaaacaagatatcctttccaaatatttccctttgtgaattactacaaacatctcctttgctgttcatcatttctgatagaaccaaggaaacattttcatagtttcatttatacagctttccctttccacaccatatttctttatagacatgtagtatagctgctttcaacttaagtcatgtgtctctgctcttttgagttaaaccttttaagagttataaatcttagcacatggttcagaatttcaaatttggtactttgacatcactatctctttcccgtagttctttccctggcatactattctattttctagttctatttttactggtagaagaaagaacactggcaatgctcctgggttttagaattttccagatcaagacattaaaatcataatcactcgagatttttccctaggttcctcagatgcatgaataagcagtactaggttgtagtccctgggttggaaaaatgtgcatggtctttccatgacaacttggataccccttctaggaccaaagcagacctaaaactggtagcccttaactaaagtatcagtggggcccatgtatcatttcctttggtgcaaatatggttttctggaacctgtttagacctatgttttatttttatttcttcaagtctcattttcagtaaagactttgttctttttcctggaagctttgattcaccatttatgtagcttctacctagtttcataggtatagcattttgctcctgtcttcctcatccatattgcagtccttaacaagctgctgattctggctttgtttacactctacctctgctgttctatgaaataaagcaatattactcagagctcagaaactttcccaggtataaactgtgacctgaattaacttttgctagtttctgactttggtggggttgatgagaatataatagtaattgagttaattcttatctgctctgacctaaaacacacagtcagtgaaaatgagtaataaaggctaagtttctcaaaggttctatacttttctagactttaacttatatcttgcataccttgattttgacagaatattgttggcaaaatttctaatgatttaggaatttctcatcaaagttaaatatgaaataaaaatataaaattttaagtgataagggcaattaaatatattttaaaagtaaagtgtcaattatggcaactaagatgaatatatatgttgaaatataaataaatatgactatgatgttagcaaaattaatactcaaaaataaccactcacactatagtgactgacactgtaatatattggatatgacagatcatttggtcaaccactagttgtcaaataagataaaacaaattttaaaataatgtctggcatgtatattttaaacacaaaataatctgtgtctctcttttttcctcatgcaataatattatgtatagcctaaagagttcctctactgagaaagaggaatacaaaaagatttaattcctttgctggagaacatataatcacacactggccacacatcagtttcctgtagcttccgatgctttctgtgggtttcacactatggaagccaggaaaggcatttttggatactgtagtcataaatctgcaaacatgaatatcgcaatcagaaattcttttgatggtagggcagaaaactaagtcctggagttgggtattccttgcaaataattattactctatttgagaaaccaaaggatgtactaagaaatttggatcattccattcagcacttaccactgtaggtaggagtttaattctttcccaataatataactctaaaaattaatatatagaaagacaaccccccataagtgaaggatatatataatcatttcagaaatatcacagattcttctgacaattatgtaagtatgtatcatgtatgtatatatctgcttatttctaaatacatatttaagtagtaccatttcaaatgtactgatctacatttttattctattagtcactgacaataactaattataacacaatatctattgccctattcttttccccacatccattcctcaactatacaccatagagtttattagggggaagctatgatagttttaagcaaaaaaaaatcatgttctttacattttatgtaacatattataaagctttattctaactttttaaaaattctttttaattttttgtaggcttatcaattctttcaacaaaaaaacctttaaatctacatagctaagcttttatacacattcatgctttaagtggcagtatactcaatggttttaagctgattttgaaacattggcaccacgatgaatatcacagttatgcgatttatgaagacattatttactcattaataaaataaggtttataccactagcatttactttgtaggcaactgtgcctgtcacaagagttagcattaaataaattctagctattgttataaagagagaaataaaatgactgaaaagttcacaataccctttcactaagttgtattaagcattattcagctaaattgaacatttaaagctaatcaaaatataaattttgtcaggtagaaaagagaagaaatgaaaagaagagcaatgaaatgaaatgaaagatagatggatactgtgacatgactaaaatgagtggcagtggaaagtcttaacacatgcatacttacggagctgcccaagtcgagctttttcttttttaccaaacaaacgtcctattgaagacttgattcctttcttcttgggggctttgtgaagagagtcttggctgctgttggcactaccaagcccgaggctttctggctcaagagagacagataaactactgcaaaacacaaaagaggaaaatacatgcaacatccacaaggtacacaaaagtcatttcctttataaaatgcaccaaaggaggaacaagcagacttgtaatgttgttttttcccctattttcccatgtttccttttaagatattaaatgcagttttttttttcagcctttgggccctgaaactccaaatttccataagataaattcatttttgctccgaatgtctttttttctttacttttttggtataatctcaaactaatcagtgaatataggctgagttattaactgcatgataaatggccttctattatggagcacttgatccattgtctatttatttctcagagtctgtttttctaatcttaaacataatgacctacagcaaggaactgaaatataactattgtgaaattgaagctgctcttctaatctacagttttacttgattttcctctagccatcgttccctttctcagttttggagccaaattcagttaatttaaaatcatctgggtgcaatttggaagcaacaaaccatgtatcctcgtgatcaatgtatgtgttttcctaattagagtactcaaatattattttaaatacatgttaaactgaaatgcttttcaagcagttggttaagtttcaatttatggtcaatatatttgacaccgtattaataggatgggatcaatagacattgttattagtttctatagttgttaattttataacaccatgataaattacttacttttacttactcatgtgaattaatttgaactcacattccctaaccttcaagcaatagctttttatatgttgaaatatactcttttttggagagtgaaagaagtaatattttgaagctgaagtaactgatttttccacattaacaacaaaaaatagttggaaaaaagaaatgactgccaacacagaaagccctacttttaaaagcatttattgtaaaacataatatctagaagatagatatttttattgaagcattcatccttaagtcattatatttggttatattaattatgtgtctacagatgctgcaattgatgagacaataagagaagatatatttcagatataaactacatgcttaggtatattcatatcatcagtgattatagagatctgtttgcagtgctttatgcatatggataagacagtataaagaattgtgatgacaaatgacatatttctccatctagacttatctttttatttaatattttagccaaggatttttttattttctaataactttctgactgaggagttattactgctggcagcagcagtacccacaggatgcacatacctgtctgctaaaaggcacaatcatatacttttcagactttaattacgcttatactgcaatccaaatttatgatcttgtcctacagtctccttagttttttgttaatatttctagtaagtccttcctctagcctgatctcattgtaatagaaaatatccactaaaaaatagaagagttattcttatctatattgaccaataataagaccacaaagatacagttaactttaaaaatacaaatttgatatcaaaattgaaatttggttatttcacaagtgatactgggaaagggaagctggagaattctggctcaaataatgtaaattgttaagcagtctattcgacaacaacgaaggaagaggaatatttttggaaggagggcattcagtgtgcagtgtgcctgcagagtcttaccttcgagcatcattgtggtaggaagaagggagagtgtgagtcattctgagggctctaggggtaggaggaggagaagtttcacatttaattgttgctttgtcctctcgaccatcttcttccacaactgcaatctagaagcaaaaacaatacattcaaataaaccctttctaaatttcagttgaaattgacacaaatggagaatcatgagaacaaggctgtcgagtaattttaatacaaaataaaacaacaaaacttggggcatttaagtcttacatacataaattcccattaaagagtttgattttcacaaatatttaaattggacacattaaaattaaaaaaaaatcatagacccactacacaaaaatgtttgattaataaacaccatagatcaagcttttccaacccacagcctgctggaaacatatagcccaagacggctttgaatgcagcccaacacgaattcgtaaactgtcttaaaacgatttatgcacggaccttttttttaaagttcattagctatcattagtgttagagtagtttatgtgtggcccaagacaattcttcttctaatgtagcccagggaagccaaaagattagacactgctgccataaatcaactagttgctgactattgatctatagtgtttattgacattgatctatgatattttataacatcagaatataaactctttacaaaaaggtattaaacacacatttgaacaattcactaacatatagcattatacatactcaggctatcataataaagacatcttttaagtagggatttttgaaatgagaagttgataaaatataactttatcagataaagtgttttaaatcagtcagcctaatgaaatttattacagggtatttaaaatatgagttgtggtttgtaagaaaaaaatctctttttaaagagaataataaaaggtaagatagtaatgttttcaaattgttccattttactaccatgatgggaaaactggcaaagacatacagaaaaccaaaagaagatgagatgggagggatttccttaaagaacactttagtacagaatccagaatgactcaggatactatccattttgtcagagatgaagatatagagctgtaacttaaaattttttccaatgtcaagttaattgtagagacatagtttttacaacaatgctgcatatttttcatggcatcgttgtgtatcacaatatggagagatcaggattgtagaaaacacagctaaagacttatggctttagagttctgatgaaaaaagttcttagtatggctaaacaaaaatttttaaagttctagggaaatattttgtttgtttttatgtaaagctgttatttataaatgtgtttatctataataaagaccttgtaactttgaggaacttcatgaaattgtcaggacttttgtcacccaatcttaggttccttttaacagcttaggtaggtaggcatttttatataattcctttgctctattcaactagcatattgccatcaggagaatcttttttcaataactgctttcggattgattctgatgctgtggaaaacctttttaaacccacaacccagctaaactcttaagcgtgtttctgaactattcctaatacatgttagtgttttcacagttctgtgatcccaccatgactcttctctgattgtttctgctaagcatggccatttttgctgtcagaattttgcttctgaaacatcttataaaataccctctttgtcctccctgccagccaaactatacttattcccaataacagcttctaaaaacagcatggcacatgtatacatatgtaactaaccggcacattgtgcacatgtaccctaaaacttaaagtataataataataataataataataataataataaatcatgtacaaaactttcctctgaatatcacttagagttttggaattagagagggatttgaattctgatttttcttaaatgttgaataaataggctgattacttacctgctctaatattacatttcctcatcaataaaatggaagtgatacaacacttttcttaatgtagtcttttgaagtgtaaataccatcatttatttaactcgttccccgatacacaagatttttttggttgtggtccctctttccatgacttttctcacaaattatgttgttacttcctgaattatttgagactacattttcgtatagaaccttccatcctacctttctatttcttacagccattaaacttatatagtctttttaaggtgatggaggtcaaagaaaataaggacattatacttggtaaatttggtaaataagaatgaactggtagtgttaaggagaagaggctataggtagatagataatagcccaggaaaataaaatggtaattccatctattcaagccatgtaagaataatatagattcctttattttttttaaaaaaaggacataaaagttatctggttccaggagtgttccaatgtttgggtgtaagctgactaccacatctcgaagatgctgaggaatagatttttgcactgaatagaagtttgaatctttgaaatctttttcatctgatgtcccatgagtgaaagctctactcaattatctaataagatgtcattttgtgaatcagaacttcagttcattttgttttccatattccatatttattctcttgatttcattccaaacagaaaagcggtgtttcgaacatatttttttattttgcatagtcttgatgctctggcatctggagaggatgctcctctaaccctagggatagttaattcctggaaatagcacatcactcacctataagtacacctttcacatgcaaaccaaacaactcacagcccatactctaaatcatcttctccatctggctcttactctccaagaggcaatattcctctgccctaatcacctgtgggccaggctgagacaactagagagagtccctacatcctgaggccagacaaaattaatcaggctatccatcctaacctgcttatcctgccttgtcttgcctttccctaagatacctcagaaaaccttctgccctgctccttctgcctcctgactgacgctggtgctgtcctgaggcacagagtactctctcctcttgggaactgtgagtaacaagctatctttttttgacagctttctcccaatctgttgtcctcaccctatcaaaataataataataaaatatttgaaaacaacgagcattatttattatatattaaatattaaaacatttgtactatattatattaataaatataaatacttatattaaaatataaaattacaccatccttggtttaaatattcaatggaaaacaggatattatggttcttataatctaattattgctccagaaatcataaacaattttatctttgaagtattttctattataatcaaatttaaacaattcaatacactttaaatactctcaactttttaatgttttatcaacattcgactagagggaatattattttaaagctttcatagaataaaacagtattcaattcgtaatgatgtaaaagttatttactgtacctttctccgatgtttcctcagatcacttggctgtgattggcagtaataaaaacataaaacacaattaattaagaattaacaatcatttgaccaagttacaattttaaatagtgtctacaacttgactatcatttttttcttcattttgttattttctaaataaacatattttaattactataaaagcactccgcctggtagttaaatttagagagggaacttctcaggtaacataagtcagatgattgtttccataatggggccatgtgtacaggcactggatacgaggcatggaccctgggaaagagaaactgtggaatgagtgagtgagtctagctagaagagtgagctagctagaaataaacgagactgcatcttttcaagaaaatattattgggagtgaagatccaatgcatatacaaggagtttataaattcttgtttttgccccatctatgcagagctttgggcctcctttgggcagatgtgctgttcctgtgggatctcaaaatttttggcatcctaaaatctttctctttcccacaaatgccaaaagcattttcttcaggttaaaaaaaattacccatattttattaaaaatatacaattgatgacagaattatattaggtgttaaggacttcctggatttcatttcttgcttctctgacttagatattaaacactttaaatatttctttactcttctaaaaatgccttttttttcagtactctaattataatgtaataatattcatattccactgatttatttattactaattgttcaagagaattcatgaaagcactggcatctttctctctctctctgtctctcacacacacacacaatcacatctaaaggattataaatattttattgctatgaaagtaatagcactatcaagagttatgatgcttatgtttataaaaagacttaaaagtgtaaaactgtgttgtaaaaatgtcagaaataaaagcaatacaaaaataatcaaagtattcctgccttgaatgctgactaaattttattctgtggtccaggattcttactataggtttggtactaagttgctcattaatactatgtagcatatcttatataggcagaaactaagcaagagacaataacacttttaactaacaaaatcagatgaatggttcctaaatttctaaaataagcagatcacaatgtagttccgtatgtttggttagtatatctcagcacattggctaaaagtttgtactgtatccaagtggaatcagttctgattagctgggcattttttctggttggccattgtctattctatttaaaaaacatttttagtaggaagttttggaaatgagcagaaaatagtggactcagcagcttaaagaggtaactgtcttctttttaaaaaaaattcacaatttttcttttacataagttttatggcttggaagcctcaaaattgtaagtatgccaatgcatattcactacaaaaacataattttacctccataaacagttcagaatgttttaatcttcatcattggtgtcatttcaacatactatatttctaggtaatgactgaaacagaaagacatggtagtacatgcttttaaattaggcaaatttgtggaaaaatccagctccatttattagctgtgttgaatatgggcactccatttatactctcaaaacctccactctctgttgagataatgccctactacctccagttttgccacgagaattaaatgactaacatcatggtattcagcagtcatcacaatcatattttccagaggttttattatatataaatatatataatgaaatatattttataatgaaatacatatattacatattaatatatttttataataaaattttttagaatggggaaatttgactttttctcagttgcattcaggagacttcctaatttaggcttccatcttctaatcccaaatataaagataaatgaaataaggaattaatgtatacatgtgaaaatgtgaatataaaatctaaaacaaaattaggaattagtagctgttgttttttatggctcttaacacaaataatgcaagaaatttatgttatatattgaaaagttataaaactctatcttggtgtattgaagcaattataatactaagttttgttacttattatgttaaaaacacacacacacagagtccaaagtgatttcctccgtatgccatcaataaaaatgtacttaatggtttaagtcattcaatttttaaaaaaaaattattttattttatttttttcaagaaggaatctcactctgttgcccaggctggagtgcagtgttgccatgatagctcactgcagtctcaaattcctaggctcaaggaatcctgctgcctcagtatcctaagtagcagtgactacaggtacagaccaccaccacacccagctaatttttttctttttctctttttcttttctttttttttgagatgcggtcttgctatgtttcttaggctagtcttgaaatccttgcctctaggtaatcctcctgcctcagcctccaaaagcgctaggattatagctgtgagccactatgcccagaaattcattgacatttataatgtgctatttagatctctgctctaccattgacttactatttgacccttagaaagttacagcacctgtgtgggttaccatttcttcatctcataatgggattcataaatgtactgatcacatagggatgttgtgaataagaaaataaataaacaataaaatacacagaaagtacttagactagaacaaacacccagttaagttttagctaaagcatcattaatcttaacaggaggcaaaggttctctggacacatcaccataccagtgtcatgactcccatccgatccatttccctggcagggcttcgaggggtgagctttggagttgagtgtccactggggggagatgaactggccagcgatgaagctgtaacagaggcagtaatggaggtacctgggtggacccttgccaaattcaggccttcgaggctcacactagccactctattttcaatttcttcagcacgcaactctgtagattctttttcttcctgaattagcctgaaagatacagtttaattatgatccatatataatttaatatggatccattatatgctgctgtaaggatcattggaattcacataataaatcagtagaaactattcttgaacattttacatcaaatctaattttttcatcttttttttttctctaaatagtgtaacttgcagtaaattccagggacttcctggctgcagtttagaaaattgttttcaaatgatacattttttcctgacaacttccagttttaccttctttgtatactaccacctgctaaaactatttaaaaatcttgaacctaattaatttctaccattaatcctaatcttacatttgacctcaggaaccactaaaagagactttagaaactcagccttgagatggcaaaggactagcaatagcttagaaaaagtgaaagattataattacatgtaaatatccctcttaagattcaaagtcattgaatcttacctcctacctaatgaaaaagtttaaatgatagtatcctcagtaaatggtcattcataattagccaaataaaaccctgagtcttttcttaatattaatacttagccaagcctcctttaaataagtaccagaaaaggtaataatgtgaaaatatagttatatagatagatgatgaatacataaataatgaaaaagtaacttgcaaataaaactaggccaggagtggtggctcacgcctgtaatcccagcactttgggaggccgagatgggtggatcatgaggtcaggagttcgagaccagcctggccaatatggtgaaaccccgtctctactaaaaatacaaaaatcagccaggcatggtggtgcatgcctgtaatcccagctactcgggaggctgaagcaggagaatcgcttgaacccgggaggcagagtttgcagtgagccgagatagcgccactgcactccagcctgggtggcagagtgagaaaaaaaattatataaattatttattacaaaggcacaaataggaaagagctttagctaggttgtgtaaaaatcctatttgaatcctgaattaaatctatacacattttgtatgttgttataatgaaactgtgtaccagtatagtttgataagggggtcgtaaaattctcctgagctattttgttcttgattacaaatggtttattgggatcccctcttatatagaacctgtaccttcaagtttatgatcacttcaaagttttctttttacatatttagaatggagaatgtaatttatttgctaaatttattcgctaaatttattcaataggaaatacttctctggtgtacgtttactatgggaagttgagctacatttactcacctgtttttatatgttcaccagctctttgattattaactcactgctggtgtcttcactaactattctgcaaatctttcagtttttaagtagtatgtgtttgctggccaggcagaaagtactttggtagtctacttacatgtcattggaataagtgatctttgtgattttaataggctgtttaaaaatcttacaaagtatggacttaaaatctaatcaaatatgtttcacaaaggttcattttggttaaaacattatgaggcacatttacacttaattataatctttcacttagaaaaagaacatgaattctgttactctcaaagtttattttcatgaatgcattttttaacttcaccccaaggtcagaactccaaagaaaggtttaatcaagtaacatagtacatagtaacatagcttaacacacatttgaaagaaaaaactatcttcaccctcaaaaaataaaaatgtaaaaaaaagaagacattttgtacttttaaaatacttagtagaaaaatgactcctagaaatttttttctggtgagatgtaacatggttatgctgtacacagaaattttggttattaactttaggtattctataaattgtacaagacagccaaacctagaggaacaagttgggtaagagagtatattgaagtttaatttaacagacaatagtagctaactataaaagcacagatgaatgaacattgctgtggcaaatgagtttgaagtaatttgaatcagcgagctgtgaagacagaaaacatgcattttttaatggctagattagtttatgaaagaagaaaaatcttaatcacagaaaaattctggttgttattagcagttcacctggtttgaatcaagatgactatttcttttaaatgtgatataatctcatttcatgtatttttaaaatcttacaaataaacaactatattaacctactggccaagattgttactagaaattactaccctaatgttacaaagctaagagtcactgaagagaaatagcttgttatggagggtgtgttgatctctttggtgcaaataaatatcacaagaatatagacttgatttcaaacttaatttggtaaattcgaccattagctgaacagcctcagaaagtgttattccgttattccgttaatacttgttttacattatttttctatttagagtaatcaaatatttatgaagcactctctaaatatcaagcgaagtgctaagacctgcaaataaaggtgagcaaagccagatacatttcttgctcctgtataaaagttacaatctagtgaaggtaaagaactgaaggacagtactacgttccttgaagaagtgatggaggagctgtccatggtgagtaagggtaacatgagtgaaatgttagggtagaagggtgtggaatgacaggaatgttccagaagaaagggatgacacaacaaaagaaagagcatggaacatcaaggaactagaaagtaggcaaggtaaatggttagagaatggtgagacaggtgaggtattgtagaccatattaaaaagtgtggttggtatcctaagaacaattgaatggttagaaaaagggggattacataaacacatttgtgtgtttaaaagtcttctctggctgtagttaggttggtatatggagaactagcatactacaaagaaaccagatagtaatggttattgtcataaggtaaaaaactattctaaagtgcagtagggtgatgataggtaatttgaataatagtagaaggaagccaactgatttagctagacccagaaagaaaaaagaaaggcattgttcaaaagacttaaaacctgttcacccattgaaaaaacaagttaagaatggtttgttgatattcagaagaacacaaatctacctgacacaattgggttcatcactggggttagtcaaggaaatgacagaaaaagctgatgtcattggaattcaagaaaccatatattaaattaaaataaaagtatcagagtgccaacatttctcaatatttgaaatgttaatttgtccaatttcaattgtaatgaaaaccatctattattagggtactatatagcaacagtacatttttttcataactagtatgaaatagttcatatcaccatatgttttattgcctttgaaatgaaaatataataaagatatttgttaggctataatattaaattatgtctcacagatatagtaagccttttatatttaaagaatgcaaatgaatttggtccccatttacttagaaaatgttcgcacatatgtccccaaaatgctaggggatttttaatgatcagcctgatttgttataaacttcagcattaatatgtgaaaaatgtattttcactgatgtaagaatattaatcataaaaaactctataagaattgtgtctcagtttaagatatggtagcagcccaacttcaaacgcaagttttaggcaccagtgaacacaattaaacagccacaagcactaagattaacaatctgaggctgggtgtggtagctcacacttgtaatttcagtattttgggaggccaaggcaggaggatcattagagcccaggagttcaagaccaccctgggcaagggagactatgtctctacaaaaaattaaaaaaaaaaaaaaaaaaaagacaggcatggtggcacatgcctatagtcccagctacttggaaggctgaggtgggagaattgcttgagactgggaggttgtgggctgcagtgagccagatctgagttatggcacactagcctgggtagcagtgtgagaccctatttaaataaaaaaaaatctgaattttcatgcaatatgttaatacagaaatgtaatttttattattaagaatagtagtaatatgtttggtttatcccatttaaaggcattaacttttattttttctcaagtgttccaggcagagaagaggactctatcctgctttctgcatttgctttgctatgaactgaattttatctcccaccttcaattcataggccgaagctgtaaaggccaaagtgactgtatttgaaaataggatctggaggaggtaattgaggttacatgaggtcttccataaatctttctttagtaaaggctctcagatcccttaaaagtatttaaaaattggagtgaaattaatttgctcttctgacaagttcaagatcaaggttccagcaggattctgtttttggtaaaggctctctgttcctggctccaggaaaagggaaaggtgggtgggcagtggggggcagacagagagagagagagagagagaggcttaattctatagaattaatatattaatgttctatctctctctctccccccactgtctttctgcctcccactgcctgcctcactttccctttccctggagccaggaagagagcctttaccaaaaactgaaccctgctgataccttcatcttggaccttccagcctctaaaactgttaatgttaataaacttccaagaaacacgctgtccctgatataaatggcataaaattgacaaaaagaatggtaaattaatttcactccaatgttgaaatattttaaggaatctgaatgcacattaatttgcatactatttggtacctttattgcagtatgtaatgtatctgaagaatgtacgtgattaccacacacactttccctttaagtagtaaattttaatttaaaaagtgctttaaaattcactggagaaagttttgcctttaacttattcttctgtactgtcactgatgtcattaatcttatatgtttcatgtatgttccttacaaaggctgtcctaatattataaaggagatatacaatatcctgggaatcttctgaaaatacacattctgattcagtgtgtacggggtgaggtctgagattctgcagatctattaagctcccagttaatgctaatgcttctgatctagtaattacatttttagtacagtatcaaggtcttctaatttcttgaaatcatcagtactaattgaagttacctgatttctttgttgatggcatccaattgttcctgaagcatcatggctagcgtctgggcatcggaatgaccacttggagagagaagatccattgagctaaaaattgtttctctgtcatcatcatcaatatcagacatttcagtgtcactttcaaaagggtggctgcttagtactccaatctgttgagttctattccactcgtgatccccaagagatttcacctgaatggtgaatgaaaaaatgcagaatatttatcatattgctcattttcaaagcattaatctcaaagacagcaacaacaacaggcatgcttttacaactgaccttgcaaaaactgaaccaattattaacattttaatttatttgcttccataaaatagttccttgacatcttaagtaatgtgagggattgtcagtataaatatcaagattttagtagaaataaagatgataaacttctatatgttttatagttcaatcatattccaaggtaacaattactttaaagcatgtatttgtaatacttttccttatttccaaatataacaatctatttatttgtactcaagcactcacgacttaaactaattagtcttcctatattttcttattataagctcagaccacaaatattatcacataagaaattacacaggaattctcttcccaacatttatttacatcgattctaacaaaatattatttaaaatattgcaaaatgatgtacaggtatactccacagagatttcagggttagttccagcccaccctgataaagtgaatatgacattagagtcacacaaatttattggtttcccaatgaatatgaaagttatgcccattctctactgaagtctattaagtgtataattgcactgtgtctaaaaaatgaacataccttcattaaaaatactttatagctaaaaaatgctaatgatcatctgagccttcagtgagttttaatctttttgctggtggaaggtcttgccttgatgctgatggctgctgactgataagggtaatggttactgaaggttgggtggctgtgacaatttttaaacataagacaacaatgaaatttgccacattgattgactctttctttcatgaaagatttctctgtagcatggaatgcagtttgatagcatttaacccagagtagaacttctttcaaaatcggaatcaatcctctcacaccctgaaactgtcttatcaactgtgtaatctaatattttatatcctttgttgtcattttaacaatgttcaccaagagtagttaccatcttcactgggagtagattccatctcaagaaaccactttctgttcattcataaaaagtaaatcctcatctgttcaagttttatcatgagattgcagcaatttggtttcgttttcaggctctacttctaattctagttctcttgttattttcaccacatttgcagttatttcctccacagaagtattgagcccttcaaagtcatccatgagggttaaaatcaatgtcttcttaactcttattaaggttgattttttttttttgagagggagtcttgctctgttgcccaggctggagggcagcggcttgatctcggctcactgcaacctctgccacccgagctcaagctattctcatgcctcagccttcagagtagctaggaatgcagaggtgcacaaccacacccagctaatttttgtacttttagtagagatgagatttcaccatgttggccaggctggtctcgagctcctgacttcaggtgatcacctgcctcagcctctcaaagtgctgggattacaggtgtgagccattgaacctgatcaaggttgatgttttgaccttctcccatgagtcataaatgttcttaatggcgcctagaatgatgaatcgtttccagaatgttttcaattggctttgccccaatccatcagaggagtcactacctatggcagttatagccctgtgaaatgtatttcttaagttataatacttgaaagccaaaattactgctttatccacgggctacagaatgaatgttgtgttagcaggcacgaaaaaaacaatctctttgagcatctctgtcagagctcttgggtggccaggtgcattgttaataagtagtaatattttgaaaggagtatttttttctgagcagtaagtctcaaatctgtgtttaaaatattcagtaaaccatgctgtaaacaaatgtgctgtcatctaggctttgttgttgcattcatagagcacaggtagagtagatttagcagaattcttgaagaccctaggattttcagcatagtgaatgagcattggcttcagcttacagtcactagctgcattcattcacccctgtcctctgagtctttgaagccagtcatttacttttcttctctatatatgaaagtcctagctggcatcttcttccaatggaaggtggtttcatctacattgaaaacccatcgtttagtgtagtcatcctcatgaattatcgtagctagatcttctgaataacttttaacagcttctccatcagcccttgttgcttcaccttgcacttttatgttgtgaagatggcttccttccttaaactttatgaactgaacaaccctctgctagcttcaaagttttcttctgcagcttcctcacctctctcagtcttcatataaatgaggagagttatggtcttgctctgggttatgctttggtttaagggaatgttgtccatgctttgattgtttatcactaaatgatcaaatttacgtagaccactaaaacgttctccatagcagcagtaaggctgttttgttttcttacttgcgtgttgtttcttattttccttcaggaacttttcctttgtagtcacaacttggctgtttgatgccagaggcctagcttttggcttaactcagcttttgacatgtctttctcactaactttaattgttgctagcttttgacttagtgagagatgtgcaactcttactttcacttgaacacttaaggctattgtagggttattaattgatctactttcaatattgttgtgtcttggggaatacaaaggcccaaagaaagggaaagcagtgggaaatggctgttggagcagaagcacacacaacatatagattaacttcactatcttatattggcatggttcatggtgtacccaaatgattacaatagtgacatcaaagatcactgttcacagatcaccataacagatataataataataataaaagtttgaaatatttcgagaactggtaggtgcagtggttcacgcttataatcccagcactttgggaggctgaggtgggcagatcacttgagcacaggagtttgagatcaacctgggcaagatggtgaaatcccatcactacaaaaaatacaaaaattagctgggcatagtggtgcccgcttgtggtcccagctacttgggaggctgagatgggaggattgcttgagctcaggaattcaaggctgcaatgagccatgatcgtgccactgcactccagcctgggtgacagaataataccctgtctcaaaaaaataaaaaaaaagaaatattgtgaaaattgccaaaatatgagacagatataggaaatgagcacatgcattgaaaaactagcatccatagacttgcttgaggcaaggttatcaggaaccttcaatttgtaaaaaactgacaaacaaacaaacataatgcttgtgaaatacaataaagcaaagcacagtaaaacaaggtatacctgtaatttttaagcccaaggcatgctaatttacatggttatgttttttaaatggatacaagaaatcttccatttgaagtaagcaattgaccagtgtttttcaagctgttatctgaatgtatgaggaggctgagcataaaagacagatcctagatctcttttattctgcttcttaaaaaattggtttttatttttgtgatcatataaaatgatttctatggaagaccacatgatacttccctgagcattgagttaagaattgagaaccagaattagtatttgtgttacaatttgttttggtatcaagtagcactaattaatttgtcacataataatgagaaaagaattgagattaacttaatttagtcttcatttgctcatttatttattcatgtattcaacagatattgaatgcctactatgatggattaattaatacatggcatactggtgccagttcaaacccaaaagtcatcaagggcctgtgtacaaatatggacaaatggattatatagtatttggggtgaataaaagtggttgaaagaataaactatgcttaggcaccaaaggactattttacttctctgtaaaatacaactacattattcaacaaacagcttgcaaattttaaattaagttactgactgaatggaaggctagcactgccccttatcattaatagttctttatgaacacaaggaatagtctatgtacattttcttcaaagtgtttttaaaataccaattttaattaagttaatttgaatgaacaacatgaatgccattgctcaagtgcccaagaaaatcaaaagactacatgtttggcaatgtagcataatagttaatattacactactaatagtactggaaactacacaaacataggcccaagttttgactccattactttgctacctgtgcaatgttgaacatttagcttttctgagcctcagtgtttttatgtctgaacttagtatacaagtagtacccacttcataatgttatatgaataaatacatgggaaatgcttattcaactttgggcccatagtaggggctttatgttacttatagtttttttaaaaatgtcatactctgtgtttcaaattaataaaaatgctagcattttctaattatctcagtgttaaaattctatcaaaaatgaaactatgtatttaaataaaactagagaagagttgaagttaaaagattaacctttggctcatctcttcgcacacccatgcggcctctccttggtcttcttattactttagttgttctgtaatcagactggctgtccactagggatcccactgagtaccgcaactcagctgaggtgtctagatgagttctggaaaaaaggaaaaatataaaataatccaatctcaaaaattaaacttaccaggaaattactatctgctgttttactggcaataaagcagaaatcctcaaggaaataaacctcaagaaagataaccgataaattgtcatgactctctgaggcctctttagagacttatgtcagaagctgcagtcttaggtccattcctgaaagtcaagtgcactttcttcttttagaatatacagtgcttataacctttctgtttattatcattttcaaatgcagtagtaaaatgaatcataataagactgataatcaaaatccattaggttaaattctggcaatttagtttgagctcttttgtgtatatcacagtatgtgctattgattactgtatttgttttaaatatttcttatacatctagctaaaaatgtctgaaatttgagggtcccagaacttttccaatcttaaaatttttggagaaatttattcacattgtctatttttcacattctatttttcaatttagagaatcaacaaaatgcttaaatttagatggacccaaggcttatggtcttatttttataaaagaaaataggatatactaccaaaaggattttttaagtttttaataagacattgtttcaaaaggatgaagaaaaatcttttcataagcacatttgattcttaaatctgcttaaagatgaaagagtcggaaaattttagttggaaagtatcattacactagttttcaataaacatggtaataaagtaccctataatcaaagtgcagaaaaggcttctccaggcatattacttatatgtagatttatagcaaattcattttattgttacaataatgatgataataacagtgacataatgctgtcctataaaatgaaataacagatctatcatcagtaggaaatatacttaaagctgttagttctattgaatttgaggctcctgctgattgactatactctctttttcagttattcttgtgaacaaagacaagcacttccaaatatctggtaacattaaaaaggggaggtgaggtttgggtgtttgcaacagcagaagacactaacttaagaaagttcttgttttgccaaatggggcattagaacaaatgaactaaaacattttccatcaaataggtgacagctattgtttttgtagcaatgtatttgagacttaatcaagtaaacaggttttatcatggataagttacatttaaaaaaaaaaacaactaggccatattcataaaggacacaactctgtctttatctcttgggcagaggctctaagtttcatgaagaacaaagatcagattttagtcaccttcctatgtccaggaaggcgttcctagcatataataagcacttcataaatatctggcaagatgataaataaaagaaatgattataagacaggcttaaactgtcttgttgtgatcagtctgggttcctttttcctgtggctgcttaccttaatgtccctttaggcatcagggtgaagtttctaacattataactcatcatcctaggagcattgttttcttgttgatttatttcacagctccagataatttattttaaaaaaaagcaaaacacagatctaatcatatcaatttcctgcttaaaattattcaatgtccttaaaggccctctataacttgggcctttgccactttccagtttcattttaaggtactctctgcctagcttttcatacagctgtactgaccttctttcaattccagtaactcacactttcttttcatttctttgaacatgcttttgtttttgtttgtttgtttgtgttctcctgaaaacagtctcaacacatgtggttaacagttttaaggtctcagtttaaaagtgctattgccatctacccttctagctcctagtattcttttttattgtaccagtcctcaaactcatctctctcctcttttttccagttctctgagctagttctctaacaggagaaaacagaggcaatattatcatactagttcaatttttaaatcattctaggtgttcagtattttgaaaggcttttggaaggtctaagtaagtcacaaaataggcatcagttcctttaagcaatgaaccctgtagcttctcctcctgaatctcctgtgactcttgcatgtaatctcattaaagaacttgcataaataagccaggtaagaatttttttagagaaaacctattacccatcgctctgcttcctggagtgttctctgttgtcctttccaattacccagagtctatcttttttcagagttgagccaaatcaagccctttgtagtcactctggaactcattttactttcttcttagatgagatattaagagagaagagtggtcactgatattcactcaccttagcttatctctcctcacctctccacctattagatcaaaacttagtagactgagttctcatgcacctcctatttccattattgtttttacgaaattacttgtcctcagaagcatgaatgttctataaataattgttgtttaataaatattcagttatcctgtaacttattataataagttctgtttagctagcttaccttaattatttctataatactttatacttgtgatatgatttactatacatataatccctactgcttgtcttattttatctgcaaaccaagcctgtgatataatcagaaaaatatcatttatgcatatttaggtacaaatatgtatttatttagaatgttattaaggaaaacaggtttccaaaatgaagcagcttgtaattatctgtgagtcctaggaatgtggattgtcttattcttggtctagggttccttccactacaatctgttgatcaaagaataattgttctatataggccaaatcatccttcattgtagataaatgtcacattgttaggctgcccataatgactcagtgcagtgatagacttttagacaacactttgaaactctgtattttgagacataaggtcaaaaaaacaaggaaatggccatttattcttaatcaaatatatttaatctattgatttgataatgcttattctatgcattgactcccctgatattttaccagttcttctccttctccttctccaccatcctcattataatcatcataaccatgtgaacacataacattgaaataataatttcagttcacatgtaaaaatcagaatcttaaaaatgtgaaaaataagaacgattttctcaattaatgacttacatatgtaaaagttctttgagtgtttttatgcctgccgaactttttctcatattcaattgagtatggaagtacttaaaatatcaaatattgtttttccttacatttatattgaaaagaatttaagacacttcaggattttttcaatttgaatttttatttgagaatctgaaaaatgctttaccagatattcatttattcattctataatatatcttgagagcatactatatgcaagatagttttttaggtgttgagattatggtagttatcaaaacaaatacaaacccatcctctggtggagttaactttctaaagatgaacataacaccaagaaagatgaacttctactaaaagcctatggtagtggaaagtttcaaacggctgctattattctgtgttgcctagtaaataagtgactaaatgagtgtgtccttctagggtttctaacaactttaaataaaacatctcaaacacaaaaggaaattatgtgtgaattattaacatatagatctatctatgtatctatctatgtatctatgtatctatctatctatctatctatctatctatctatctatctatctatgatctatcaagtaagctgccatccattgcttctttttcttaagatgagatagtgaatcaaagtagatgagtatggctaaatttatttgaagtttttgttttcttttcttttatctgattcatttctcttttcctcttttttttttttgcaattactttaccgaaataggtagatgctaagtgaccataatcaataatatttgtttagtcacataagcattgaacatatttctgcatgtttctacactgaacacatatagaaaattttatgtcgaattcaatttctgtattgaacacatataaagagaagggctgacgcctcttcttgaatgagatgcaatctccctgtacacagttcaatttcttcaattaagaatcttttaatatatttatatatataatgaaatgcagaatacaaaagttaacattttaattttttattgattatctacagaaataatctctaagttaaaaagttatttttgaatgtaaaaactgcaaatcagtgaagagtcaaaacatgataatgactagtgagcaataggaagtactgatttattttagttgaggacatatgaaaccataagggaattcatgttgattttcagtgaattatagataagcttttagtttaatgttaccttggtattgtgggttcaattaaagagccagttctcattttcaattggtcaagttcagatctcagcttttcaatttcttctgctaatctttcctaaaaaatcaaaacagtgttactcagatgccagtaatatcagcaagcaattatgataaatgagtcttaatgattttttttaaaaaggaaaaactgaggatatatttttattaaaggttattacacataataataaagcacgccaaaattttccccttgtaataaaaaatgtggatagcagaaattaataaaaatttatctacaatctctggcattcactaatcctgaatatttgaaaattcgtgggaatattaaaattatgactagctatgtagatgtcacttaaaaatgcagagtagaaatcatatgcagttttgaaaataaagaaaatgtcttatttatgcagtaaatgaagaactttcattattctatgagggttaaaggacatatgggtgaaggaaaaagatgattggattgaaagaaaaaggaaagtaaaccctctggcttttactctgcatgagataggcaacaattggaggatttttttaaaaaatattaattaattaattaatttatttatttatttaaagacagggcctcactctgtcactgaggctggagtgcaccttaaaaagtaaagttaataaccaattagcttgatattgtcaccattatttgtacttaattataattttctcaaattggcattttctggtctataaatttatgaagataggggttgtcttagagctttaattaactgctcatgtaagcattcaatttggttttaatgattataactgttatattgttttacaggtctaaatgtatcattctagatttttctattactgtttttccccttcccagtggccagtgcttgatattttactttactcaaacttttctcaccacatttttttttgttaatgtggcctttgcaatgtttctcttttctgttctttttattctcactacgtcactaccatcctactctaagccctttttatctttttcctgaatgatttttaccagcttcagtctctttcctacacatttctctgctagacatataatttcaaaacacatgtacaataaactaatgtgttgctttaaaatgttcaatagtttcttattgatttgtaaatatctttgttcattattttcacaaaagtgcgctgagtacctcttgtgtgtcaggcacctgagatacagtagtgagctgacaaatgtcttgccctcatgcaatttagaatttagtagaaaagatgaataataaacaagtagtaatatagaaatatagcatgttgttagaaaggagaaaacaggggagtcatggaagggtttttcaataaagtgatacttggacaatgacctaaataaaggagaaattaaaaaatgagactcttaggaaaaggcatggcagataaaagcaacaacacgtgcatacgcctcttagtggaaatggagtagagggtaaggagtccagtgtggctggattgcagaggttaaattgacaaatagaggatactttttaaaagtatgattgcagaactcaggaatggtagtcctaaaagaggttgtaaaccacttcaaactctggcttttactctgcatgagataggcaacaattgaaggattttaaaaaattattttatttatgtatttatttatttaaagacagggtctcactttgccactgaaactggagtgcagttctgtgatcacagttcattgcagtcttgaactccagggctcaagtaatcctcttgcctctgccttccaagtagttaggaggactacaggtgtgcaccactgcacctggctaatttgtttttaatttttatttttgtaaagatggggtcttgctatgtttcctggattttctagcagagaagtggcatgatcattctaatggctgtgaaatagattgtcaagttgaattgggagtcagaaaagagaggaaattttgaggcaagagagtaatggtttggacaagaatggtgttagggtaagagtggctatattttggctatatcgtgagagtagaaataagaggatttgatattggactagatgtgggatatgaaacaaacataggggtcaagactaagtccaagttttttagcctgagtaactgaaagaaagaaagaaattgtaattatgattgactgagaagactgctggtgtgttaggttagatggtggtggtgtttgatgtgtgggagtggggtgagaatagactggcatgttacatttgaggtacctaggtgtccaaatggagatattgagttggcaatagaatatataaactctctcagggaagaggacccagtaggtaatctaaatttggatgtgctcaatttatagatggtgtttaaatccaggagatcagatgaagtcactaggggtgaatcagagagaagaaaggaaagctacctagaaacttcaaattgtagagataaagatggaaagggaaacactgagaaaagagtttgagcctacagagggttttgctgataatggactgtgagtacagttagtttagtggaaatttgaggaattatagaagatgtggtcagattagtgaatgtgcccatctaaatgggatgatagttcagacatgagatatgatctgggatttactctctctggagactgacataagcaaggatgcaaagcatggcatgattagtactcttggttgcttaggcagattgttggagttacaaggctttggtaggtggtgggggagtgggttctggggatattgccaggagcacacagagctttggataacataacatgcataacagcatcacgtccaaaattcacaatctgctcaaaaactacttctttaaatacataccagtcacagtaaacttctgatgattcatcaaatcaatcatcttgattttctttgtgccgttgcagaggattcatcctctacttagaatgctctacctttatgaagatcatatatgtctttaagaggctactaaaaatgtaatctctgtgttgtttttgtgaactacctcagaaagaatcagatactatattctaggccccacattacattgttctaaagacctatctttcaggagattgtggacaccttgactgtagaattagttatttttaattgcttcataatatgcagcatccagtagggttaaatgtataattgttctctttcctctattcttcatcttttccaataccttctatatcccatactatccctccctccctccctccctcccttccttccttccttccttccttccttccttccttccttccttccttccctccctccctcttccctttccttcccttcccttccctcccttctttcttccccctctcccttctttccttcattctctttttcccttccttctctctctccatttcttctatcttttctcaacatacagttatagatcacttcttaagttagcaatcctttcttctttaaaaaaataagataaaattgctaacaataactttaaaggctaatgaagaaggaaaatactattagcaattaccattaaaatttcacaatctgcccttagtttcctcttctaccacataccctacaacaggaataattgattccagccaaatagttgtgcctattatttaaaatgtcacactcattacccatcccctcaccccaccaagcacctgtgatcatgccacatgcactatgtttgaaagcctggggtcagagtcctactttcccttaaatcttcagtcaagtccctccttcctgaagtcttcttcacagcagcaatatatcatggtctttcctacctgtagctcttactgcctacttcactaatttggcatttggcatctgctaccctgcatcctcattggtttgtaagggctgtgttctctctcctcagttagatttttttagctcctttggaactaggattatgtttggacatatataacttagcataattctatttataatagtatttaatgtatttctgctgaaagaatatctaaaactgacataaattagcgcatatattttaattctatttatataaggcataaagcaaggcaaaaccattttttaatgttataagtcaagatagtgattatcctttaatggaagagtatgagtatagactaatttggggggagtttctgaagtgctaatttttggtgaatttgggttacaaagattcatgaagctcttcctctctatgtacgcttttctgcacatattctaaaaagttaaaattgttttacaaagatagcatactaaaattattttttcaaatttattttacaacaaaacattcatcagtggaatagaaaataaaaatagaaaatgggcccaaaacataagtttccattataccttatcatgtaaagattcttcaagattctttctgaaagtttctgattcttgaattaaaacattctaaagaaaagaaaatagcagaaataattaataaattaaacataaaatacttaaaaatatattgattaatatcttatcactcaagaatcctcttagattccttccttagttcaggtatttcttggtttccatggaaaccatgctttgatgaaattttcaaatgtgagaccttcacatttaaaaaatacataatttaaatgggaaatgctattttgtaacacttgaatgaacaaatgaaataaatattgcattttaagctacttctgtttgccttttctcagaccacattttaaatcagaaactattggttattcttcaagtaagaaaaagtgagcaacaagctaaatcttagaggtgttataaaaaattcagaagaactcacttctattgtctgaagaaagaagaaatcatgaaatcatattttttaaaatttcactttctggacatctactgcaatgtggaattaacaatttataatgatacttaaattattagagaaataacaaactctagctattcagaaacctaatattacatgtcacaaagtcagtggaaataagttggcatcatagatacttaaaataaaccttgccagaaaattatttttgttgttaaaaattatttatttttctacaaaacacacaagtactataagacattatttaaaataatgtattctttttcaaagttatagaataaaattaaactaagagtgtagtaattgcataggggccatgtatttgaagttgtatgagaggaagtcatgtcttattactttctaatgggtaaattaatcaaactaactttttgtcaaaacattttccctattttggtttattttatgtactaatggaaaatgtctagctaaaatagtgattggcattcaatctagatttctaaaatgatgtgatcatccgggttttataccctaccttaatttatgctctggaattggtaaccagctctcataactcttgctggtctggtagctgccaactatcaatgagacatatataactgtaaatcacattgcagactgtacagaagcactatttctgaaataatgcagctgaaaatactgggttcctaaaccctctactgggattgatactagttcttttgatgatataaactcacttacattttgacttttagactggtgtgtaggtatcagtcacttgacacgtgaatatttcaaatcaccttccccccaaaaaagtattgacttgtgtctcatcacttttctattttgcataccaggcaaaggatatataaaatattttcatcataaaagcacagcatattttaatacatttgcctcatatgaacatgtgaatataaaagatttatatatcatgcaaattttttattcatcccaaatttgatcttacacttttttaaataaaaaatatgcattcctttctaagaatataccaggcatttttaaaaactaagtaaatggatcatctgaccattacaatgattgcagctgtatataaaacaaacatgagcattgcaaaatattcatgtgattttacccttctatcgttttaccttttcttctagagcagccattctttcctttaagtgtagttgtaggcgttcattggattcagtcagaagtctatcaaccgtatccgataatctcttgttatgctcctcattcattttctctctttgcctagccttacattttaaaaaatgacataaaaatccattcaaaaactgtttgagattatttttatagtgttgctagttttaaattgaatttaattttacatctgttttgattaaagtggtggaaacattttattcaagtcaacaggtcatatttgtaagttttaaatataacccatactcagttaaaggctttcttcttatatacagaatacgaattcataaaccaatgattggggggtaatagttcttaatatacatactctttgaagttcttgattcttctcttcaagttgaccctctaaatgtctcatacgttcttcaatatttccatgtctctcttcagcctgttaagaaatatgaagaatacacctgaaatgtaagatttggttaacacttttcctctaaataaattgaaataaaatgtaaagcaagctactaccaactgcaaacatagtttttaaaaaataaactttcttcaaacaggcagctgaacagcattgcttgaaatgtgtcagctacaaaggcctgttacatccaagcatcagcaaaacattggagttatttatgagcaatgaaatcagccaaatgtaacatgcagactgtgcatggtttgaacacaaacctgccattgtccaatcttaagctcctgaagcactgaactgcacagatggttgattatcaataaataaaagtaacataatttttataaatgaaaagaaaaacttagatggattctatttagcaatagaaagtaaagtccagtaggactaccttcctacgtatggagatcatttcttgtagtttagcttccataacatattgataatcatcagatgaggtagaagaggttggatcagactaacgagtcaaggaaaaggagagggacaaaattgaaaaatcagaactaaagacactgacaccaaacagaacatagcacagaatgcttaaaagaaaagtgtgacagcaaatttaatactttaatagacagaattttatgtggaaagaactacattgatatttggtgaacacgatgcagttgatggttttaaataaaaaacaataatatactaaaataaaaagctatcaacctaagatatgaaaggttagtgatggctggcaatgaaagactactacagaatgaataaagcaactctgaaagagttatataataattggaattatgggaaaccaaacaccagaatatgtctctgatagattgttaaaagtttgtattagggtttgtttgtctatattacttaaaaataatggaaacagtagtttcacaatgttgaggaaaatgctagacaatgactcaggtgtaattaatttggaacaaaatttattctaaaccttgctctgtagaaaaaaagataaaaaaactaagcctgggggttattgtgagtagtccccaattcaagcaagattgagtttcctcagcaacaggaaaacttatgaaatgacttctggtctctgaatgcacactatggtcattggtctagaatctaatggcctactctcagatacttggtctcaaatattggtctaacggtccactctcagatattggtctagaatttaatggcttactctcagataggtttaattagaaattttaaatgaaaatgattgaaagtcctcaaattatcaattgacaacaatgctgtgagaacaagaaatcttgtttgtgactctcctaaatgacattaggggccaatcccaaactgttcctgcattgatttgttgctgtggaaacaaaatagtgcctaaagtgaataggcagcacagtttccttgtaagctcatgtttgcccagtgccaaggttagatacatgtcttggaggtgaccgtcaggttaccacaggtgcagagtgttcaacacatgtgacattgctgatagcaaaattgttagtatgttatgcaaggattacatatgaagttatatcaacattttaatcattgcaagttaagtaattattacatttaaaggactctatgtcaggactacaaatttaactccacagcatattctgtcacattttataagctcattctaaaacagtgaaactcactttatgccaatatagaactatatataaatatgtcatgcagtaactgaaaagaaatagtaacctattcatttgattcagatgcatatatactattttatgcaataaattcaaatttaatctatgaaagcaaacatttaacatttcaattctggtgtgcttatgcaaactacaattcaacatttacattttgtaaggctttccttctgatattcttattttataaatgtggaagataataaagacatgataaccaattcctttcctccaagtcgtcctcaaatttccaatttagaagctatacagagttaccatggtccccaaatgccataattttttaaataatattatttaaaaatatattttattaaaaataaaaatttaaataatattatttaaattttagagtaagtggatcaaaatgttgttgaaattatataatctaaattcataaagatatctgtgatccttcaaaattacattttaacatgcagttagtagtgtttaaattaattaggtgactgactcaagacacttgagacatgaatatttcagctgccaaaactgtgtcttcaaaaatacaagtttttagaggtctttaaaacttctagttgtttctgtttacttattaaaaacacatcaaacttaaaaagaaaaaacacacaaaacaccaaaattgtgaaaattcccttcagagaaaaaaaaagaatttggtcctgtttaaattcctattattgctgatacattttattggtactagaaataaataaaatacctcattcaagatgaattatgtccttgctaaaggaatatgcattttaattaaaaagtagatattataaatcataagactgggagcccaaagtaatctttattggttaattgcgtataaactcgccaaagcaaaacttttagttgtatccataaccattaatcaatcattctgactttctaaaagacataaataagctttgcctatacacacacacacacaaacacacacacacacacaaacacacacacacacacaaacacattagaaggagaaaaatagtttatcaaccaaagaatgcattcagacatcccatctaaataatatatactgggaccaattttcaaccaacactactgatttgcattctatgtgaaaactatagttttagcaattgttgtaaatacaaagatcacacagaaacagtctgctattttttatactccttggtgaaaaactgtttatcttagtttcactccttaatatgatataggaaaatttaaaatatactaaagttttaggatgaactacaggcagaaatggttttgagaacatgaataacctcagaaagggagaagaaattaaatttaaagagaaagacctagaaaaaagaagaaaaaaaggtgacagtaaagtagaaaaacgtatattggtgaaataaaatgtctgaggggttattaagaatatcattcaaaatataggaggaggaacccatgtttaagctaagaagaaatatttttactttagtgagtagtcaaaaggttaatgaacagaaaaagactatgatgatccataataaggaaatatcagaaacaaattgaaacagaaaaaaaaaaaaaaaacagatataaaaatagaccctaaaggtcttgagaacagagtacaagaaaaagtacaaggctgttgaaaccacaaaacttgggaaaaggaatgaaagagtgatcctcaaatgtttaaaaaaaaaaaatgacaggcaaaaggaatgtgttcaggataaaatctcagtacttaaggagctttcataatgaataaaatatggtcataatataaaaagtatatatttaaaatatgttgttgacaaagcaccagtcagaagagaaagtgataaaaaggagagtgaatcagagcatttgaagactttttggaagaattccaattttctgaaaaatgaaatcaaagaggttcagggacagtaaagggaggagaaagctgaggggagctattttttgtgcccaaggtaatattgtgcccaagatatatatatatcaacttaacagactagacaagataagaggaaaaaatataaggcacctaattccagttatttttatatattctaaatcaataattcttgggagtatttaatatagtgttttttatgtcaaatattatattttaaattgtttttattctcagtctatcaaaggttaatgtggggcagtgattttctgaattgtaaattgtgttacttgggggaaattgcagattttcttgtgttttagtcaagataatattgataattattttaagctacaattttacaaaagttatttttcttattcagtaactcatctaaccccccaaaacagtgcaattgaaaaagataactctttttgaaagtcctttatgttctttagatgaaaggcctaattatgcatatcttagtctaggttatagtcatttaagatctgtgtttgcaagaaaaaatgaaataatatgaacatgtttaaatattttttcaaattaaatgataaattaatctttatcttagaaatcacatattcctgaaattgccagagtggtttactggcatggtttgtgactacagaacgatccaaattataatcccatcttaatcagttttatccaactagttactccaacactctgtaaacaagcaactatttaaatgctctctaatcctgctctacgcagtcaaaggtttgtctttcattacctggttaattgtcctattttaaccaacaggaagatcagtccactgttcatttttaattatttgcttttttagaaaatcagatgtgtgtgtctacttcattgctgcatcaattattttgggtaaatcctaatcccgtaattttaaacttgaagtccagatacctatcatactcacttattgtagtggccttgaaaacttagcaaatattaatgattgtataaaaatataaattgtgtgattatttttgaattcatattaaatgtcaaacatgcttttagtgacaaaatgtagttttatataacttgtgacatatacatacactttgaaatgatgccatttccgtttgattgtcagaggtcagaatagttctttttaacattataatgcttgtaaaattctaaaatattcagatagttgcagaatctactggccatattatacagaaaattttgaacactcttcagcgtattattgattttaattttcagatgaaattacaactataaaactgctttctgatttttaattgttttagacctcagacttttataagtctaacttcccacttctaacaagttttatactgtagttggagaggaatcaagaagttatgatattctctatacttctaatagcaattgatgtgaagcctgttaaattgttatgtctcatataacattatcttttttgtttatctccaggattattatacaaatattaccatggaaaattaactataacaatgacatgaaattttacttgttttgttaatgtttaaataggcagggggatcatcacatttgtataacaattattcctgctggcataaatatgtatgacaagaaaaaaattgacttaataacagctcaatataatagagattaaacttaattttcataaagcctatagaaaatctttacacattccattttgattacaagtcctttctacaaatatatctaggttgaccagttgttctagtgcagtaccttggttagggctgcaattctctgagccagttcagcctctacttcaggcaaggtttcagcctttctcatggtctgctgcaacttttgttcagctagctcaagacgttcttgtaactgtctgtttttctcttccatctgaaatgggaatgggagcagagacacttaaagagtcagagtttggatagcaaacaccagtcgccaggggctttgcacttcagccatgattctagatttaaatcagccactaccacacctaaatgtgcaaagtgttgattgttgtcttgttatcatatattgcttatctgtttccttcatacatttcagcacattaaaacaatgaagaagctcttaccactggcagcaaaaaggaaagaaattactcatgagtatacattttaacaaagggaatatagctcagtactaagacatcagatataccaccgtagcaaaatattgaaaatcatggtatttagactggagttggagaggtaatgtagcatgatgatccaggctctagagataaggttgacaaacattttctgtaacaggtcagatagtaaaaatgttaggcctcctgtatcatatggcctcaatcccaaatactcaactgcgttgtagcacaaaaacagtcatagacaatgattaaatgattgggcatggctgtgttccaataagactttattaacaagagcaggcaaccaaccagctttggcccacggctatagtttgcctgtttctgctctagagcccaataaacttagtattccattattggctctggtgtttagcagatgtatgatcttgggaaagtctgactgtctctgaactgtagtgtctttactacaataacgccacctacttcataggtggtggttagaattaagtgaggtaatacatgaaaactgtttagcacagattctggctcatgcctatatgaaaagtaaatcagagtcattatttgtattactattaagataaataatttatctttctggaaagtaaatttcacactgaaaatcgtatttgttttgctagagaatttcaaattttagagaatgattactcaaacatctgtcaagaagtaccctattttatttactccgttttgtgagaatgatgagaacgcacagaccagaagaaaaccaagacagagatactgaacctgccgcaggatagcttctttatttgctaactcattttctagtttatcattcatgtcatgtatggaggtagattctctctgagcactgaggtaacgcttttcaagggttgtaattctttcttccatatcttccttttgtgccatggcctacaattaaaataatttagaaaaagcaaatcagattctcagattgtttaattattgtcttgttagttaaataaaaaagaaacataaaaactattgcattcttgaagtaaatactcattcctttcttttcattgaacgaatgtgagattgcaggtgcatgttcccaacttagctatcagaattatttttgtatcttcggttaaccaaaagctttctgctgtctaagaatgcaatggagtagcttttgaaactctctactgtagaattggcattcttgtaagacaagtggcagataaattagttcattatgcagtaaaattaagtacaataatgagtagagttgcaaatcataaaattgttaaaatggtggctacagttctaaattgtaaagcagtcttcaaatagataacaaataccatccgtattcttacctttacattaagaaagaggaactctgtggttaaaaggccaggccaaaaaaaaaaatagtacatttggatcttatttataagtttaccagctgacttagaaacttagccatttacctagttatatatgtttcaattacataagattttaaagaagtccatgaacacataaatataggaaaaaatcaagttcaagtggagaaaatcatggcattgataatattttaaacagtaatttttaaataatagaatttatagatagtaatatggagataattttacctcacagcttacatggaaatttattggtagttagataacctactttattgacaagatgttgggtgaaaatcaagtgcagaagtgaggctcattggcctggaattgtttcctgagaatgtgggaagcttctttgtataaggatcctggaattgaggaaatggctatagtttccatatcttattatccagaatcatttcatcacttattcttaatcagtgcctttgtcactctcctacagggtccagagccagtcctgtcacatataataatcagataaacagacagcctttcttccaattttctttcttttttttttcagatgataactctaatgaaaagataggttgaataaaaagtaaaataagaaataaaataggtaatgtcctaatctaatataatagcaagacataaattttgtttaaataaagagagaaaataccagaagtagtggataaaagggttgaaattaagaatttcagggaaatgggatgaaaacttgaagtgagatgctgtgtgtgtttatacatgtaccatatttatacgtgccattatttgactttgagaatttttgtatatataaaaaattaaaattaattaaaaagtaatagatcagccagaggcgatggctcacacctgtaatcccagcattttgggaggccaaggtgggcagatctcttgaggtcaggagttcgagaccagcctgcctggctaacatggtgaaatcccgtctctactaaaaatacaaaaaacttagctgggcatcatggctcatgcctgtaatcccagctactcagagaggccgaggcctgagaatcgcttgaacctgggaggtggaggttgcagtgagccgagatcgcaccactgcactccagcctgggccacagggcaagactccatttcaagaaaaaaaaaaaaagaaaaaggaatagatccaccatgaaactcatcatgttgtccctagtctcctgcccacccacaagttagctctctctcttgtattttttgtcttttattctccttacttttcctccacgctgctgcctgagagatatttctaaatgatcatattgcttcttggtttcaatacttttatttcttcccctccatcttcagggtaaaatctgagctacaaagcctggaataaaagtggttttgtgacctgatacttccttacttcagtgtactggggctaataacatccccccaaaattcgtgtccactctgaacctgtgaatgtgaccttatgtgcaaataagattttgttgacataatcaagttaagatgaggtcacacaggattaggataggccctaaatccaatgactggtgtttttacaaggaggggatttggggacacagagatataccgggaagaaggaggaagtcagtcagagaattgcgttatacggagttgtactgctaccagccaagaatgccaatgactcccagtaaccattagaagctagaaggggggaagaagaaatctcactagagccttcagagagaatatggccctgctgaaacattgatttcagacttaaagcctccaaaacagtgagtgactaaattatggttgttttaagccacccagttggtggcaatttgttatggcaggtttacaaaactaatgcactctgacatcatgtctacctggaatgtgtgctgtcttctttgtctagctcaatcctactgaccaccaagacccagtcaaaagctacttgattaattatgttgacattaaagtgcaaacataaaaaattaaatttaatctatgaattcagcaaaaaatagccagactaatttttaagaaatattatatacatactcctagattttagatatcctaaataatgcctactatttaaaaagctatttattttcacttttgactttttctactttacatattttttatctcaatgatggtagagtttttatcttagaggatcttttcagagtgcttaatattgtattctgtcagtttcatttgcaaacagaactctgggaaaattttgtggtctgaagagaaaagtctaaagctaacctgtgtaaataaacttcttactaaattttaacagcaataaagtcaataaaagatatacacacatttctcaagaacgtgagcactgaagtagtacatacttgctccaaatgctagtttgggacacttattaactctgttataagggatcagtattggtcaccttttccgtgcttcaccttcttcatatattgtgtgggttgagattctaatatgtagcacatagcattgttgttaagaatcaggaagtgctttgtatggtgtctcatgcagaaaacaccctcgataaataatagctgttatttattattaattactattatgtacacaattagatgatctcactctatgacgtagattacatgcaggaatttttgcattttgtaattttggtactgcattttttgattcagtgattcatgtgggagattcaatttttaactgcaggctgtgttgccaaaaataaactggatttacaagtcagagaaatagcttttccctctgtcatttgaaaaattctgaaagaggaagctttttctagtccctaaaacttgctacctacaaaaaaaatgagaaaaaataaagattcaatgatctcttgacctgaagttcatgtataaattggattttgttcatatttaataaatataactctctggtaatttagatctattaaagtgaaaaatataactacatgtttcagataacagaaaaggcaacactgagatgtatttaattcatttaatcacatagtgaaattctgaagaactgttaataggaagttggaaatacaggatggttttattcacaaaacaaaatgtaattaaaatactccactgaaaattttagctactggcacagctatgtatttgatatatcattatccatacacaattaataatccttttgattaaaaactggagagataatccacttgtatgagattgtctatttttctaatttgagtgctgtgtctagctttaatccaactcacgtattcttcctagatcaaaatcaatttaaggagttttgtttgaagacaaaatgtaaaatgaaattaaattttggataatttcttttttgacaaagaaaaattacaaaagtatattctgaagccatcagtggaacatatttataaattagattggtgcaaaagtaattgcagtttttgctattcaaagtaatagttaattttagataccttagaatgtcctcacatgcaaagcaaattatatttctgttttttattatatggttgttttttcttatttcctaatttttactcaattattacaacatacatttattacctgtacaatttataaatcatactatgctagcaatgctataggagtatcaagaaaaacgagcttatttttttctactaagaaacttgcaatccgtggcttatgcctataattgcagcccactgggaggatgaggtgggaggatcccttgaaccaggaatttgagaccagcctaagcaacatagtgggaccctttctctacaaaaaacacaaaaattttccagacatcgtgacatgtgccctgtagtcttagctactccaaaggctgaggtgagaggattgcttgagcctaggagttcgaggttgcagtgagctgaaaacactactgcacttcagcctggacaacagagcaagactctttctctaaaataaataaataatattttaaaagaataattaagaaaaggaaaagaaacttgcaatccagttgactctatgtgaccataacccggaaaaatattattcaggaaaataaaagctttaagtgctaagtaatttgttttttaagtacgtgattttcacatcttcctgcttattgaaaaaaaaagatccaaatattgattatttagaggacagttatgttgtagcttcattttatgatagttgctatcactgaattatttattgtgctgtgttgattttggaagcagttcatagtggaagaagcacaggttttgaagccatgctgatcttatttctcttccgtgctgccgaggagggaactgcatagatctttggcaagttactttacctcactgaaccttgtgggtctcatctgagaaaaatggagataataattagcattgccccttttgccagttgtgaggaatttgagactttccatgtaatacacccgtaatagttttcacatgtgactcgtccttaaaaaatctttcataaaccatgggcctgggtcttgagacctgaatatttcagaattcgtttatttagctttcacagtgctgtgtgtgtgtgtgtgtgtgtgtgtgtgtgtgtgtgtgtgtatacaaaaaaaaaaaagtgatgcatgcagtaacgcaggctgagtgtaggccatttcacaggtttcatcaacgccatcagttcctacagtcttgcacctggcactttacacttttccattgccagcctggctctgaaaacatttgtgtttgcaacctcccttcaaaggtggatgatgagagatattcctttctcaggaaactcttctaaaatatatacatagaaacgatggggctgataagagtagttgtattttaaaataattccacatgaaaggagaacgttttgcccattagaatggattcttaataaaagaacacctggcatcataggagtgacattttccatctgactgggtgttttgttacctacattcagaggctattagtatcaaggagttatttttaaataggcagttagaaaatggggattgaatgttgggccttacctgtaagtgatgctggattagataagcattaatagagcaatgagtactaagatgaaaggaaatcatctaaatctccagggccaagagaatgaagatggagagaatgaacaacagaccaagaagtgagcccggtgatttgatagccagaaatcctagtaattccttaacagtgatacagaagaggggttaaactgcctttactttatgaattctctgagtttgaattgtggggagtagtgaagagaagagatgcatccatgaactattatattaattcataaaaagttgtatcattatctgtgctgcagtggagcagtctaccacttcatggttcatctatctcttttttttgttttgttttgttttgttttgctttcaggcattgtcgtagtacatattctgatatcattcacaccttctgatatttacttataaatatctattctttcagcaaagattttttgagtgcctattatacaatcaatagctgcgcaggttctctgaagacagcagtgaacaaaacaagaaaaaaaccctagctcttatagatgtttacgaatagttggggtgggaggcatatgataaccaagtatatcagtaaaatatacattgtgtcaggtgatagaaagtcctgtgggataagcaaacaaaagaagagggagagtgtatatgtgtaaataacaaggtcaggggacatttcactgagaaaacaacattgaacaaaaggcagagagaaaagaaaatgtaacaaaacaggtctggcttgcttaagaggtcactccagttgagcagagcatgttaggatgagacagtagatgatctccaagaggtcaggaaggtggtagtagagagattgtacatggcttgtagaccactgtgagggttttgataatagtgtaagtagaataggtagtcactgaaaagttttaagcagaaaagtgacatgaactgacttataggcaggctgctcaagctgctgtgttgagcacagactgaggtgagctgaacgcatgagcaggaagaccaggaaacagatgaccattgaaataatccagtgagagaaagtgattgtgtagaaaaagcaaaagccatgaagattctgagaagaggtcccattatgaatactttgaaattgtaaataacaggatttactgctgaatcaaagcaagtgtgtgaggggagagatcttaaggacagcttcaagattgttggcctgagcaacaataataatggataaggaagactgcaggagggtctggtttgctgagaaaatatcaagaaaagagtctgaagtgctaattttgagatatcccttagtgactgagagagaaacatctggaaatcaggaaagaaggacaagttggagatattaattgggaatcctaagatgatggtggcttttggagccatgagactgcagaaattcaccagggaaataaaggtaggtagagaagggaagacactccaaggtcggggaggagaaatagaagcagtaaaggagccttcgaagaggtaagcaagtaaatacggatgaaaaccagaagaggataatgtgctatgagcccagtgaagaagtcctctggaaaatggatcaagtgcttcagaagactgagaattgaaccttggattcagtaacatggaggtcagtaatgacttttatgagaagagttttggtggaacagtcagggaaaaagtaagatacaattggcttacgagagaatgggaagaaaagaattggacacatagaatagggccaacttgatgaacaactagctagttatatacaaaagatacttttaaaagataaaaatacatttaaaagaatatgtaaaaatggaaaaggcaaaaagtcagaaaacgcaatttccacaaatataattttcttttcagttgtgactgaaaaggtgaaaaagtgaaaagattctaaactttcaccttagcaggtaaaatgatttgacagtgttacaaattaaacatctcctagtatttttttttagtaacttaaagtactctcttcacttgatattagccaagagactgagaaatgactaaagtactcatttttttaagtagaaaaagggatgttatgtctaacaggaatttaatatatagacaaagaaaggtcatgttatacatatgcgtgtatatgtatattaacagagatacattccccttcatgacacaaaaccaaaataagcaatggaacaatttaaggcatttttgtagtattcctatatgctaagagtatagcaattcatgattcatacacatatctagagttatttaaaattaaaagcttacatttaaaaaattttattaacagcttcagaatgtctttgttatatctgacccttgatagcacaaatttctttccatatatcatgggcatttaaaatgctcatgaagtaaactatgtttgcgctattgaacaagtttcataactaatataatgcatgccaaagtatggtcttttgagaagtaaaaagtgtatggtcattacgggaaattatggaaacagtatctcagaagcagcattcagaaatcaaagactgaaagtggcatgaatcacttacctccctaatgtccctttgatacttggtgttcatttcttctgttttaatgagatcctttcttgctgtctctgcttcctgttccacctctcccactcgggaagaaagggctgctaaacgttctttcatctgggccatttcatagttttgcttttcaagcaattcttgtagttcaactatttgactagtttcatcggttgagtctatagaaccattggacaaacgctgcagaaatagaaaaagaaatggcacttaagaattttcatctttaatttaaaatttaaaataaacttaaagaaattaaactgacactgctttcacagtgagaaataagaaattctgaaaagaactagttttgccgaaaaactaagtttctaaggaaactgttaattgacattaaaatatgaaggtagatcagtaattttcaaacagtttaatagatgtatttgaaatatgctatgctatgctctctctatatataaaacatagcataaaacattgatgtatcctaaacatttaagtgttagctactattttataaattagatatataatttattattaatttacaatgctatgatataacaccatacattatttttaattaatgggtaaggacctataaggtgtacaattttaaaatttttcttcaagatcccttgtaaatttttaagttttattttcaatgatgcccagaagaataacttaccaaatattttttatcaaagattattcctgctgtgaatctgacctagctggaacaaacatatagtatagaaaagtttttatttctatattgctattaacataaaatcatgtgtgcacacaactcacaggaaggaggttgaaaggggttaaatattttgagagctgatttttcttctttccgaaaggactgcttagaaaccagggttttctaaaaatatgtcttcagaagtatgccctacagctaaagtccgaaatatataaacaactcaaacaactcaatagaaagaaaataaatccccagataagaaacagggaagagacctgaataaacatttctcaaaagaagacatacagatgaccagcagatacatgaaaaaatgctcaataccaacaacgcatcaggaaaatgcaaattaaaaccacgatgagatatcacttcatacctgttagaatggctattagcaaaaagccaataagtgttggtaaaagaataagaatgtggtaaaatggaacccttgtatgctactagtaaaaatgtaaattagtatagccactacagaaaaaggtatgagagttcctcaaaaaatcaaaattatcatatgatccagaaatctcacttctgggtatataaccaaaggaattgaaatcactgtgtggaagagatatctgcactcctatgttcaatgcaaaattatttacaatagccaagaaacggaatcaacctaactaagtgtctatcaacggatgaatggataaaagcgagtgtggcatacatacacaatgaaatcctattcagtttctaagaagaaggaaattctgtcatttgtgacaacatggatgagcctggaggacattattctaagtgaaataagccaggcacagaaagacaaatacttcttcacctcgcttatctgtagaatctaaaaagtcaaactcatagaagttgatagaagaatggtggttgccagaggctggaaaaaaaggatagctgtgatgagttaatgggagatgttagtcaaagagtaaaataattcaattatacagtaagaataatggtctattacacagcatgatagctacagttaataataaataatacattgctagaagagtagattttaagtgctctcaccacaaaaatgataagtgagtgagtgatggatatattaacttgattgaatcattccacattgtatacatatagcaaaacattacattgtaactcacgaatatgtacatttattatttgtcaattaaaaagtaaaaggcctggtgttgtggctcactcttttaatcccagtgctttgggaggctgaggcaggagactgcttgaggcgatgaatttgagaccagcctgggtgacatagcaaggcctcatttctagaaaaaaattaaaaaaaaaaaatagggtgtggtggcatgcacctgtagtgctagctgctcaagaggctgaggcaaaaggatggcttgagcctaggagtttgaggctgtagtgagccatgatcatgccacagcaatccagcatgggcaacagagccttacaacctttaaataaataaataaataaataaataaataaataaataaataaataagaaaagaaaagaaagtatgggctgtatgtggtggctggctcttgtaatcccagtattttgggaagctggggtgggaggatcacttgaggccaggagtttgagacctgcctgggcaacatggggagactccaactctaaaaaataggaaaattagccaggtgttgtggcacgcacccatagtcccagcaactagagaggcagaggtgggcgggttgcttaagcccagaaggtccaggttgtagtgagccatgattgcattagcgcactccagcctgggtgaaagagtgaggctctgaccaatagtaataatgataataataataataatgataaataaaagtatgctcctcagcctagctactttggagaagttttgtagtgaggacggtgcagcaatttgggagaaataactaagagaaaaagaacataagtagaaacaaaaagtatggagagaaaatacagaaagtacagtcatttccgctcatgttttcagcacttgtttaaaaacatgaatttgtttcaacatgatagatatattataaaacaatttcaatgtaatgcaaatttttttaatatgcaattttgttcctgagaagcactggctaaatacagaaaaccacacctggctgaaacaagccacataggaacacataaaatgcacacatgcccattcctcaaatatctaaaactgacctcaatgccccttgtatgtcataaatttgcccatcgacacctgtgttacaactttctgatttcagatacctttccttctaccacttcacaagaaatgaaagcctttaagtcttctaacacttctacaagcaaacttcagctctttctcggggaaaaaaaaatacttatcactgtatttgtgctatctccaactatttaacaggtgtaaaattgtgctaccatttttattagcttttttacttttattttaatgtgacactgataaagtttttagtgttgtgccataaacttcattacccccttaagccctgtgatttttattgcacaatattgcatagttcatgatatttaggaatgcaaatgacacatagagtagaatggactatagaagaatgagaagaacagaaagcatcatgaaagcagtgagaaagataaaacacagagaaaggaaatgcaggcaaatggcaagaagtactgtaagtccaataacctaaacaatgtgagagtgtggagaaatagctgagagaatcaaaattaaaagagcagagaaagatagagacaattgcctttttaaagttgactagaggaatttctcaatgtgagaaggtagaagttctaataaatcttatggtggtctagttacttgtagactttatacaggatttgaagatatttaaaattatggcaaaacccctctaaaatcagttatcatacctcagttatctcaaatttggaaataactgactggcaattggttccacccatcttccctaatccagatcttgggtgctgcctaatgattataaactggcctttctgagttcagtgtacagatagttgtgtactgtagaagttcacaattccctccctctaagagcaattcccagagaaatgttcagctctgatccttcaaccagcaacatttccagcagaaaggggaatacagactctaaagggaaatgtgattaatgaactgcagtatgcactccaacattcccacatattcgtagcagcacttaccccttttattaaatagaatttggcacccaaaatacaggagttctatgttcagatatggaatgatatcttcaaagaattaggtctgtagattcaacttgtatcttaagagacaatttagtaaccaacagggattccttggaaataacgtttacatactataaataaaagtacaatgcaatcatgctaaataattaaattcaaacacacttcttaaaaatagaagaaactattgtactcttggggtaaacaaatataacttgatatgcttgtacaatgaaaacaaacatattactgatctctccaatacaatgaatgaatcacaaaaacattaagctgagaaatagaaagtagatacaaaagagtacataatgtgtgattcaatttatttgaaattctagaaaagatcatcctaatctatcatggcaggaaaacagattggttgttgcctgggctgggagttggaatgggggaggtggggttgacttcaagggggcatgagagcacttctaaggtttatggggatgttctttatcttgatttgggtgtttacggaggcacatatatttatcaaaattgacagaattgtgcacttaaattgtatgttacttgtacattaatacatttgcttaaaagcctataaaaaccttgaaaaacaaatttttattttgaaaaatgtttcatagaattgaaaaatcatatttaagattctagagctctgaagaattttggagaaactgagactcaggtaatcacatagaggtgatctgaattaaaatgcagaacttttattcccagttcagttaatttacgctttaccacattgcctctaatcagaacatataaatcaacaggataaaattatatatgacgcatggtataggcatgtaccaagcaggtaccaagcatccacacaccattatatatatatatatcactcacacaccccaagccccagacaaccactaactactttctgtcacacagattcgctgttctggacttttcacagaagtggagccgctgaacatgtgttctttcgtgactagttttatgcactgagcatgatgtttttgaattttattcaatattttatatatatatatatatatacacacacacatatatgtattcagtggagtttatatatatacacatatattatatatatataatattgataaatatttatttggtgcaaatgaacgatatttattttctaatttgaaaaatgtttgttccaattctgtgcacctgcgctccattaaaatcttgttaatgcacttaacaagaaaattgcatacttttaaatgggctcaaggtaagagaaatttaactaactatagatagtaatcaggcaattaaaataaaacgcttttaaaatgttaactttttaaattccattaagcagtaaatgttcactgcatagtctttatgctactgtgttgggattacccatgaggagattttaaaactctcaatttttattccatagtgtttatgaaacttgcatttgcagaaaatatataatcttttatttgttctcattaccttaaatagattgtatcgtgagcttactgtgtgtcttaataatatcagaataaaaagtcatattaaaactgtgatttatatcttagaaaaagatcttgtttttgttccaaaccattgttaacttgacttacctttaaaataaattgtggcactttaatttaaatgacaaatggctgtattaaaagtcagtacttattttaagcagctctactgggatataatttacacgccataaaacgcaccctttaaacataaaaagttcagtggagtttagtatacttacagagttgcgcaactatcaacattagttaatctcacattttttcacccttagtggaaatcttataattattagcaatcactgacacacccccagccccagacaaccactaactactttctgtcatacagattcgcagttctggacttttcacagaagtggagttgctgaacatgtgttctttcgtgactagttttatgcactgagcatgatgtttttgaatttcgttcaagtaccgtagcatgttatccacacctcatttctacattgatgaatagtattccatcatggggatatattacatgttatttatatattcatcagttgagggacattaacgttgtgtccaccttttggctactataaataactgccgtgaacttttgtgtataagtctttatacggacaaatgttttcagttctcttggatcgattcctagagtagaattgatggaccatatgacaattctatctttaacatgttgaggaaatgttttccaaagtggttgcaccattgtacattcctaccagcaatgtatgagagttctaattttccacatcttcaccaaaacttattattgtctatctttttatttcagctattctagtgggtgcaaagtgatatttccttatggtttggatttgcatttcctaataactgatgaagttggacatcttttcatgtacttattgttcatttgtatatcttatttggagaaatgtctatttaaattatttgccttcatattaattgatttacatgtatttttattgttgatttacatgaattttttacatatattttgattcaagtattttatgaaacatatggcttgaaaatagcttttctctattctgtagaccatcttttcactttctttcatgatagtattctttgaatttcaaatgtttttaattttaagaagttccagtttatcatttttttttctttgtggcttgggctcacggtgtcatttctaaaaaatcaatccccaacagaaggtcataaagattttcaattttttaaagcagtacaagtatatatttgaaattattaatgatcaaatacaatggtgtctcatatgttaaattttaaaatatatatttatatttactcattcatcaatatttattaatcacctactttggtgtcaagtggaagataataagttttagaatgttttaaaaggtgataatacttttctgacatcaaggcaattctatcaagcaaagaagtaatacacaaataggcaaggatatgcattgcaataaagtattatcataaagttttattttgcttcatatttatgtgtgggagcagaaagcagagaatatctttgtgatatcctttgagttgggtcttcaaagatgagttattatatttcaagtaaaggaaaggaggggagtacttattctaggagcagaaaataacatgagcaaagggagggggatatccctgaagaataattgtaagtcgtcctgtatgcagagcagaaaacatgtgctataaggaaatggtaaaatatgagacttgacagggaaggccagcatagattacgatggcctttgtttttccatactgaatagaataaactttgggtaccagatagaatgacaaggagccatcaaagttgtttgaacagggaagtaacatgtaaaactgtgcaagtaaactgttactctgtcatcacaaacccggtaattcagataaagccattcctatctgtaatggataatttttgcttgtttgttcaatatcctcacagctagggttgccagatgaaatataggatgtacagttagatttgaattttcaataaacaatgaaaaacttgagtgtaatgatgtcacatgcagtatttgggtcaagcttatactaggggaattgataatgaaaagaaagcattgagctaaaccctgcaatacaagcataaatcatgcagttttctggcagaggaaacagaaagatcaaagacaaagtgacacaagtgggtttaggattttcaaggagaccattgtagctagaatggactggactaaataaagcaagagggtgggagtggatatagatggaaatatgatgtgtgttcttgagatcattttaagactggcttttgctcaaggtgatatgaaaactataggaaggtgttgagcagaggagtgacatgatttcacttacattttcgatggattcctcagtcctcttataaaagacaggacaaaaaaaggaatttaagaaaatgaattaagaggtgaaaaattacgttggcttagaccagggtaataggactaaaggttataaaaggggtcatattctttgaatggattgaatatgatatgggacaaaaagcatagactcaaggatgactgcaagatttgtagtcttcgattagaaagatggagttgctattttttgagaagagaaaatctgtaggagaagcagatttgtggttaggatggggcaaaatcctggactgggttttgaaaacaatgtttgaaatgactaattagatgtcaaaataaaggtgtcaggcaagctattgtataagcccacagtaaagaatagtgaatatatggatgttttctgcaagcagctataacattggatgagatcacctgtggagtgaagtagggggtcgtcaaagatgactaataacgtctttgtagaactctcttcaattgttactttatcagaaaggcctttcacccctgccatattatatatttacaaaatatgtttgttgtctttctcacctaccaaaatatatattcctaaaatttttatctctattaaaagtttaaatcttaacttatatattattgtacattcaactgcaatacaattttcacacttggctgtcaaacagactttccaaactcaatatgtttaaaatctgtgttcagaacgtgcttctcccccaaatatgttttgctttaattcatccccaactcaattagtgagaacttcactttttcactttctccaaaaacggtggagtcatccttgagttctctctttttctcccatcttttatacaatctatgagaaaaacttgttggctttcttttcacaaaatatgtgaatgtgacccactgtcatgacctccaccattgtcacccttgtctgggtcatctactctcctttgaattactgtaacaatcttgtaactggttctttttttctaaccttgtttcttattttcattcttatagcagtcagactgattcatggtgatcctgttacattgcagttaagtgaatattcccatgataaatgttaataattatcagaaatataaaaaatagctaggtcccacattacagcatgaaataaacatgttaatgattgatagagaaaaacattcatctgtgaaattcttactctgtatagtttgaagagatgagaagtgtgtatattgagtttattttgtgtatattgagtttatttttttctttagagaaagtcatcaaattgaaagctttcaaatgttttgttgctattgttgttcatctataaaataaagaatcaacactagagtggatctttcttcctggatgaattaccaagtagtccttttagatgtgtaaatataagtcaagtaggctcccacatcccaaggaagaatatttaatagaaccctgacaaaaagtgtctcctctactgtgtcttgatattaagagagtggaggaggaagatatttgacataaaccaggaaacttcaggaaggagaggaaaaaacagattgctcccctttcaattgtgaagttcaatgtttttcttaattctctggtagactgacaattgactagatcacaaggagtaccaagagtccacaaagagaacttaccatgagggaagtaagagtatgaatttgaactatggtccaacacccagtggtggttctggcatggaatctgaaagaccttcctggctcagtcatcttgatgaatttgggaacatgagtatgaacctaaacttcaactggtaaaacttggagaatggaaaattcttcctgaagaatcactttggtagaggttgtcactactgctggtggaactagtttggaaaaactaggccatttattggcataagatggtttaatttggcctgtatgacagtgggttattgcagtggtgcatggatggtgttggattttgagggaacacttgtttcaaaagtgatactttgagggctaaaaatatgcaatagcagttttttaaaaatttactcacttgttactttatcacattttccagttatcttttcatgaattgtaaacaaacaaaaaacaaaaacaaacaatcaaacaaaaaaattcctttttggtctgatcaagttttgaaagtttttagataacttaggcagaacaacattggccccaagaggctggtaccagacttactgttacttggattacttgggctcttatatattttagatagtcaaaaaagagctcaacttgcctgtatccaggtcacaaaaattatgtatgtaaaggattaatggtaggcatagaaataatgaacactaatcaagtacaacagagtttaatttattttctatttttaaaaatttcacttctgtcagagaatcatgcatacaaaaaaaaaatcaagttgtttatccctaggaaaagaaaaacagttccaaaagaatatgtgccatcattctcagcaaactaacacaggaacaaaaaaccaaacaccgcatgttctcagttataagtggaagttgaacaacgagaacacatggacacagggaggggaacatcacacactggggcctgtcagggtgttgggggcaaggggagggagagcattaggacaaatacctaatgcatgtggggcttaaaacctagagacaggttgataggtgcagcaaaccaccatggcacatgtatatctatgtaacaaacctgcatattctgcatgtgtcccagaagttaaaaaaaaaaaaaaactgtccatgaaatccactacttttgaaagatgagtatattgtattctgaaaatacttcttagcaaacttgtaaatgaaattccaaacctgataaaagctatctaccagttactatgataagcatcacattaatgaatagcattattattaaagtctatacttttacaagctttatatgtcttggacaataacaataaatgaaaactgaaaaggaagagaagagaaaagtaaatcctcccaatctgtgtaattacttagaaaataccaagagtatagcaaactcttagaactaatagttttgcaagtttgctgtaatccatatcaatattggaaaatcaatagcatctttatatgccagtattaatttattaggaaaaacatataaaggagataacaatcacagtaactataaatgcctagaaataaatctaatcatatataagatctctatgggaaaaattaaacaattttattgaagaacataaaataatacacaaatgaatggagacataagccatatgtacacatggtaaaacagtatacaatagaggcaataacttcccgaagttaatttattaatttaagcaattgcagtaaaaatcttgttggggcacagaaaacgattcccccaaatatgactttggcttgttgagcgctttgaaaattgaaaggcctcagaaataatccttagaaccaagatctgtctctgaccttcctctcctccctttctctctctctctctctggaatttccttatctgactgaaaacacttctttccacaaggaatgtaattgtctcaagattcccctcttcaggaatcctgtcagattaaccactagagaagagcagaaattgggagtcgtcatgccaagacagatttataatctgttcttcagaggacagctcccagagattacccaggggacttaatctgcaataataaagcaatatttattcctgcacagtctttccccttactttcctttaatttgtcagtcccacccagcttccaaaaagaatcatttgcaaaatgtctgcctcctgaatccatacatatctcctatgtcgagaatatttaagcatcagccctctggcccctcttccagtctaatacattgtaaatggcagttatatccatatgcgtgttaaaataagttttgtgtgccttttttcacattaatctgccttccctcaattcattttcagcaaacctttagagggtggaagaaaattttctccttggcccctacaatctcaacagagttgaaaaatggaatttgaaaagttgatattataattaagctctaagaatcaagatttataaagttaatcattaaaacagtgtgatatttatttcttattcttgaacacgtatttattaagtgttcatcatgttctaggaactattctaggtacctgagcttcatcaggaataaaacaaggatcctaacttttatggaggttattatctaactgggctggcagacaatacattacagacattataaataagtaaagcatataaacacatgctgtgctataatacattactatgttagaatatgttatgacatttgaacaaagactggatggaagtggggaagttagccatgtatctggaggaaaggcaattcagacaaaggaaagaggaaatcaaaagtcaacaggaggccagtgtggctggggtggatttggatgtgaagtcagaagataaagacagtgagatttatgtagagccttgtgtaagtggaaagaagttgcagagttttgagcagacgattgatgtgttcagatatatggtttaaaacatcactcttgtatcaaaatatcacatgcaccatataaatatgcataattagaatatatccatagacatttttttaaaaatgaaaatgaacagattactctgattcatgctgttttaaaaatagactggagatggcccatgggagaagcagagagacctcataaaaagtgattgattacaataattcagctgagagatgacagtggttcaaaacagagtgatcaatggaagtggtaggattctggatatattttgaaggtagagtaaatcaaatttctttatagttggatgggaggtgtgagacatagggaggatgtgagagtaattccaaattctttagcttgagcaactggaaaggcaaagttttcatcatgtaaactggagatgatggatcaaattttttaaggggggatatcaaatacgtaagcttttgatattttaaatgtgcaaagtcttttagatatacaagtggagatgttcgattgtggctggatatatgcatttggttgtagggtctgaactagaggtaaagattcataaattattagtatatgaataggatgagattgattggaatcatggagagagtgtaggtagagaacatgtggagggctgagccctggggtgaagaaagaaagagaagaagagaagaaactgggagttgtcatgccaagacagacttatcatctgttcttcagagagcagatgctccaacattcagaagtcagagggaggaaaatagatggagatgtagccactggtaagtaagaggaaaacaatgtagtttcctgtaatgcaagtgaagaagtatatgaaggaagaaaactattaactatgtcatatactgctgagacatcaactatagcaaggcctgagaattggccttatatttagcactataaatttagtgatgactgtagcaggagtggcttctgtgctatggtggggcaaaaccttattgaaataggtttataagggattttaaaatgtggggccaaaagataattttttttaagttagggaaactttgtatattataagaatacagtcgaccaggggtgcccacgttccaagccatggacatgtactggtctgtggcctgtttgggaccagacttctcagtaggaggtaaaggtgtgagcaaagcttgatctgtatttacaaccactccctatcacttgcattaccgtctgagctctactttctgtaagatcagcggcagcattagattcacaaagtagtgtgaaccctattgtgaactgtccattcgagggatctaggttgtgcactccttatgagaatctaatgcctgactatctgtcactgtcagacaggaccatctagttgcaggaaaacaagctcagagctcccactgattctacattatggtgagttgtataattatttcattatatatttcaatgtaataatttaaataaagtgcaaaataaatgtaatgtgcttgaatcatcctgaaaccatccccaaccacacccccagttggtggaaaaattgtcttccacaaaactggttcctgttgccaaaaactttggggaccattggagtagacaaagaaaagaaaatgatggcaaaggaaagagcagtaaaatttgctggggaaatatacttgattaaatgtttgctgaagacattacacatggtgtaacaaagttttctttgactaggcttttttgaaatttttgtaagcctcatgctcagtctaataaactcttccatcctcttagaaacatggacaggtttaagactttgcttaaagtaaataatcttatattttgaaatctataaaatcaggtagtttttatgctgccttttccctccatagttcacatttattctttacttacttgttacctgtttatctccaatccccctgttcatgagctacattactttgagccattgatccttgctctgcaaacctcacagggttgttgttacagagatcaaataaaacaactcacataaaggactttatgctggttacttatctcattcttaaagacccgtagccgctttgttaatgaggtttccagacaagtttgaaaaacaatttggctaactttaaaggttaagcaccagcattccttaattccatattaaggcatgtcctgttgaattctcattctgggatactcttatttccctgtgggtaaagagcgtctctggaaacactacatactgtgtttctttcttgacgctcgacaatactaagagttaaaatataaatactgtagtacttacaccagttaaaaattgtacacaacaatatttcctaatctgcttctcctgggaatttcatttgttgggtgagtgggtcctatcaaacacccactaaatttctggggagcttgtgtttcatgagaaatgatgaaatagataaattctaccaaagtgaaaaaatacaattagatcaactgaggaacttctgaatgaaaaacttaaaaattctcctagccttgcttaacagatcgcacaaaacaaaacagaggaaaaagaacttattcttgtgtacatcaccaaaagacaacagattccttggcacaaaatgaaccctccaattatgttaataagataaaggtaactgaacaaatttccagtcagtcagtcttttaaagtctttggaaatatccttcttcacaaaaaaaaaaaaaaaaaaaaaaaaaaaattctgagtacctcaaatcctggctaatacaaatgatacttcttactgaagacagcagagtggatttcacttcatctttccatctaacaaggtcttagttaacacacaataacccagtcactgcacccagagcgatttgttttgaacctaatgagtttccacacagcattagaagacttttatttttgccattgcatatagaagattccagacctttcgttatgtgcttcctcgccaactcagcttctagaaaattgatacaacttcatgtatatatggataagccatggaagatcctaaccttactcttttggtcccttttctagccaatcattgaacctctgggccagtccagcccatgtatatctttagacctgctctttccaagttggcaaattcataaactccattcagtttggtgtttcactgcttgacaattcaattgaagaataaaggagaaacattcaagtcgttatgttttgtaaggaattagaatacaatatatggaatcaatacacagaagaaaatattctgtgagtgcaatccatttgtaaataagcccaattatatttttgagagagggaatcaataatgcataaaatgagctacagttgacaagactgaatctttgaaagaatggttgttggccgtagttaacatgtattgatgaacacaaaaaaatgaacaaaatatagtcaatatattgaagacatgcctgtggatgatgacttttagtcagaacttagtgagaatgattaaaagaatggcatttgtgataaatgatgtttattagtattttaaaataggatgagatattgataagccaaacttttaactggacagctgacaggtttgcatgagagtgtgcaaatcttcacactatgatatctcaatatttcacaatagcatgatggaatgaaatactttgtctccactgaggatcacattgcttgtagagctatgttggcttgttctaagtacctatttttgtcattggttgttcattctaaaacagcattgtattgctaaaagtccacaaaacccttaattttgataaaggcacatcccgtattccatttttatcactttggctcaatattcttcatgaacagtagttctataataaaaatactagacaattatttattaaatttaccgatctgaggattattcttgccactgattcttcattttgctttatgtacttttttgtccataattcttctatctgacaagaactaaagaactgaaaacatgcaaacaaaaatctatttctgattttacatttattcagctttcacatttccatattactgttgcttaaattgttatgttgcatttttagagaacagtcacgaataaatgtcagattcaaagaggagagaagaataagagcaacaacttaaaaaaggaagctttaacttagttcacttagtaattaagctcaaagtgggaatgataagcaaacaggcctgggaggcgagaagaggccagccagcttgggaagaacctcatgtgacatgccgaggatgtgcctcatttgttgtatggtcattgaaggatcagtcaactccactcttcgatctatgaagaactagtgtctcagtcactaatacatgacacgtataaaaattcactgcatatagttaagtgtgactactgttttgtgaaagtttttcatattgttgactcctggtactttttcaggcatcagttcaaatcccaccatcttaaaaagatcccttctttaatgtcttcaccactcaccttgtacgggtcccttgatcatatctatgcccttttacactgtgtatatttgtttattgcctgtaccctcaactgtcttatcatcattatattcctaccacctagaatagggcccatttcttagcacctttaataaggttgccactaaatatttatttgattgaaaacacaggattaataaatagaataagcatttattgcttctatacaatatgcctaagatgatgtaattcattgaatatagtgtttctattcttataactctgtaagttggcaagactattttatctgaaactcagagtcagcggtgttaagggtaaggttcatacagctggtagctggcagagacaggaacttcaaacaaatcgctattccacattgcctctctgacacccctcaatgaggattaattaaccttgtttttaaactctaatattatttttgataccacaatatttatcatgttttatgatattaatttgggcatgtttatttctcactgtagattcttatcaaatttattacagactatatcttctgaatctctaacatatctaatattctactgattcacatcagttagcaaatacttgcagctgaaaaaataattagaagtacagattatacaagtaatgagcattattataaactttacaagagtagcatgtttactttttaaaattcaccaattaacttccatctagaaagaaataggaaaaagttattagagcctggttctgaaaaggtggaatttagtgttatgaaaatttgtattatccttgaatatttatattcttctcaatcagttaaatttaagaccacacagaaatatttaaattcgtttcagttaagtgtattttttctttttattttttcttttaaaaaggctgataataattaccagagttttccatgaataataaggcctatttcagattgtgcttttgtgaggctatttttgtcaactattttgtcaacagagttctcaatccaccgacacaaaacatcttctttgggctaatcacccaccctgactgtgtaacttaagcaaattaactgccctaaacaaagggtaatccttccaactaggatttagaagtcactttcttagttctatcagtatctaataatagttttacatttttgtcctgatcaaccacttttcaatttacacactaacactacagtcatcgttgataatctgccaaaataataatttcttttcttttgtttgaatatacctttttaaaagttctcaataaaaaaaaaataagtattaggctttaaattacaatcctttgacaacttgttttatggcattaatataccttgaataatcatgtcatggaggatgattttgataagaaaaatgctctataatattatatgtgtgtaacttgggagtatttatataaggacaatgaaaataataatcaggatactgttttatgttttatcaagaaatgtcaggtaaaaaaatgtggtatagctgagcacggtggctcacacctgtaattccagcactttgggaggccgaggtgggcagattgcttgagctcaggagttcaagaccagcctggtcaacatgatgaaactctgtctctacaaaaattaccaaaattagccaggcagggtggctcacgccagtaatgttagctacttggaacattgagatgggaggattgcttgagcccaggagaaggaggttgcagtgagccaagttcatgccactgcactacagcctggactgtctcaaaaatatgtaaataaaaataaatttaaaaatgtggcataaataaaacttcttattacaacactttattggaacatcctgagaaatcaatcacaggattaatataaattgaaacatgtttacatatttttaaatttagactaaatatatatgatacattatacacattttaggtttacaccaaaggatatgggcatgatattatgcatgataataatatataattattctaaagcatttagaaatcactgttttagaaattcaaggaagctgaaaaaagcaaatgaataccagtaatcataatgtttaaaaacctttagttacaccaacacaagaagtgaatgacttagcattggcacacaatttcttttctccactggctgaaatgccttcactaagaactggaagtcaaaaaaagttaaagacaattgctttgggtcaccaatgtctcaaaatcctccatatgtgcacttatatctgtgaagaccaatagagacaaatatcaattatgcataaatcctcatcctaattctgtaaccagttcccgaaaaataatctgtcataaactgtcttacattctctaatgtctgcatattcaaatatttagtggttatattgttagagtaggtagttaggcaaccaataggtgatggtcaggtggttgttaaactctctctgtaaaacaattattggttgctgccagtgccagggaagacagactgtaataaatagaaaacattgaatctggtgatcagcagtttccagataagatctcaggagttgggcaagtggactcaagcatgtgcactgagaagcaaaatggcagcatttaactggtataggaatagaacattcctctaggaacactcaactggtaagggaaaaatgcctccagtaagcatgtataggacttcagtaaacatgctgtgcatgcggcccctcccaagtgctgacaggccaccgtgcatgcagacagcccaccccaaaggaagaatcagggcagaagtaccacaactccagaagcatgccagtgtataaaaccccaattcagaggtcaaattgcacacttgaatctctcaagttgcccatttggcccttttccagctgtactttatctcctcttgttcctgctctaaaactttcctgccctgaaacttgccttggtctctccctttgcctcatgccccacagtcaatttctttcttctgagaaaacaagaattgaggttgctgcagacctgtatggatttgctgctgctaacagtaccttgatgaaaaaatatttgaaaaaaatatatatgtatgagcattccctgccctcctcctccataagaagaacacttcaagtatgaaataacctgttaggggataaaaaaaatctgaagttgttcatgtctgagaaaggtatatttcttcatttctggagtagattagcataaatacagcattattatagaaaacaataatttgtagccttttatgaaaaagactagatgaccataaaatccattttttataaccagccaattgtgattctataattctctgaggagaggtatactactaatgacataattaaaatgaaagagcaatatcaaattacatgttggtttcctaaactgagtgctgagtgaaaatgccttattaaagagcttggtggtgtatctactgaagcagtatcagtttatttagttgaaggaaagataaataatgttattctaatctcagataaagctaatgaaatacgtcaaattgtagtttatgttttatatttagcttaagatttctataaaatacatggataaaggctaaattcgtggtcttatgtgaagatctgttcatttgtcagccaccagaattgaagcttctttccggaaattcatctgatttacttactttattttgcttttctacttgaaggaagaaacataagaagtccctctattttttctaaccacataagtgaggaaatgctaaacttaatttatagtaagaattctagtgctatttattgtattgtccagtcacttgcttcttaatcgctaggttttagaaactcttgacattttcaattacagcaatttagctagctgattcatgtggtcttcatttaggagcttaagaatccaaagatataacttgttacaggcaaatgattctcctgagtttccaacacaggatgtgtgaatgcctccatgtaattttcatctgattctagacctaccaataacttaccttcttcctcttctgttggaaagaggtggtccagcacagacaccttttgtcttttgctagtggagcaacagagcgctagtttcctttgtgtgggactaaacttcacccaaaaggagaatcattccattataaaaaatgtaaaagtcccatgacttcacatttcattttatgttatctctcattaacaagagtactgctgaggcctcaaacaatgcaagaaaaatactaatcaaataaaagattaccaacaattttcgcagtcataaacaacaaataagttaccaattgtatattatatcacttacaattcaaaagtgttgttttgcacttaaaatagtcctgcctatatatgtacatatatatacatatgccatatatacacacaatgtgtatatatgtactttaaattatattctttatacatattataaattcaattctatataatttaaatacttttaagaaaatcaattaagagcaggtaaaaaatttgaatatgtgtatatgcatacacacaacatatacacatatgtattatatttaagagaatcaaaataagaacaaatattagaaaggaaataaccataaaccttgaacctttgaccaaagaatcaacaaatactaaaaaaatgttcattatgtggtttttatatttcctgtcaaatgatataagaagtaaacatttccatgtaagagcatgtggggtgtgtcataccttctcatggactttctgtccaggttccatcccttcaagatgttctgactctgtggatccctcgcttgatgccatttttctttgtatatgaacattttgttcacgcaaggcaacaatctgcaaaataaaagcactatgcctttaaagtctaaatagggaataaaatataaaaagaaaatgaatttacttcaatgtggttaagaactaatgaacactaacaaataaccagaaagtgaacattacattttactgaattattattcaaaatatgtgtttcaatgtaggtcaccattttgaacaatatttacaaaaattcataatatctctactaagaagaggttaaagcactgtaaaatttacctaagaaaatattttcttgttggaaatgtatctaaaatcaatgatatatttgtattcacgtgatgttaattcagaaattattttttaaattaatttgtaggatgtaataaaaatgtttttttggtctgtatttttaaagtatacaagaaacataaaagattgaaggttaaagactaattatgagcacagcaatttcgcctacactgatagcccatctgcaatttaatataagcagacacacagctgaacttaaaaaaaaatttgtaatgctgtcatgagcatgtattaaatttgttttattattataattttaatgtccattattttaccaaatttagttaatttgcaaacacaaattaagaaagcagttattcttgcaaactttcagctcaattttaatgacataattatttcaattaaaaaacaaattctcgggtacttatagcataagtgatcctagtaatagagtgaaaaatagtatttcagtctttttaaaatgatgttttaaaatacatttgctaaatatatatatatatatcactttgaaaatattttacattatattaatgctgtaacttatttattccatggcatattttattgtattatcaactcagatagtagtcaatattagttctgggagaaataaaggtacatagtatttagtgcacaataagatctgaataatattaaacttacatgtggaaattacaagaccaacatgtcacaagacgaataatcattaactgaaaaaaacatgatatcaaggggttgggtgtttgccctgctacttgacactatttcaatgccatattaccaccatgtgtccatgacatcagttgatctagctatatgatctctggtatttgagcatttggtatatccttctctaggtatatgttcttttctctcgtataactgtaaacaccaaataattggctccctcacgcttactcttgttcatctacaatctattatccacaaagcagccaggtacatctttcaaacttaaattagattgtgtaacccttcagctttctaacaaaactaatgtttggcccagcgcggcagctcacgcctgtaatctcggcactttgggaggccaaggtggccagatcacttgaggtcaggagttcatgaccaccctggccaactggtgaaacctgtctctactaaaaatataaaaattagccgggcgtgatggtgggcgcctgtaatcccagctactcaggaggctgagccaggagaatcccttgaacctgggaggcggagattgcagtgagctgagattgcgcgactgcactccagcctgggcgacagagggagactctgtcttaaaataaaataaaataaaataaaataaaataaaataaaataaaatactttaaaattttgttaaaaaaacctaaagttttcccagcttatttagccaaaatttaaacttcttaacaaggtctatactgtcctacttgagccctttgcttcagcgacactggcctcctttccatccctcaaacatatctgtctctttcttacacagaactgaggaatttgatgatcttcctgtctaaaacattcttcctcagctatcacaggggacacaatcccagctttaaaaacagttgagatacaactcctcagagtgaatgtgtgttgtcatcaaacactttgtacaatatatccctatttatttttgtgcatgtagcactcaataaagtttattattccatttctccacttcctcatttgcttatttatttagctagcacaagtcctaataatatctcctgagaaaataattttcaaaagaatgcttcattgaaaacagcattttcatatgaagtagcacatcaaattattatgtgcagggtattcactaaaaatgtgttgaattaaataatacatggatatgggaaaacaaagaatctaaacctgattaattcaaaaaataacaaaagataaagatttggagtgtaaaaaaaacttcagaaacattcttttcacattagtcaacatggaaatagattacatcaaaggaatgacaagaagaataaaatagctcctagatatatcatttttatattacactcttaacttattgctttttgcataaatattacaattgatacatgagattttatgaattataaattttaaaatattcaagtatcatttgttgacattccactaagaaaacatctatgactaacagaaatgctaatacaaagtaccaggccatttaaaaattatatgctttgttctattattaatctactcagaagtgaagggagacatttaaaaaatatttaaagaacaaatttaactctcagcttacagattagcttacatttgtttaataaacagatgactttcaaatatgtcctggtgcctgaaataaagcaggccatctataaaagtttattgaatgaatcagtgaaaagatgaattaatgtccctattaaaaaataatcaaaaaatcaaattcattcagaaaaaagtacaaatataattgagccactatgatttttaaaattctaaacttcaagtttgctacagtgtatacatgacaattagttccaaaaatgacataattttcaaccactaacatgcaaactttgttttgtaaaaatgaatcaaggctaaaaatgttggctcttgatacagaagaacaaatgtgacatattctatattctctaccactgtaatatgctattttctccaataacaaattatcctgggtagttatgaaaccaaagtttcagcacctgatttaattgtgggtgttaataagtggattatttttgacactggggaaagggggaaagtttgtagttctcttttaaaaattcccctttgggtgttaagcattttcttcaatctgttttaaagagtgaagaggtcaccaataaataactggagcctaaggtagcacagacttctttaggaaattctcttagctggtttgagaagtgaacacaagagatggctagggaaccagcttgggacaataaatagaatgaaaagaagctaatggcctcaaaatattccctaggctctcactgagagggaatgttgtcagaaggagggcccaagcaaattgcctacaagaaaactaacgtaggtctggatgcctcaccactaaacaacatggcctacttgctatggtttaaatgttccctccaaaacttatgttgaaatgtaattgcctttgtaatggtattaagaggtgggacctttaacaggtttttacggcatgagggctttgctctcataaatggattaaggctgttatctctggagtgggttatttatcattggagtgggttctggataaaaggatggagtttgcccctcatcctctctctgtatcatctcacatgcttttatgcccttccatccctctactatgggataaggcatcataaaaactcatgccagatgccagtgtcatgccttggacttcccagcctccagaactttcagaaataaatttattttctttaaaaatcatccagtctgtgatattctgttatagcaacacaaaacagactaagacactactccaaatatgattacatgttgagtaggaggaaccacttatgtacaagtcctgttgtttacccagttcttatataactgtactgaaaaactcactatgtacaagtactgtgctaaactatttttatctgctaagggggtatgattcatatttaacaaatgatcagattaagataaagaaagattaatggggacaactgctatggtttgaatatatgccctcctccaacccccaacatttgtatgttgaaacctagggctcaatgtgatagttttgagaggtaaggtctttaggagacgataaatggaattagtaccaatataaaaggcctcaagggtactagctaattaagccttttgccagccaccttctgccatgtgaggacgcattgttcagggtgccataatggaagtagaaggcagtccttccaaatctgctgatgccttgatgttggactttcctgtctccacaactgtgatacatatacttctattgtttataaattatgcagtctcagacattttgtcacagcagcacaaatggactaagaagtaagagtcaaataaaacttaactccgtatccttatacttcctaatttgtaacattggctcaaatggctccccttttaaatttggggtctactaaatcagaagttaatagcgggctgggataggaagcataatcattttatttccaagggctgatacccttgctggaatcctttgtatgtcattaagattggacgtctccctggacagattcatatggaggcaaagttttgcatatattttcagtgagttagcaacccactgaaggctcatggaactctgttcaagataaatatttcacaactgtttttaatgttcaatcatcatttatcaagtgtctgttgacatttgctttcaggtatcccttcacatttctttgataataacatcttatattttcactggagacttttcctttcttattctaatcccacagagactgtcaatgaaggaaccaagagcccatggcaaatgggtgggcacatgacccaagccagggaaatcagaatattattactttacatgtttctggctgagctatgggaaacgattctctctatctactaaggaaggtaagctggtagaatatgaaaggggtactctttgccattaattcctattcatgcagaaaacacatggaagagatgaggccctaacaaattgcttctggtcctgattctaggcatccttaaatcattcctacccttggcattttagtaatatgatccaagccccaaatttccccttttgtgccccaactcatttgaaatggttttctgtcacttgcaactaaaagtgacttgcaaatgcagcaggaaacatggaagacaatacagagtatgcaatacctaagtgaggattttggagaatggctaagaatttaccagacagacatggtagaagacttttttaggtgtgtagaagatcacaggcattttgtgtttctacaactttgtgttcctcgcactgtaagttgtttaatattcctgtggcaaaaagtacctggaaaaagttggaggaatgatgggactagcaaagctaaagtgcttcaactaaatctcaggcatctgtgtgctttttctctctggcttattgctttgtcttgatccttatttgtgttttctggttgctcataagcttataacagcctgatccattccttctaggcactctcaaacacgttatattttcaagccaatcttctaggtttcattcatatccttgcctctgtcaggttgattttggctctgacaagctctgaccctacacaatagacaactggtagtcttggcggctgggcctccagtctgcaaaattctttagccttcatttttcttttctaccagcttgaacactactatgtcttgcaacagactctcttctagctccttgcctgtgaacaactgtttttctttgatatcctggagagattcatttatctcaaaaatattcattcagcactgatgacataccaggcgttagggaaacacaatgggaggaaaaggcagaaatccttcctaatggaaattgtactctcattggggaaaataagttataaacaaacataagtagagcatatttttaaatggtgttaacagaaaagagaaaatcaaaccaagtgaggaatgctgtgaggtataatttgattacaaattaggtgatttctgagtatgggcttgaggacaagagggaacagcaatgtggatatctgggagaataactttctagaaaatgtaaataactattgaaaacaaatattgagatttataacaatatttcagggagttctttcaatgatgtaaaatgtcctccctaaaagagaggtaaaacatcagtgcaagttgatgccttggagacttaaggaaacatattatcatgaaaaaaatgatttgggcaaaaataacaaagaccattaaatatctttttatgctaaaattttaggatttcttgagggtttaataaatattaatacatttattcaacaaatattcatttgatcactgttctaagtatcacaaaatactgggaaaaatgcagacagtttccttctcttgtgtagattacattctagttaaggaggcaaaaaaaaaaaaaaaaaaaggaagcagtaggactacaataacaaaatagcaattatttatttagctcttataatgtgccagaaactgtgctaagtacattatataaatttgcttcttttcataaactttgcatctacattatcttttctttccaggtttgagatttcttggtaaaagaccctgagactattatatttaatggcaacaaccacaattgcttttgcaccaacctaataataatcaggtacaagtagtttgaaaggtgattcctggaagtgaaacattccttaaatatgcttgaaaggctgaggatgaatcctggcccatgtagttgttgctggttgtacgatcttgtacaagctatttaacctcaagttcaggttcttgttatatcaaatggagggcaaataatatctactttatattgtatttgtttgtaaaatacttagtcaaatttgatgtacattaaacacttgctatgtaatgacaatgacaataatgaattgacttccacttgcctcttcaattttatctttctattcatattgcgtgctctagcttactgaaaggcttcgatcacacatataaaaagtgccgtcttggctgtgagtttttatattcacctgggtaacctttgttcctctttaactgcctcttagtcacttagcttttaagtctttcagatgaattcggggacaatatcttcccaaggagttacagaatgccttagtaatctccagtaactcatgtcatgcaagtgattatcacaactggatgttagttttctcaccaaccattttgacacagtgccttgagactagaaactgtttctgattcattacttattctcagttcttaggacactgactgacaaacaggaggcactctagaaatatttgtagaatgtcaaaaaaaatgatgacaggctacatgaatgaaaaaaaagcatatgaggagttggaaaaattggacagaaatgttcacaggatgtatacatggagaagaaaattagttatccatatagaggaatataagaacttgaaggtctttcaaatgttcatattataggcttcaaggttaaaaaggattctgggtagagctcactggggaaataaagaaataaaagaatgggaaatactgcaatggctttgtaggaaagtcactgctctagcgtgaggaggcagataaagtagaaggcataagcaactgtaaaggaggctagcagcaggatcatggaaggacagtttaatgaaagtcatcaagagttgttttgtaaactcaaagtaataggcaatttcattgcatcttaaaatataacattaaaatgtattctcaagtatactgcagcttaggtaatatgattcacatgcattgaagcacattgtgtatttgctttagatttagaatgaatcgttgtttgtggacagaaaaatggaattctaagagtgtctaagaaactaatttctgccaatagaattttccaataaaaaaggaaaagcaatgtaaattgatttagtattcacttcattttcctttgtctttctgaaatattaatatacatgaagaaatgggagttgagaaattaaatttctaattaagaacttctagctgtaataatagctatgtcttgaacatttattacatgccccatatgaaataaaacaatttacatacattacctcatttaatctttccagtaaccttgtaaatttggtatttttattttcattttacaaatgaggcaactaacacagaggaaatatgtaatatacttgaagtcatacagaaaaagacacaacagagatatttctgattcaggtctgattccttcaaaacattttaaaaatattatgctgtaatgccttttggtaatcagtgaaatgattcattgcatacacaatttaaatatttatcaaggtcaggactacaagtttgtggtctgattgcagggggcttttcctgacctgcgttggcaaacaatttagaagatgtcttcaaaaacatttaaaaggtgtcttcatatattccccaaaataaaaaaagtcatggtttttaccttactgattattttcatttataactcgtatacagcataagcacttaaacttaccctgaaaaaaaattaactactttttaaaataaactacatctacataaaatctttcatgctatttctacagggattttcattctcatgtttttaaattaatatttgtctctacttatttaacaacttccagatagtgcccacatctaattaacaaagattcttttcatctatttttatcccaaattcaattaacaattcccagggtgacacttattgaagtctcactacaccaacacataatttgcttctacacagatacttattctacttctagctgaattccatgcttagattataatgaagttgaaacacacacacaaacaacaagaaaaaactagtaaaacagtagggatttacaatttaaacttaagcaactttcagtcacaatagtttgcatttgtatcgctatttattaattgggaaaccataaaggttgaaacacttatttaaatagaattaagaaacccaagccagtaactatttccttttctagctctgcatttggaaataagatttataagcatcactgaagcacgttaaaaccaatggagagcaacttcatgtagtctgtgcagtttgatcagcttacatgtaacattcaatttaaatggctttcattaaccatgggcagattttgaaagcttgtgacaccaaactgttccagtgaataatcaaattgctttgaggtaagaatgagaggtttgcattgtgagaatttatcttggttcaggtaaaaaaaaaaaaaaaaaaaaaaaaaaaaaaaaaatatatatatatatatatatatatatatatatatatatatatatatatgtttgtaagaatttttactacataaaatacttccactcagtcaactaatatttattggatgaataagaatattctacatttatttattttaaacttcccaccccaaatttggctgactagtactcccaattcctatacagataaattacctaagtgctaaaatttaaatgcacattaccagtaagtttctggtgaccttttaattgaaaatacatcatataaaaagtacataaatttggctatttccaaattttacatctaaactagtctttcttgtatctaaatacacatggaattcaaactcagttagtttataatgattaaaaaatcctctttaaattaatatttaaagggttttttaaaaaagaaatcttcctaaaacagtaactggaatgcaaaactgttatttttagttttaagtttaaaacagaatgattccaatagcaaaaaaaaaaaaatcaaatatattctcaggtagaaagttttgcttttttgcaggagatgtttacactatccatttaacttagaattataatattcaacaatagtaattttgacaatagctatactttgtcattgttattaacatgtaattctaatgaaaattacaactttgtactaacatctctcttctttttgtctaatcagtatttcagtcaatacattttctgatgcttgataatgcatcatttattttaaccatctatgtagttccctaataattaaaatgacaataaaataaaatactagcatcttcattagaggcatgtaaaaggctacagaatatacaaaacaatttatattggtcagaagaattagtggacattgttaaggcaagactgttattttactaggttagcaactaagagtggcataatatggaagaatagtaagaaaaatagccaaggaagctgttaatacaggaaagtgaaagaattaatccagagaatgaaagcaaacaccaatttctaaacagtttttcaaaagtgttagtggtaggaaaacacattcttaaccacttgtatgtatcactgcatgaaagcaagactcaatttagaatatatataagcagataaataaggaagggtagagagtattcattaaggtaaacagtactgagaagtgccctaccaaagataaagaaactgcaataattcagtgttgagtgctgacagtattggcagtaattgcgttaaaagttttgaatttcataaagaaaatatggtaaaatctccatcaccaaggaagatgctattgctaataacttctcacctccttgaacaagacagaaaaatcctattcaaaaagggaaataggtgtctcacagtgaaaacagcaaacagaacttactgaaggtattgattattataaagtacttctttgtacagaatggaggctatcttgattcatactggttcctcacaatcactcccacagggctctttgccctctaaagtcagaggtatcaaaatctgctaacttggtttagtttcagctaagggcataaatgacaactgactgcagtaattaattatctccccaactacaataaaaaggaaaagcaaaattaaagatactgagttaggctgagaagagagtgaatgcaaactaaataatccaatgtgtgtgtacgtgatcattttataaagcaggaaacatgctctgtgaatgagagcatttgttttcaaaagtctcaataaatatttatttttaaataaaatgaaatgttaatatatgactaaaagtttatatttcatttactttatgtatgctaagaagtataaaaatactttgagcaaacactgttaatagtattaaatttaaaaagataaatctgccctattctaatcatgtctttgtcttctgtttattcaagtgtattccatttgctttcgggaatatttggatgttttagaactaacattctgctttaataatccaaacacactataattccatcaatttgagtctcttaaaatgttacactgaaatgaatctctctgaagatggacttattgatttctatattcttcctctagcatcatgaaatttgacctcttcagccgtgcatggttaacactgtaagtatacatgtgtttttttgttttttctccaatcatggcaaatgtgtcgaaattataggctgtgtcctagatctattattttagttctattatggcaaagaagagagttttagggaaaagcgtttcaaagtgtttgaaaagtgcttgaaaaaaatatagaaagcagaaacaatattcattaatcaatcttgcatataacaaagcaagctagggcaataaaaaggatttattcatttagttcctttcttagaaataacaaaagcatactaaacccattgttctggccaattccttttaaagtaatccatttacttcagttctaatggtaattatcatgttacatttatctgtacccatttccattttatttttatgtgatttttaaatgtgcacatatcaaaataatgtcagtatgagaaggaagcagaacttaagtggtctttacacccttactattatgaataaagaaaatgagatttacagagaatagtgataattctatttgtctccaacaaattgccatctagtcagtctcactgtagacaggacactctgcctccctaaatctcagttcaattacctttaaaggagatggatagtatcatatctaaaaagaccacaatgacattaccaaaatcaataataagcataatatttactgaaagactctttatgccaaccacagttttacgttgtttgaatgtattaattaatttaaaactcacaacatcattataagttattattatggttcagccaattaaggtaaaaagaaaaaggaaattgcctatggttacaaagctagtgaatagcagaatgacttagggagaaagtaagtttcacttggtgggcgttatagctcctctttggagtaggtttgtctctttccttagccttctatttccagagtagaatatatttactggaaccaagtaaatactctatttagaataaaggtttttttatttaccacttttccttacttgccaacgctaatttctaactactcaaagctatccactttccataaaatatttcatacttttattgctccttatttctgtttttgtcagacctgcaagctaaaaattgttttgacatttttgaatagttgaaaaacattaaaagagaataatattgtgtaaattataagaaattcactttcagtgtccatgaataaattttaattggaaaatggccaaactcatttgtttacacattgtctatgattgttttcactccacaatggtagagaagttgtgacagagaccatctggctcataaagccaaaaatatttactagttggacttttaccgaagtttgctgatacctggtctagtggttcttgtctatctctttaaggaaaaaaaaactgttcaaatggatacagttaaagtcagaactataactaaaattcctgagttttaggtttatacgttgtttctaatttccttcacataagtacaaagaaaaaattacccctgaaaatgaaattatttgatagtgataatgtgttttttcacatgctattttgtctactcatgtctaaatagcagagattcagataatataatgatgttggttaatattaaaatggaaacagttgagagaacacagaaaaaaaacagtttaaaattgaatgtcaattgcattttcaatattctccttctatagaggtgaaatttatttcaccgaatttatcagtatataaaaatagttttaacttatatatttctaatataagacccttaaggaaagcagtttattctttggttactgatatgcccttgacatccaaaacattgcttggtatccaccaagtagacagtataaagtactgattaagattatgatttgtgcggtagaattctggttctaccacttactaacactgaaattaaaccagttgctcaactacgctctgcctcaattttcctatctataaagtaatgatgtttgcaacatcagtctgaaatgttattcatgaaaaaaagaaaatcagttaaaatatataaagtacttacaagagaacctcacatgttgtagggaatccataagtgttattattgttgtttttataaatatttattgaatgaatgttcttacaataaacataaagtctcatgatattgcccttgtatacacgttttgatttaatcatgttacatggtattcatttttttctgtttttttattgtaataaaaattttaacttttctaagatggaatcccagtttttcttttgctataccttgtattgtttgaaagatgtcagtgtattatttcaatacaaataatatttcattccctagttataatttcactttttatatttaactcatttttcaccttatttatgttggatattcaagtttgagaaggaataaagagtatatacatgacttctggatataaattagctttaaaaatgaagtggtttggccatgtgcatttgcatccatatccaaatccatagccatgccatatgaacctgcattccagacctagtaccaccattgttcgatgtatgttcacagttcagacacaggcaccaagaagaatcccctctaccacaacttctcctgtgggtgaaaaggaaagcaggaggacttcaaaagctttcatgactggggaccctgcaagtcattgctgcctttgcagacactctcagccttgtctactaaaaacgctgtagtcttcaccagtgctgacctcagctgatggaactacctggagtctaactgctgcccactcctggagctggaacagccactgtgtccttcagagaagaagctaccatacccacccagttggtggcttcataccttcccataggtgaggtctttccttactgaagccagtacataaagtttaaagaggtgacaactccttcaaatgtgcagacatcaatgcatgtctatgagaatatgaaaaatcaagaaaatgccacaaaaggaacacaataattttctagtaactgaccacaaagaaatggagaataataagttgcctgacagggaattcaaaataattattttaaagaagctcagcaagctacaagcaaacacagatacacaacttgaaaataatcagcagaacaatacatgaaaaaaataaaagttcaataaagaggtaaaaatcataaaaaagagtctaacagaagttctggagctgaagaataaaatgaaaactacaatagagtgcttcaatagcagacttgatcaaacagaagaaagaatctaaaaattcaaggacaggtcttttgatcttaaccagtcataggagagaaaaatgaaaaaaagggaagaaagcctatcatatctatggaacaccatcaagtgggccagtttatgcattatgggagtcccaaaaagagaaaaagaaagaaagaaattgatagaaagcatatttagagaaataacagctgaaaaatccccaaatctcaggagagaaatggcatgcaaattcatgaagctcaaaagttcccaaataagatcaaccccaaaacactgcaccgagacaaattataatcaaattatcaaaagtcaaggacaaagagattagaaagccaaaagaaaaaagcaactcattatgtgaaagagaatccctgtaagactattagtagatttctcagcagaaacattgcaggccaagagacagtgggatgatatattcaaagtactgaaagaaaataactgtctaccaagaacaatatatccaacaaaattattctttaaaagtgaagaagggataaagtctttccaatacaaatgaaaattgaaggagtttttcaactatagacctgccttaaaagaaatgcacaaggaagttcttcaaattttaacaaaaacatgctgagtagcaacatgaaagcatgtaagagtataaatctcactggttaaggtaaacatacagagaaatggaggttaaagtaacattataattgtattgtataaattacttttaatcctactataaaggttagagatacaaaattgttaatggatacacaatataaaaagaaactctaactacaagaacacaaatcgggcagagtaaaaaggggagtaaaagtgtggaggttttgtattcaattgaagttaagttgctattaacttaaaaaagactgttgtaactacaagatattttatgaaagctttgagctaaccacaaataaaattcccacaatatacataaaatatacaagaagaaaaaaaatcaaagcaaataactacaaaaaaccatctaattaaaaagaagacagtaagagagcagagagagaaaaatcaatggcaaaatgtatagaaagcaattaacaaaaagaaattagtaattcctcacctgtcaataattactttaaatatacatgaattaaaatcaccaatcaaaaggcatagcatggctgaatggatttaaaggaaaaaaataatataacaagatccagtggtttatttttcataagacactcattttacatataaagacacacacagtttgaaaatgaggagctgaagaaagttatgttatgcaaatggtaaccaaaagaaagctaggggtagttatgcttatatcatgaaaagttatgccatgcaaacggtaatcaaaagaaagctgggaatggctatgcttatatcagacaaaatagactttaagtctagaactgtctctagaggcaagaaggtgattatataaacaggtatatatatatacatatatatatacgtgtgtgtgtgtatatatatgtgtatatatatgtgtgtatatatatgtgtatatatatgtgtgtatatatatgtgtatatatatgtgtgtatatatatatatatatatgtcattttcatgagatctcagatgaaaacgagaaacaaggtattggaaactaaagtaaatgccatcctgttacacctctgcaaagactagtagaattgtgtctatattattggactttatggaatgaagaacttaagagtgaggaactatgatatctggtgaaagaaatatctaagcagcaaagcattcaccctgctgcatgactacttttaactgtttacagtgaagtgtgacagaaaaggattgtcttaagggcagaatttataattaaaaggaaagcagagtgaaaaaccttggaaaattcacagcatgggaaggtaaaatgtgaaaaaatgtggccaagcaaccatttgctaaagaaattactacagatggaagggagtcaagggctactctttaagataaacaagtcacttcttacatggacggcagcaggcaaagagagagctcatacaggagctcttataataaccctcagatctcatgagacttattcactatcacaagaacagcacaggaaagacctacccccatgataaaattacctcccattgggtccctcccacaacacgtgggaattcaagatgagatttgggtggggacacagccaaatcatatcaccactcattaggctctacctcccaaaactgttgcactgggattaagtttcaaacctatgaacttttgggagatgtattcaagccatagctttctgcccctggttcccaaaattaataaatttaataaaatcagacatgaaagaggagacattacaacgaatgcctaaaaaatataaaggatcataagagactactatgaacaattataacccagcaaactgcagagccaagaaggaatgggtaaattccaataaacatacaatctgccaatactgaatcaaaaagaaatagataatccgaacagaaaaataacaaataaggggattgaatcagtaataaaccaacccaaatatgtccatgaaccaatgccttcacagatgaattctaccaaacactgaaagaggaattgataccaactcatcttaagctcttccaaaaaatagaagaagcagtaacacttaaaaggtcaggatcccctaattccaaaatcagagatactacaagagaataaaattacaggccaatatttctgatgaacaaacatgcaaaaatcctcaatataatactagcaaacccaatgcaacagaacattaaatagatcacatatcatgaccaagagagatttatctctggaatgcaaggatagtttaacatacacaaatcaatcaatatgatacaacacatcagcaaaattttttagaaacagaattatctcaacagatacagaaaaggcaaatgaaaaagttcaacatctatttatgaaaaatattctcaacaaaattggtatagaagaaaattacctcagcacaataaagatcatgcgggaaaagtacatagctaacatcttaatccgtggagaaaaactgaaagctttccttctaagatccagcacaagaaaaggatgcccacttttactacttctttttgacatagtactgaagtcctagccatagcaattagacagggaaagaaaataaaaagcaaacaattggaaaggaagaagtaaataatctgtatgcaaatgacatgaccacagacataaaaaactgtaaaggctcactgttataactaatatctattttaactaataaacaaaacagtaaagttgcagaatacaaaatcaacattcaaaaattagttgcatttccacacacaaacaacaatataaaaaggaaattaagaaaacaacccccttaataatagcaatgaaaagaatcaaatacttagcaataaacttaatcaaagtggtaaaaaactttaaaatgtattttaatatctgtgcattctagggaaaccccatactcaacaatcttttaattttcataacattattaaatgttttacattaatatttaataaggaaatttcagaattattttatttaaatctcaaaaccattatattagaattttgattgaattacacctataaaataacttgggaaaaatagatatctttacaatatctagctccagacacaaaaatgaaactgttgtttccatgtatttaggacattttgtatttcctaaaacaatgggatttgctactttagctaaaaatttctaaacataattcagtgtttacatataaaatacatctatatatctatctttatagttatttgaacgaaatatgcttttcactaatgctttctatttattgctggtgtgggaatactactgatatttacatatacatttttatattactttattaagttcattaataaattccaaacattctttatgttttgtgtgttctagagtctgctttttgtacattaatattcattctcacattctttagcaatagaacttttgtatatggccatgaaaatagagattgcatgtcctggtctcttttacagcttagagtgatgtgagaccaagttttcttcaatggcatgtaagtaagagtcatgtgtgctacttcctgatctcgcccttaaaagttttctttatatgtttattagctccctataatacctgctggctggaagtagtgccatctgtgacaggcactttaacccatacagcgtatttttatgtccctcagcccacttgttctggatacaacagacatatcagtgcaggtgcaaatccatctaattccatggatagatacaaatgtatgcttcttggaataagtgttgattaaccaaaacctggagaaaagattttaaaaggagagattagaagaaatgaatacatccaagaaaagggaaatggctcaggcatttactaactatgtaattcaggtgaattactttaagcattagaaccatattttctgcatctttaaagtggtgatagtactccctgttttaaaggtgattagataatcgcaagatctcaatacattttcactgttaataacagcaataacctcgtaatgtggggatccatcaacttgaaggtagggaaaggtaagtaagtggttggagctttctgagaacgataaaacagcacttacataaatatacttgactcagccttatgcctcaaaaacaccagttgcctttcccaaacttgctagtgacagtattttatttttttatttattcttttttgagatgaagcctcactctgtcacccaggatggaatgcagtggcgcaatcttggctcactgcaacctccacctcccaggttcaagcgattctcctgcctcagcctcccgagtatcggggactacaggcctgtgccaccatgcccggctaaatttttgtatttttatgtatttatttacttatttttagtagagagggggtttcaccatgttagccaggatggtctcaaaggtctcgaaatcctgacctcatggtcacccaacttgggctcccaaagtgctgggattacgggcgtgagccactgcacccagcccctacagtattatttaattgttttgtaattttcttttaaaagactctctctctctctgcactggctttacaaaacttccacgacacattttctgattgtactgtaagttattttcttccttatctcccaatgacactgttttctacatgaaaaataccattttggctttatcaacatgttattaattcataatatgagagatctatcagcactatttgtaaaaatattcaattaaaaaaattaagatgatttatagttgtgtggtaaagaatttgaccttacccaaaggaggtcaggcttttgccctcagccttaaggagataatcttgtcatacccaataaaagtgttattttaaagtgaggctgactacacctgataatccagcttgagggacagttatgccagtttgaccaactagatgatttagggagctttctctcccaacttcaaagctgtgatgaatcaaacaggtaattaatcgatcatgcttatgtaatgaagccttgattgaaacttcaaagattgattgacgttccttggttggtaatactctgtcatgtgtcaattctagaagggtaatacgtcctgaggataacagaagctctgtgtttggaatcatcctggactctgcactttgtttctcctgctttggctgattttgatctgtaacctttacctataataaaccataactataatataatagatttcagtgagtgctgtgaggctttctagtgatttattgaacctaagggtggatgtgagaatttcctgaacttgcagttggtatcagaagtgagggaggtcctatggaggactgtgccctcagatgttgcagtttggctaaactcaggtaatagtatatggtaaataccaactgatcaagttatatttgttttttgctaggaagttttttaaaagtaaaatcattagcagtcaattatcaattaaaaaattaagtcaattaatgtatatctttttcatccatcttatttatttatttatttatttatttagtgttccaagagttcagttatttggaacttccacagttttcaagacttgagagctattgcactttcttgttaaaaatgacatgggaacaaataggtactgcagaaatcctttcatcttgtttaatatgacctgaggtgtcacattttctatatttaaaacatagtggccactgcaatgttctcatgctatttattactattatactgaagtctatactgtgatataataatcaaatgtatcttaaaaactgtaaatatctggatgctttaattaatcttttatgtatagttaaatgttaaattttatcaaagtatttggcatttttaaaggtagtttaatttgattaattgattgaatacatgctttattgatttacacattttatgtctctttcagtgtaatggagttataaattttgagataattcatgtatatatactagatatgaagatatcatgatggattcaaattactgaaagatgaggaaactataccagttttatacaggaggaaatattgttgggagaaaggccaggtgacatagtaactacaccgaaattgaaagtcagacatcttggatttggattcctgtcgactagtgataacactcagaacaattcacttaggttctatatgactcaatttcttaactttcaaaatgctagtaataattatccttttctcatacattaattatgataactaaaaaatgtgtgtgggttcggggtattgttacagtccttactgtagtaccaagcacacagtaacctcctctaaaattgcagatgctattatttttatcaaacatgtgaataagtgaaatgcaatatcatttataaaatgcatatagtgctacagaattattctatgaacaaataaggtatttgtttattcacaagaagaagatttcaaaatacaaaaaaaaggagatgtagtcgtgggtataacataaagtacagagtactactatcatttcattttttatcacattcaaagtatcaacagaaaagtattttcatttgctcaactaataactaatgtttacttttgagtccaataatagcaatacaacttcagtatgccaagtttacaaagtgcttccctgtatattgtctcatccaaatattacgacttctttgaaagatacgtccaaaatttactaatacattctatttcatggatgaaaaagaatgaggcactgagaagttgaattaattgccaggtgctatggaattagtaaatgatagctctataattcaatcttgaatcttctgacttaaagttaatattctttaactttttatcttgcctctcaccaaagttcaatatttcatctaaatttctaagcaataagtaatctttctcaaaatgttagcttaaaaacaataagaataaatatgggtaaaataaaataggtcaatttatgatgcttatgatcaaagtattaatatcaaacacgatcttactattaatagagaaaaaaagcattcaaaatctccacatgcaacaatagaactatgtctgctaccacaaataaaaaaaaaccttatgctctcatcaaagaaaatattctaatcaaaataggagagagtctggaaagatttgcaaacaaacttcaaatgtcttatacacagtaggtgacacttttaacttctattttagataattgcttcacacaagacttggaactagtaaaattagtggaagtagcaaacagcaattttgttacctatcttctttgttggattttaacaggtattgttataaaacaccttgattttttttgtctgggaaagattctttgtattataacagtacaatcatcaacagcaaaagatacattttctattcatgataataacttggacaatttacagtttattcatttatctttataatacaatatcatcataaaggataatcaagaggtacaataagaaatcataggtctttgtaaataactactggtttaacaatactgaaacttttagtttaccaatctaaaattaaaaaaaaatccattgttcaaccattattcaacttttctaggaaattaaaatctatacaatcttctaaccaaaaatgatacatttccaacaggaataatacgttcccaataagtgggtcttttggaatctcacaactgttggcaggcaagctaaaagcatagcatcagacagttttgcattatctttaaggaatataagttcagagctccaagggtgtcactgtcctatgcaaacactgttgtcattaaacgcatactgtcatctggtaagtttagtcatggcgacttgtttcaattgttaataaaacaaacaaacaaaaaatctcttttatctgactttctgttcgaatgttaactgaaaattggtcatggaatttactaatatgattcctaatgtttaaaataagctaatcagtggaattagaatatgtagcatgcataaacatgtggaaaattagaaagtcattatgagagtaatcatttttataaagcagtgatagacatacaaaattaaatctgctttcatctcccagaactgaggaagagatagaatttaaaaatacaaaagtgagtaatttgcaaaggcccctcaaaagaaatgattcttatttttaggattctgaaataatttaacttaagagattttgcagtggtctctttttctacatctggagctttctactcacagatatggcagttttaatttgaagagaaaactgacttagtcacttgattaatttttcaaataaacgatcctataacttcagatgagtatttctattacttccctctaggcaaattccttaatagagtattgttcagcaaatctcctactttctccatgtttttctgcataattatcagctatttaagtttcttttaaactattcaaatatagctgaactactcatggatttcagaagttccctaatttttacccgtgtcaaattttagggaaaagttataacactgattttattctaagtggccaaagcaatcaaagacaactttagctcaatatttgtatctcttccttttgaattatgatgaataaaataactttatagatttaaataaggaaataccattggagaatccatgttgtttcagttgataagagctgtgaaatactggcttttatttaatttgctggggtaacttaatgagaacctcatctgggtccaccatcccatactaaaatttattcgcttagtcttattggttccttgctatgttctatgttgtctcgtttacagtctccttagttcctaaaaagtaactctgttctcactttccttagcagataacccatctccttgagaagaacccctgatgaaaaagaaatcctctccaaatcaatatcttcattcatcactacactacatgttctattttccttcctccatttctcagaggaaggagttctattacttgccattgatcttaaaattatagttatcctccactgtgctgccatccataatttcatgtccttcatttgtggctttgttttcaatggctataagcattttcaattttgtcccattataacaaggctgtcactcaatactgtctggaatcattcagcatataccctctccttcccttcgttgctgaatttctcaaaagagtattaccttctttcatttatctgaactcatacatacttttaatcgcagctattctactttcattagagtttactgcaactatctctgtaaacatttccagtgacctcttaagtataagtgaaatcatttcatatcagacataatcctccatgccttcaagaaacattgaacacctccaatctttatgcttaaaactctctctctctctctctctctctctctctctctcaatatcttgctatctcactacttctatctctaatttggttcagtgactcttgacttgcttgagtctcatatctctccttccttcattccagccttttgcttttagaatagcttccacctttgcctgtatctattcaccttttccagttttccatttaattccatgcatttaacagaatactagttgttaacctaactcaaaggatttgggggatgattacatggaataatgtgtatgatgcaatggctatgatccatgggcctgtaatgcccccaaaatgtgtgttgctgcctctatctcctttcaacatcctgatgcaatatttttctaaatgtgaatattacttaatacgcccatgcaagttctttaatttttccttaggaaaatagacttcagagataaagctgattgtagatgaggtacaataattgttaatttccttggaaaattctaattgaaaattggtaaattcagtggttggaataagtatgcacagagtaaaggcaataaaaaatatagttcagcctgcaactacacttgccagttctttttatgtataatgtaatcatgtggaaaggcttttaaaataagcacgcctgtgtattcactgcaaattagtctgtcaattgaatttttacaggtgcttctgaataatccatttcgtctggcttaattacataattttaaaagtgtacaggtttctgataaaagagaacacattgttaggatgtaatctatttattaccccttgtacttccctttattgtgcttttttttggctttccaattttaagcaataacaataatactctgcaaaaaaataaagactttattgtattttctgtgtctaaattgtctgggctcacttttttaggacaatggcctggaacatgtaatcaacattaacaatccaatctgcctaagtggggccattcaaaaaggcctaaaattacaacacattttcattatgtatatatttatttacaatattttgtttgatttttaaaatttatatttgccattactaaaagaacataagaaatgccacactaaataatacctgtggtctactcaatgctgtattttctgacactgtccccttgattcttttaagatcatgaagattcttttaaatctatccttaaacacagtaccttgaccatctaatacatttcttacctttaactttttgagataccactagtctataaaaccgaaaatccaatcacatctcttctcttcctaaaaattctgttggctcactgctgtctgcaggacaaagcccaactctagccacccctcactcagatctgcctctctctgtcacctcctccccaatcctacctctacctgcttctattttctttctccaagtccatctggtgagctctttatagtcacttttgtagcaccatctgtttttcctattcatacccctacaatgaattcctccctttggtaatattactaaaccttgtacctacttttatattcacattagtcatactgtattataattatgtttactgtgataaaacaagataaataattagttttttaatcatttttaagtgtgccctttaagtactactcaatggcataaagtacattcacattgttaatcagccattaccatcatctgtcttccgaacttcattcatcttcccaaactgaaattctgtacacattaaatactaactcttcattataattgctttttaacaaatagatagggtctcgctttgttgctgaggctggtctcacactcctgagttcaagcgaccctcctgcctcagtgtaacgagtaggtaggatttcacatatatgccaccacacccagcttacaattagtttttaacattaacaggtctatctcacatactggccttcggagcagaactaactttttttttttttttttttcaatacagagtcttgctctgtcacccaggttggagtgcagtggcgtgatcttggcccaatgcaacctctgcctcccgggttcaagcgattctcctgcctcagcctcctgagtagctgggattacaggcacgcaccaccatgcccagatgatttttgtatagagactgggtttcaccatgtaggtcaggctggtcttgaactcctgacctcatgatccacccacctcggcctcccaaagtgctgggattacaggcgtgagccactacgcccggctagaactaactatttacaaatatgagtttgttaacatatttatacccagtacttaatgaaatgcctggcaactggaagatgcccaataagtatttgttaaagtaccatgattagaatcacatattatattattatgttaaccaaacgcatcaaattatgccaactttctagctctttgccacgtcagccttacactttacaaaaaacaaacattaacaaaaaaaaccacacaaaaacatacctttaatggttttcactttaacaaaaattaaaaaaaaaacagaaaaaaacccataatattacctttagtgctttctcatttcagaaagcataaaatctacaaatttttagctcttcagaatctggatcccatcaacctctttaccctcctcttctgtatcttttcacaccctgacttttatcaatgcaacattccttattcttgaaacagcagtttcagattttcttaatcattctgtctcctcagcctgaaatacttcccacagttttgaagttaaatcatagccttccttcaaggatatactcaaatgctgtctttttaggttgaagtcttctccgatcctttggcacagaatacgcttattctctgttcccttctgtattttgcttgtgcctgtattttgtatttagttagttttgcactaaattacatgttagttatacgtgtatacgtctgtctctttcactagagggcaagttatatgaaaatttacttaatacctcatttattttctttctttccatttcttcctttcagagactctcaaaattttctgcacatggtagagattaattaattaaattgaaagacgaaacaacttgttcatttgatacatatgatcaacatattgctgtttattgagcatactgaatgttgttcaaatggttcattaagagaatagtcaaagaacaacatgaaaacactagtcagaatgaagtgtagataatgcaatttgacaaacatatattgatcaagaggttcatatcactgttactgagtgaaataaatataaaggagagagatgaagtctatttctcagtaaactaactacataggcttacacaagtataaaattaaccctaatacttgttgaacagtcgtaatacaggctgaagtaatgagctttagccattaattaattagcctgttggcaaagaattataaaatagttcattaaagaggtgacatctgagcttgagcttaaatgaggaaatatgttttcaatgagtgatttggggttatggaggtattccaggaaagactttagcataaataagatttagagttaggaaaaatgttgccttctttaaaaaaaaatacactctatgacttaaggccttagaatgactcaggcagagcagtaggggtggtggagttaaagtagaatctgtaggttaggaacactgaagaaattttcgatggtatgttacaagtctatgtaacatatatcactatattgttaacatatattaatatagcataatagatcattatgttatcagtgtattaatatggcatatatcatatataagtacatattatagatgagaacatattacaaaaataatcattataattggggcttcacttagcaagtttaaccttgcagaattacacagcaaaagagataagcaataagaacagataaaagcctactgtaatatgtcaggtgagaatgcatgaagacctgaaatattgtaattttaatacatatggaaaaagatgagagtaaacagatatggggaacattatagacacaattatatacataaattgaaacaacctgaaagcagagagttaagacaaattcaaagataaatacattttcaagtaggagggaatagcagtacattaggagaaataacttctctggtctcatctgtaaaataatagtatgtaccttccagcattagtgtactgacatatatgtatttagcaataaatattaactatgattactattaagtgctccataaaatgatctagtattgatgtcattatggacaataaaatctgactctaaaacaactttattattttatttgtttataagaataatgaaaagttattaaaatttcaaacactacagaaacatatggtatatatacttgcaaacaatggagaaaacaaataataacagtttggcacttatatctaaaactttttctattcctgtcataatgaattattattattatttatatttgaaaaatattgagattattctatgcaacttcattctttttacatagcagaatgttttggggctttttccagaaaagaacatatagtagttttgtattctttttaatgaggcaactcactttattacattaatgtgccatatagaatctaagaggacatcaggaaaactaggtggcatttctgacccaccagagcataaggcacttttgtgtaaattagaaaatgtactccttgtaggtggctatgtcctctggtgcatgtctggattagcaaaccctgagctatatttcagctcccactgacctccctgctggaaatttgtaggagagaataatctatacaataattaacaaagccctgtggcaatgccaaagggatgtttgaaattttctgtagagctcagaagagtatataaactttgagctatagattttagtttcttttctacagaagtcatggttgaattcctggatgtctggggagaatagatgagcgatcaatgaaagagattatataaagaaaagatattaggaggtgataactccaaacccatccgtgagaataagacaagtggtggtggtgggaggaggagagagagaaagagagagagagagagaaagagactctatatataataatgatagatagatgagagaataaagcatattaaaatcatataatgatgatagaataaactgtatggtcttttcagattctacatatgcatatatgcgtatgtatgaatatatcaagatatcattcacaatctaaatctcttctcttaattatccgttctgaatttgggaattgaattaattcagaaaaaaatgtttggataagattttatatctaaactgtcactgtaacaaggagaaactcaagaaccaagcagattatcataatatagcacccttactcttcaagatggcaatatgaactcagaaaacaaatagatttgaatgttaagggacacttgtaaatacattttaaatttaatttaaaatctgaaacgttgctgggtgaggtggctcatgcctgaaatctcagtgctttgggaggccgagttgggcagactgtttgacccctggagttaaagaccagcctgggcaacatggcaaaactccatctctataaagaatacaaaaaaaattggctgggcatggtggcatgcaactgtagtcccagctactcgtaaggctgaggcttgaggatcacctgaggctaagaggtggagggtgcagtaagccttgatcgtgccactgcactccagcctgggcaacagagtgagaccctgtctaaaaaaaaaaaaaaaaaaaaaaaaaaaaaaaaaaaaaaaaaaaaaaaaaagttaaatctgatgcatcagataaacgtttctccagctccttgctcatttagtcatacgcaggacttttgctctggttcctgattattcggctcttaataattttttaaactttttcatgaaaatttgctctttttttaaaaactatcttcttcagttattgcctccaacattcaaaagtcacctagttcttatcctaaagctgctaatagtatgaatttttctaaatgtattttatcaggtttctaaatatatcttcttatcatcaatacatgatgctttacttacagtgatttcttataccaattgctcttactatagagaatcaacaactcaaactgcaagtgtcttctgattttttcgtaatttcattttgaaatatcaattttattaagaagttaaagttgactcttttctaattactctcttaaaagaatcactattgataagtgatttattattagaaaactaaagtaaattttctttatcactgggcttgtgaatttctaaatagggattcgagttaagccacatggacaatagttaaaatcaacaacaaaaccaaaatggaagttaataatgagcacgataattactaacagacgtgatttttacttatgcaagtgactcttatttgtacaaatgattttaagcaaaacaaatggcattcagaaaagtctgcagtagatacacaggagtgctaaaaagtaaaaatttattttatctatgtaaaatcaatcaaatgtaccacactgcctataggagattataataatactcgagggataaaactctattccagaaaacagtcgtaaatctttcctccacttttgttctcaagggctgctgttcaattttatgtataattgaagtaactacttagttgctattcctggagcaaattttcagagcctcactttgagacagagtctggctgtgttgcctaggctggagtgcagtggcgcgatctcggctcactgcaagctctgcctccagggttcacgccattctcctgcctcagcctcccaagtagctgggactacaggcacccgccaccaagcccagctaattttttgtatttttaatagagacagggtttcaccgtgttagccaggatggtctcgcttgatctgcagacctcatgatccacccgcctcggcctcccaaagtgctgggattacaggtgtgaaccaccacacctggcctatgggacacttttatttcagcttactttagccaagtggtctcatcacacctttgtttatgacaaacagaaattctatcacgttcatattaagccatgcttttataatagtagccaccaaactttttgtttgtttgcccttatcaataaaatattttgagaaatgcatccaaaatgaatgtaattttatcacatataaaaatcacaattaacattaataaaatataatatgaatacacattttacgtttttttctgatagttccaggaacaagtacaccccatcctgaagataatttatcaaccccatctctttcaaagactgtgtactccttctcattacctattattccagaggttcttttcttctatgatgactgagaggtaccaatctcttatttcttttttttttttttcccccaaaccatcctgtttactaagctgaatctggtcatcaaaaagttttctttcctttttaaagatggctatttcatcatttatggttttaacactactagcctttaattcacatagagtttactctcctactagctgaaagtccattatttctaaaggttaaattgttatggctgggacaaagaaaagcatatatacactcatttaattaatctagcttattttgaagaacaaaagagtggctgggcgcggtggctcacgcgtgtaatcccagcactttgggaggccgaggcaggcgaatcactaggttaggagttcaagaccagcctgaccaacatggtgaaaccccgtctctactaaaaatacaaaaattagccaggggtggtggcacatgcccgtaatcccagctacttgggatgccgaggcagtagaattgcttgaacccagcaggcagagagaggttggagtgagccaagattgcaccactgcactccagcctgggtgatagagcaagactccgtctcaaaacaaaaaacaaaacaaaacaaaacaaaacaaaaaacaaaggagtttgtactgagaagatttattgagtggtttgaaaatgtgtatttgtctgtatgcataatgtatatgtaaacattatcttgttataaatccctttataagacttatctttactgatattagcctcatatatttttataaatctatttatatttacttattttttattgatccataatagatgtacatactttgggggtacttgtgataatttgatacattcatataatgtgtaaagatcaaagcaggttatttggagtatccaccacattaactatttatctttactttttactaggaacatttaaattctgtcttctagctattttgaaatgtatattagattaatgttaactataatcaacctactgatctagatctatggaacactaggtcctatttcttccatctaactgaaaatttgtacccattaatcaaccctcttcattattccctcccctctacccttggttatttaagagtaagaagattttgctaatttatattagtatgtccaatactagtaataccaatattacattactggaataaacttgtaggaaaaatgcagccttataaatgtcagagaaaaagagagatgggactattttaatggctgacacaggttaaacttctctctctctctctctccctctctctctctctctctctatatatatatataattttattttatctatgtaatatcaataaaatgtaccacactgtctataggagactataataatacttcagggataaatatatatatatatagttttatatcttaggtattatatacatacatatttagagagagataaatatagatagatacatgtatatataaacaaatttatgtactctctatatatacctaattatccaagataatttgtgcgttaaaacccaagagaagtaaaatcttccgaagataaaataactctttaaatcttaaaaagatgattgaaaaaacttttttgggggttgtgaatagtagcagaagtggattcagtgacgtcactaaatatgagtacagtgcttttagaagataagaataggcaggacctgagggcaagtatatctctccaaggagttcacttttatttgtagcattttctaagtttaacagttatttgatatgtgttccaattttgagctgtgttttccttcttgaaacgactgacgttctgcctgtagtctttctaaatcttcatctccctagctcacatgtcactagcttttgataattttcctttggtctagtagtgacacatataaataaccaaaaatcagaaaacaagactccggcaactaatttcaacaagccttgttcaatggcatagacagaatgtaatttattttttgtgacagttataataaaagtgacgtgaaacacaagggatgtaatgtcagcgatattgcacctcaaaagaggagaaagtgtggcaggttacctcctgattagcagcagctagttcttcttccagtgcagagactctttctaaagaaaccctcagtcgctcccttacctagaagaaaaatcaaaatatgtgcagtaatgtacatcccatacatattaaactgtgctgaatccataattaacatcatcagagacagtcaatttggcaaattattaaagtatttatatccctgcgtgctcagaatactaaatctggcagaaatacaatgaatgcattgtcacctcgtattgtcactgtatcaagggatttccttgtaagcaaatgcttttggtagttccctgatagagcttcaggtggggttggagattgacttgtcttgctctgaattctgattcatagtaagtggagacaaagtttaaaagtatattatgaattcatctaaaaaatagtcactgtttaagcatgacaaataggaaaaaaaaataccccacctttttctctacttctgtaaaataacaagtgaattttcatttggtacttagtatctaatttcaaaaattatttgcctgaaggaaaggccttttagaacctgaaaaatgttcttcgcttctctgttttttattaattagaggtctactttgtttttgaggaattgtaaactacttaagtatcttggaatttccaactagcttccagataccaaaggttaaaccattgtattttatagaacaaaaatctctgtatattttagtttgaaagtcataatttatgcttgtttcttacataactgaaactcgaagaagtatttctttgattcttgctttcttagaactttgttttagttgttttatgtttagatctatatatatgtcctgatatatatatatatatatataaaacaattcagagaaagaaatattgctgaattaaaatgaatgactatagcagtttaattttccttaaaaaatcaaaaaactttatagctttaacttaagatgcaattcatggtgggttttcgattatttataaattaacttagatttttcttgggaatgctatagtatttgtgcagttaagatgtgttttaacatataattatattcctatgagctttcattttattaactgacagcatattttaataaatggtatttttctcctctaataagatttaactgggaatatagattaaatttataaaatatgtaaaaacccagatacataaaaattaaattggaattataatattatttttccagttagcaaacaaacaaaaagtcagtaatgtcctattaacctagaatcctattaggaatttttaagaatctaagtcacattttagtattgtattacaataccatgtatattcagatgaatggatgcatttaattcctgaaatagaccttgaatcagcaataaaaatatccaagtaggggttttaatattaattatattttgttatgcttaaattctctaaaaacaataatacacacataaatggagacttgatttctaaaagagttgcacaggatctttcatcatattgagctagagattaactgccaagtatcattcctgttagacaaatatccaattgttaacaaaatacataggattaatgctgattaataaccaaacactagttacatagcaggaaatcttcgatgatttgatttggagaatacttttttatgaattttgaatacatgaaaaagaagcaaatatcccgaagccatgaaaatgagcaggacagctgatgtgtggaatgcatatatcaaaaaacgtttcaacagacgtgtgatgtttaacagggattcccatattctaaaataccaactgtaaaatacgggtgtcctgaagaaggcctagtaaacctagttgatgagaacagcaatatgaagcaatctaaatatgttaataatctctccatacacaacgctgatcatatcacacttaagctgctgtagagagaggaagttaccatattttaaaatatcaacacattaaaatctttctaaaagtcattcgcataatataagaaatggttgaatctaggctacatggtaggttaatatatctttctttctttttttaaacttaaactcttagaactgttccaaactgttttctatttactacaagttaagcatttatattttcattatagtgagtttttaaggagtaaaagttatcgaatttatccaacaatatgaaaatgaaataatcatctttcatatatttagaatagtggtttacaaattgagattatgttgtccacgaagtaataaatctaaaactgttttacaagaaaataaaaaattctgaatatattttgagttatgttataaattgaaaaattgatgctgtgaatatcaataatgcaaactgaaattaatataaggcagggttgcatttggggaattatcactcctacaacagaaaatattcttgtggaaatctcctcagaccagaagctctaattcattccttgacactaagatatttgataataaaaatatatagggaaggcatatatatttaatttgttttggtttacatttcccatacatgtctgatatgttatttttaaatagtcaatgatttctgagtaattgaaaaacacaagtatatttctcatgttctccaacccttggaattggtaaatatattgtagagtaatttcaaaattactgatggtcttagctaattatgaatattctatgctacaacttggtggctgtataaataattggacattaatgatgaaaattatgaatcactgcaactctctacagctatgctcaatccttgtagagtttatttagctctgcatatgtactaatccctctatgataaagttgtttgtttcctgtccccaaggcatggttaattgcatctttttctgacttcatatatatatatatatatatatatatatatatatatatatatatatatatagtattacttgtttatatatctatatccacatccctcctcatccctatgagaaactgtgagttactcttagggaaattgtctatgaaggcacttagacacatatgagtccctcgacaactaaatgaaatgctattgtaaacaagcatctggatcaacagtaaaaccaacatgtttacttggtttgaaagttttatcaaatgctgatgcttactcctgctaataataatattcataaacgttcactaaggacttgccatatgctaagcactggctgaaagctttgcatatcagatcatatctaatcctcatgatgactctgaggtcagtactaggattatcttaattcaagataagaggtaattgatgctttgagaatgaatgatcaagtcacttatccagatctgtctgactccagagccccaattcatttcttctttaggccactgagcattacttgttgataatcagtccagttgtccctgaactcaccaatgttcagaatacctatggtgagttaatacatattattatagctcctagggtcatacgatggaacaactcatatagttatgctaaacccactgaacttctataaagtaaattatttctagattacgttgtacaacaaccatttttttcttaaatgtactcacacgaccaggttatttgtcttaaatgctgtttattacctctattctgataaagaatcattcttttgtaaaagcatccctcaagtgatatgggaatgcttatgggaccatctcaaatcatacattctctagtaccttcatttaagtcacaaaactcttgaattttctctggataggtccttctcttcttacagctctgggttattttctgtgtgggtcctgctgcttagagtatctttctctgcttaaaaaacccttaatcattctttaatacctagatcaaatgccaacctttctttttttttttttttttttttttttttttgagacggagtctcgctgtcacccaggctggagtgcagtggcgcgatctgggctcactgcaagctccacctcccgggttcacgccattctcctgcctcagcctccccagtagctgggactacaggcgcccgccaccacgcccagctaattttttgtatttttagtagaggtggggtttcaccgtgttagccaggatggtctcgatctcctgacctcgtgatccgcccgcctcggcctcccaaagtgctgggattacaggcgtgagccaccgcgcccggccatgccaacctttcttgaagacatccttgtctttgtcattactcacacagtcacagctttttctgtggctacatattgtgatggaaatacatctgttttgagttgtttttcattgatatgtgaattcctagcactaactctgaacttctcagtcataatgagcatatcttatttatctctgtgtgtcaaacatgtgctatggagcctgacacatactaaaaattctatacatataaactcttgcaaattcttagcacttttataaaaagagaggaaatataatatgaaactaaatattgaatattaaataattatttgatgtcatatttagcaagaatttttatataatattcatttctgttttattcaaaataattcttatactaattgcctctcgttgctaaaataaaaatgagatacaatttcttcttaatactctagaagacagaattatagttatccttacatacacactccacataatcccctgttctcagaacatctgaaagaccaatgataaaaatataaatgtatataaatattaaatagaacaaaaatatttgcatgcttaaaaactagatataactgggaaataatccctagtttggattttaatgctcagaacttgtcggatactttacaatgaagtgtcccaatttccactctaactcctaaagatttactaatttttaaaagttcagtctttgaaatttcacgaaattgaaatacgtcataagccttcctaatctcctaaggatattatcatcatattggtttatatatgtcagtagaacttattcgagtaacagctaagagaagcttacagctacttttaaaaatatctaaacacaggtttttctactaatactttgtgatgttacatgcagagaatattcaaatgaatatttaaaactatgatattagagacattagaaaataagatgcttctaaaataaatgtctaaaagttaaagtacatcaatttgcatatcaaaatatacataattttcagttagtggtctcttattttggaatctataaagaaagaccaaggtgggggggggggaggggggagagagagagagagagagagaggctcaataataatattaaatgatataacattttgaatgtcatctgaagtagggttataatgtaccataatagaagtctaattctgataagccatagattcagtggtttagaaaaagaagatgtttatgaatattaccaacatccacacagtaatccattttcacttttaaaaaatgatttttcatataactcaaaagtgttcctcaactgactgactttaggagtcaggtgagtcaatggatgaagacaaagagcttgatgctgatgacagaagtgtagttaagcttgaactctttttccatactataccttttcatccaaggccttgtggtgctcaaacaaagatttcagtgccttgagaacttcaacttcactggatactcctgagggagactgggcttgccgttttaccaccgtcattcttagtgatctttcatgtcgtgacacaaggcactccaaatgctccagtaatagctattgggtttaacagaaaatgcaattatcttatgaatacaagtcataaatacttacaaatgacttcccccttaaattattgcaggcttacatagtatctaatgttagctgcaggttacactgcaagcagcaacaaagaagcacagacctgtttaaaacagggtttataaaatacattaaagataaattgtatttgatcatttaacaagttactgaatttaaaaatgtaatgcaaatgtaatgcagtcctttagcaaatgtaataatttcagtacgaattcagcagaaatagaacacttggaaaaatatgtatgataatgatgaaagaacattgcttgatgcatcatgatctttttagaggatcatagtgacagtcaaaatttatttcatttacatatggccattaaaataatttgaattgaataaaatgagcataatcattaaaatgttactttaacttaatcacatggttttattcacaattagtctttagattaattatagaaaaatatatgcaaccaattagaacatagtaactgagattctcaattgtcagttcagaaaaggaagttaaggatacagttttaaattgcctgtgttagaatctatgatttcccagagtagcctctggggccatgacagaggtggagggaaagtccctgaagactttccaggctgtttcaggctttacactcttagcttttgccagaggagttctgctttgaaatgttttgtgaattggggtttcatatttgctttcatttcaaaaggaagttctactgctaaaaaacaaagatacatgagaagaaaatcagaaattgcttgattattttcagttattataattttactagtgaagaaccacacacagttggtgagcattataggaaaggtcttcggaagcatagtgaaaagcataggctaacaagtggtgtctacttatgcaaaataaagaagaaaataaagcagaaattacccaaacaaaagatttaaaaacagatataagacactgaaggtggaaagaataaagaaaacaactttatttttttcttttcaagatattttctaaaagtttaactgtaatgaaaaattttggttttcactataccactgttagattcattgtcaagtattagtatcatattttttggttgatttctctacatttgctgtcactaattatgactcaaaatgttagaaaactttgccattattgggcacaaagaacaccagtatctgagacactaaacatgcataaatcagtagataagagtcacatttaaggatcaaactaatcgccgggcacagtggctcactcctgtaatcccagcactttgggaggccaaggcaggcagatcacgaggtcaggagatcgagaccatcctggctaacacagtgaaaccccgtctctactaaaataataataataataatagtagtttttcagtatgaaaataacctgaaattttcaaggagccctttaaaatttatcaatctctgattatattatggtattctattctctcaaattctttagatacatgtattcattgcataaatccaagctgttttacataggttgtggagatttgcatgaacttaataatgtctgtttttccagtggcatctgatgtcaatctttcgctggcaaactatgttccagacttctgacctacttttagctcctcagtatgtcaagcctttgcttatgctgtaccctctgcccaaagcactccttctttggttcctcatttaaccagctctttctcattctttaagtctcagcttaaacatcatctctcaacaaggcatttgctcactactgtctaaagtaagtttctccttttccccacctccgcaagtctctatttcaatcccttactaattttcttcagaatattttatgatatgcaatttaaacaaatttttctaccaaatttcattctattttcccattgcaataaaagctccatgagagttggcacagtgtccgccttaatcctcttgatcctctctggatttgggtgttagctcaattcccaacatctataggtatgcaattaatatttgttgagtgaactgaaatgttaaatgagttaaatttacatacctcatatagttttatatatctcatacagatttggcctatatgaaagctaagcctgtggccatggttaattggcattatttcctaaaagcttaggctaattaacattattatgtacatctatccttcaatctgatgacaaaaataatgaaacctttacaacacaatgaaaactgtttttttttctaattgtaaattagagtcatcttgcataatatagtcgttcaataaacatatcagcatccaattttgcacaatacagtgtaagatttagaaatataaaatatccaccctctaggaaaagaaacacaataatgatgctataaaggatatctgttattagagactacctaaatcttttgatcacactcttcacatttggcaagtggaactttttaactgcttctccctaccctcatgtcctcattgtctctttacccagcttaaagttaacaattcagtatttgtaagcactctctttcatgctccctcagtttctagaatctgatcacttgccactacatccactgcttacatttgtgtccaagacctataatctccccctggattataatggctccttaactggtcctcctcctttcagcctttcatcttcaggctattctcaaaacactatttcagttaaaatgtgagttaggtcatttatacctctgctcaaatttttaatgtcttcttattgagctcaagtgaaagtcaaagtccttatacatcccaaagggatctaaattttctgaacttatctcctatttttcttcttgctcattctggtatagcttcattggctgccttgcagttttttgtttgtttagttttgttagttttgcttttaacaggctaaacatccatgtccccacaacaggggttttgtacttcttcttttctctaactaaaacattctctttcagaaatctgtatgactatctcacttcaccttcgctttcatattttaactcaaatgccacttttcaatgaggctttccctggttacctacaacattggatatctccttcctagcatattaaaatgttgctttgtgtcattaagtttttggatagtttgtcatatcatgataggtaatcagaaaaccttctcccaaaggatctgtaactatttattagagtcatagtactatggacaataaaatatcaaagtttcttgaatattacctctgagctaggagtaattttctgatcctcactctgtaagagtcttcagtaacctggtggacaaactgattcaccttgtagatatcagcctatttcccttgccaccatgtcgtatttctcaatgtgcataaagaagtgaccatggtttcagggttataaacctgacaaaatgggcttcccacgattaagactgatggagacaccaccatggctgaacggcccagtggcaagctgcagcaatctaacttgagccctgtcatgataaagtacagctggagaccagctattcaccatgaagcaagcatattatatcaaatactttttattaaagaggaggcagtttttcctcactataataaaccccctttttggatatagatttgctttctctaatgaccatacttctaccagaaacaccatcttaccgagtttttgcttacagtcatgttatgatatacaacattacttcagacaaaaaaaaaaaaacaaaaaaaaatctgattttacagtgaaaagagtaatgcaattgatgggtgctcccagggaccccggattttatcacaccattacatcatttagaagtagctgaacttatagaatggttaaataagccaagacttttttttattttttattattatactgtaagttctagggtacatgtgcacaacgtgcaggtttattacatatgtatacatgtgccatgttggtgtgctgcacccattaactcgtcatttacattaggtatatctcctaatgctatccctcccccctccccccgaccccatgacaggccctggtgtgtgatgttccccttcctgtgtccaaatgttctcattgttcaattcccacctatgagtgaaaacatgcggtgtttggttttttgtccttgcaatagtttgctgagaatgatggtttccagcttcatccatgtccctacaaaggacatggactcatccttttttatggctgcatagtattccatggtttatatgtgccacattttctcaatccagtctatcattgatggacatttgggttagttccaagtctttggtattgtgaatagtgctgcaataaacataagtgtgcatgtgtctttatagcatcatgatttataatcctttgggtatatacccagtaatgggatggctgggtcaaatggtatttctagttctagatccttgaggaattgccacactgtcttccacaacggttgaactagtttacagtcccaccaacagtgcaaaagtgttcctatttctccacatcctctccagcacctgttgtttcctcactttgtaatgattgccattctaactggtgtgagatggtatctcattgtggttttgatttgcattcctctgatggccagtgatggtgagcattttttcatgtgtctgttggctgcacaaatgtccttttgagaagtgtctgttcgtatccttcgcccactttttgatagggttgtttgttttttttcttgtaaatttgtttgagttctttgtagattctggatattagccctttgtcagatgagtaggttgcaaaaattttctcccattctgtagcttgcctgttcactctgatggtattttcttttgctgtgcagaagctctttagtttaattagatcccatttgtcaattttggcttttgttgccattgcttttggtgttttagacatgaagtcctatcatccctatgtcctgaatggtattgcctaggttttcttctagggtttttatggttttaggtctaacatttaagtctttaatccatcttgaattaatttttgtataaggtgtaaggaagggatccagtttcagctttctacatgtggctagccagttgacccagcacaattcaagcttggacataatacattgctaagtaggaattctatcatcctggaattagtatatcctcagaactactgatagaaataagatagagtttctttcttggaatagctatggatccatgtatgtaagtccagaaaccaaggtttataattggaattcataactgccaactaggacctgtgactagtggagaaaagaggatcattccttttttgttgacacacatacacacgctcacatacagacacacacactatatatacacacacgcatgcatgtttgtgtgtgaatatatatatataatgtacattaatacattattctcttttctgttttctgtaccctgttaccatcttttacccattaattatccccattttctacccctccccctgactgtttgatagttcctcacaatccaaatcccatcttcccagtaacatttcttgggaatgtttaccactaggtggcagacctgtgacttaagatcagtcaaccagacctgaccaccctgggagttagcctgacggggcagagaggaaccatgctgggaaggggtagtggcagaggctgcgtgtttctgggactgggcttgtgagaaaaatttacaaagctaagaaatgtggtcctagagactgtctgaaagctcagtttagagatttcttatatgctttaattaatgtctttatttaaacagccaagctatatactctgttttgtgcaattaggaactctcatctacatgataataaaaaccaaatatgtttttattaatataaacagactccttaagggatgaacgatttcacttatccccaataccaaggaaaatattctacataataagtacttaatacttgttgaattgggttaatgataaacatcaattattcagattgaagaatatggacaaaaatgttctcatctggcatatatatatggcctaatttaaggttaaaaataaaagtaaataaattaagagtacaaaaagtgatacttagctaagataccattaacaatctactaattacacaccttcactgggagctacaactttagcctaatatttaataattctcacagaaagtacaaatggaactctctttggtatactcaaaggattgtagagactatgtgaatggccatgaatcctatgtttgaattttctttaaatgaccacaggttctatgtgtatacacacatatgtatcatatattcacacacagacacacacacacacacccacacaaacccacacatcatgcgtcattgggaattttttggactaagttttgccttgaaaagcaagatggcccaggtaatctaaatcttttattttactatgattctgtaaggatttctaaaactatataacttcctattagatcttaattcaacaaaaccttgtgaatagttatttccaattataaatggcactgaaacagaaacacattcttccctgtagactaatgtggctgctgtaatatggtcatatagcatgacattaacatctgaaaacgaaaacctttaaattggttgccttcttactcaacccactccatatcttttaccctcaaatatcgtttaaaatcccatgtttcttatgctcatgtttgattatgaaattgaaatagctgttgggagggcgtatgtcctatcctatttactcttgtactgatcatatcctatcatagaactttcataaataactatatacgcacatgcatgtacacatatgtagaatctttatctgttttcagctgagaaggtcttccttttctgaattggaccgtattttctacccattgatgaaatacatttggatgacattattaactcgtacaggcagagatttgtcaataagaaaaaatttttctttagtagtgatgggtgtctaattgtatctcaatatctgttaagataattcctttggctcaaaacaaaagtgagggcatggtaagaaatgtgtcaaatgcaattatgtcttctttttaagtttatgatccatgagattaagttacagctttattatttataactaggtattaatactgtttcttgaaatcataacaatatgaatactgtttctcaaaaccataacgtttttctttttttttaatttttttttattatactttaagttttagggtacatgtgcacattgtgcaggttagttacatatgtatacatgtgccatgctggtgcgctgcacccactaactcgtcatctagcattaggtatatctcccagtgctatccctcccccctccccccaccccaccacagtccccagagtgtgatattccccttcctgtgtccatgtgatctcattgttcaattcccacctatgagtgagaattcaaagtcacacaatagttacattctaaaacattatgaacaatttaaaacatcctttgagatcttcagctataaaaatagttgaaacaactccgacaataaaaatgttcttcacgctgacattcacaggcaataactatacaaaaattcccagtttttctttacctcttcattagttcagataactttgtcaaaacatgtcttattgatcattttgagttgaaataacatcaggaataaattattttctataaatataaccttctgtaaatatatacttgccaaagtatggtcagaggagttttaggaataacaaattttgtttcaatattttttctacatttttatcagtataaaaatattgaacaaaaacttctttgtatgtttctataaatatccactataattttttgaaatttctatttttgtataattgtttataatattataatgattttattaggatattcttaatttaataacttgaggcagttggatttaagaacaactgcagtgatgactgattttctttcattcactcaaatttttgcaatgtcaacgaggtgtttctgtggagaaaacataatacatggccaggacatacatttcagctttgacctcagaataaaaacatagcagattgactttccacatgactaacacaaaataaagtaggattgaattacaaaaatttaaataggccaggagcagtggctcatgcctgtaatcccagcactttgggaggtgaagacgggccgactgcttgagcccaggagttcgagacaagtccaggcaacatggcaaaaccccatctctacaaaaaataacagaaattagctgggtatggtggcatgtggctatagtcccagctacttgggaggctgaggtgggaagatcacctgagtccagggaactctaggctgcagtgaaccatgattgtgccactgcactccagcctgagcaagagtgagacctcgtctcaaaagaattaaaaaaagaaaaaaataaatttgaacaaactgtattcttctttgaacataatacctttgcatcacatgtgaattgtgggtgacataggaatatgatttcttaaatacatagtctgtgggtaaactgagaaggaagtagtggactctctgggtgtttcatttataagccatttataggcctgggacaagttacttactaccttagttttctcttgaattaaatgggaataatgagattgctgtgagaataaagtgagttaaacatgtaaaacattcataaaaacatttagattttaatgttagctattatattatcattattactctctatcttcattcaattcccactggaacttctattttctattttggaagatggtataattcatccaaatatcattatacagaaggactttttctgatctattgtttttgataacattcaaaattaatacaaatgaccccatccacacatggtttcatggactggctttttatgttatttagctcagttcatgaacatatcctaactactcgatgtaaagtgagccacaagttgatcagaactttggaaattggaatgctcaattacactttatattttattttcttttatatatttatttatgtatttattttttgagatggagtctccctctgtcgcccagactggagtgcagtgacacgatctctgctcactgcaatctcaccctcctggattcaagcgattatcctatttcagcatcacgagcagctgaggttacaggcatgtgccaccatgcccagctatcacttgcgctttaaatttgctcacaatctgacaccaattaaagtttctttacatgtgagaaggaaacactagcttgttgctttgtctctatgaccagcacacagatatttatagcaagaagaaaagcacaacatctagaaagagaaacaactataaaatctataaaaatggttttatttagcaacatttgataaggcatctggtgtgaagagagacatatttgattttcagctctggatatactacttctgggggatggaggagggtgagaggtggttatgtaacttaaggagttattatataattaatactgtgtacaagggggttttcataaatctgttttccttgatgcagtcgacaacaaaaatcctccacatcactgctttaaagaaggtagaaatgtattttccagccttattcatattttcaaagtaactattatgcatggttgaaatcaatggcttcaatatctgttattgttattttaaaggaactttgtatttttctaattttgactcccaaataggtacttcacatgtggctcaccttcctccctttattatccaagactcctttgcaaacacaatagcctcgggtatttctggttctcatggggttcaatatgatgaaaattgtacggattctgtcaccaaatctcttagctctctaaaattcatcacaattagatactgtggtggtctgactgttaagcaatgtcctctctagctgtagtaagtctttgagtaataatgctgatggcctcatggttagtgcacaggctctggatttagactgccttacctttcaaattcattctttgctatttactaactgtgtgacttctggcaagttatctgaccttttctgagctcacttacctggtctgtaaaattgagataattataacatctccagaggggtgtagaaaggagtaaggggctgaagaaaaaaggctagatgaacctacacagctaataaaagagtgtctggtgcattttaaatgtgagcattagttataaacctaaccaaagctttgtatttccctgcattctcagctttctgctcctacttttacacttgagtgtgctgtgttaaatcaaggaatgtagtctaaagtactaaaatataacatagtggaatagggcagaataaatgtcatggtataaataaattttaaatttgcacgaaaacacagtgttaagttaaaaaagtcaagggtaggaaatatatagagaggaagacagcaaaagaaaaaaattgtctgatacctgataatatgatctaaactgcccttgttatgccctgtttgaggcaatccatttgacaggttcatcagagtatcattgaaaaccaattcaatgtatgcatgtatgtgaattctctttaccatgaaataagaccttgataaataaggacataaattcagtttgatcatgtaaccattatgcaagcaaccctatctctcattaaaggcacaagctcccagttagtagaactgtattttatattactctctaagactcataaagtgaataggccattagctatacctatttttttcaggattgatctattatagctataacatttaaactatttttcaccaacttcagttgtatttaaattgaacttacatccacatagaagtggtttttttctacttccttttagtaaactgtactcctctatgggtaatgtggtaatttacatgtttataaaatttagtgattttttttctcaaagaaaatatagcatgtttatcaaattctgaactttaatgttacatggcatgtcatatgcttgatgaaaatacatgggtttccaaaagtagaatctagcaaattccatgagtttcatgaaatcagaatatcatggctggacattcccttggaaatttattaaaacataaaggcactcctcttttaatgggcagatttttttttcagtttttttttcttgacactattttttgtttcctttttattttatttattattattatttttttgagacagagtctcactctgttgcccaggctggactgtggtggtgcaatctcggttcactgcagcctctgcctcccaggccctcccaagtagctgggactgcaggtgcgtgccaccaagcctggctgacttttgtatttatagtagaaatggggtttcaccatgttggccagggtgatcttgaactcctgaacttaggtgatccgcctgccttggcctcccaaagtgctgggattacaggcatgaggcatcgcgtccggcctttttttttttttcctttttaaaaaaatcttctgctgggaggaggtgagaaccaaacccaggccactcttttgtagcagcccttaatttaaactcttcctcttttccaaaactctcctcttttgcccatttccaacctctgagggattaccctacccccaaaacaaccttttgaaagtttgaaacccattattgaaatccagatcttctttttaaagccaaataaagtaaaggccagaaggaatgtgaacattttgtaaagcaacatagtgatttagtagctgtgactataatttaggtttcctgtctttttgttttgagttttatagtatatcctcctttactttaagtaactgagttactatctgcttaaagtaattataaagttttaaaatgcatatattttcttcttatatgtgtgttacatgtaatgcattgaactacaaatagaattaattccaaaaaggctgctttacacttactcttgtgttgtttctttcagctttaagttcagagatttcttcttccttttctagaagttgttccctgcaggcatttaattcttttgtcagtgcagcaaattcctggaaaagtaataaaaatatttgaagaaatattcaagatctaaaagcagaaaaaaattcaaaatataaatttcaaaatgaaaagaatggggaaaaatgaccccactgactggtcaacatatgttgctgttatgaagtatcttaaatacattattcaaaacatgctaatccataatatgtgtcatatgcattttattacagtacactgcttagatgggtgtataaagtatatttcaaaatatatcagatacatcacactgagcctaacgttaatatgataacttattcctagagtaaatttaagtttggctaattttatgaacagctcccaaaatcttacactttaattcctatacagcaatgtttatacagagtacagtggatcttcagaacaaccgcaaaaaaccctgctaaacatgctattttgaaattaacaaatttatttgttaacaagatgaagcagaggaatctacctttttttttttttacaaaataacaaaataacaaatatgcctaagatttgatagcattatctaagattttcttattaatttgcgtattgctcagtctttctaaaaggtaagctccatgtggacaggggctttgacttgttcacggttacaccaccagtgtctaagacatagtgggagctcaaatggtatttatttttagttgatagaaataggtcatattgttacaaaaaaattggggattctggagtaattctgtcttcatgtggttaatgacactgtgaaggaatcttcattggcctccttcccctaaatgggatcagagatcatatgatatggtatttttaccaataggtagagagtttgttaacacacagaaaaggttatttaataagaagaccaaaaaatgcaactattctgctattctaccttataaacaaatatttatttttttaaatatagtaaatagatccatattatcaccaaaccctttagagtgattttcagtagtaacactgatgcttatcaaatatttaagtatttgggaaaacttaggtccatgctgagaagtcactcagaagattaaaaaacataaaatgaaggagacaggtttggttaacctaacctccagggaggcaaatttaataaaaagtaaatgaatatgatgattatgcaaagctggggaaggtttggagtttatatttttgtttgcttcaaatcatttattttgcttagtttctctaaagggcttcagcccaagtgagtacttcaaagatctcagagtaggcttcagggcttagattctagatgacagagtttgttgttgctttttggctgacatagggataaatgttttcttccctgattgccgcctgcttaaatgttgctaatactctgagcatattatttaggtggtaaatggaaataaagcaaatagaaaacaataaacctttctctagaaaataaaattttcttcatatacagcatagttttgatagagaaaagaagtgatacctaaagattctttattgcacattattaacatgtaggcattcagaaaaaatcttatacttatgtatattataaacattgactaagataaaacataacatctgtatatttatcatactaattataaaaaatttattcatctattagaattttaacattagatatctctaggcagtgaaattatgaatgaattttggtttttggcttccacccaagtatttctatcatcaaactttttacaatggagaaatatgttttcgtgctttgaaaataagagaaaatataaacctgtaagtgcactgaaacaatcaagtttttaaagcagaggggagaaattagtgaagatgttataggccacagaaagctcggccttttttattatcatggcactgattctgagtaggctagtgactccatgtattaagattagtcttacatttactaacttcctagcaactttcaggcactactttcacatttattataccaccttgctctctaaatacctagtgaggaggtctcactcccatcttatggctgaggatactgaataatggtaagctgtatgtctaagttcacaaaactcacaagccatagggagtgagttagctctgagcatcattctccactgcaagtttagtgcttttctactatttcactttgaacctagttgtttgttgggtttatattattcagatctggagtacatttagaggtaccctttttccttatctgaaacattaaataatattactactgatatggtttggctctctgtccccacccaaatctcacattgaattgtaacaatccccacgtgtcaagggcaggaacaggtggagataattgaatcatgggagcagtttcccttcatattgctttcctgattgtgagtaagtttgagatctgatgattttataaagggaaaccgctttcatttggtcctcattctctcttgctgccatcatgtaagaagtgccttttaccttccaccatgattgtgtggcctccccagtaacgtggagctgtgagtccattaaacctctttttctttataaattacccagtctcgggtatgtctttatcagcaacgtgaaaaagaactaacacaactacaattatcttgcatgatcccccttaattagtccaagagtgtggggaactagaaggtccaaagtatagtataccttccacacagagcaacaagtgttagacaagtttgttctatgtatctgagactgtgtagaggcagatatctcacatggagttaaccaccaaacattttaacacttttcctctgacagttctctttcctatacctattctccttactgtgaacatgaactgaggcttacatcatcttacaaagataccactaacagcaaatagggttaacattgattgcaaacttacagtatgttaggtcctctgccaagcaatttatattaattacctcatctatcctaataacacaccttaagaaactactaaaatctcactgaggcctagagaagttaagtacattgtgcaaagttacacacctagtccatgatggagctgggctttgaacccagacaatctaactcatactgggtgattacgataagttgtttgtttcccctgaccacattttcccttctgatttgtgtttcaatttttggaaaaattatatttcccaaggtcatcaaactttcagtgctttttaccttcaaatatatcaaatttaaaccaactttaactttcaaaattcaaaccacccaaaacataaccctttcataactaattagctttattacttacagaacaatagcaactattaataccactttgagcagttggcactttgttttgccatgccccaagctaaccattttacatgaataactccatcgactccctatttttcagatgaggacactgaagcttagcagtgatgaataacttgttcaaggtcaccgctcaatatgacccactttgattctaaaacgtttagatttctgcaacactgcctccttctggctaaaaatggagtctctttatcaaatgtctcaagcattctgggattatcatccgtctaactatccagccattcatacaacatttgttgaccacttaccacatatcagaccctgtgctagatgctgaagatatgaagataacatagaacagttgttgcagttgacctcatagaaatgtcagaattcacatttgaggcccatcagggatctccatcattaaccagcactcaaaacccatcaccaaagtgccacacagagtaataccagtgtatgccctttagaagtcatatgtccctcaaaagcctccttcttagatggtctatcttctgcaactactgtgaaacatttctctttcctgtttccatttctaccttttcatttttttcaactttttttcttgtttctttcacaaactacctactgtgcctcaaatactcttcatcatccctctgcctaactaattcatttttaaaagcactagttagccttcttaatgctttaaaatacctagttgtattgtttttataactgaattatgtgttcgtctcctccacctaaacagtacaatcctttaaggcaaggttgttagagtatttttatatccttaggtcttagcatagttcctggaaaattaagtaaacagtaaatccttgttgtgataataaataaatggcttactttcctcaaactttggactttgataccaaaataaatttagaagatattattggaggttttttttaaatttttctaagtgagatcactataatttgcttaacatataacagatataatattcttttttactttgtagctgttgttttgtctatattgaaatatgctatattctacacggcaatgacattattgtctgccatgcttttctaacatatatatatatatatatatatgttagaaaacatatatatatatatatgttttctaaaagacccatacatatatatgtcattttgctctttgtagttgtgactgatctaattctcttatctcactgattcaaacacacttctacagattccttttaattcagacatggtgaagtatgaataaagtttccttctaagatttctcactgctttaaccttctgataatactctgtattatatattgtattctgtttcttacctttttcactcatatatatgtatgtatgtatgtatatgtgtgtgtgtatatatatgtgtatatatatatatacatatatatatatatatatatataatatagcgattacctggaaactgccaaattcaacaaattattcagaaaatcttctctgatcctggtagtttcttcaaagagatctgcagtatacctcccacctaggaataggctagctctagtgctgaagctcactattatgaaagcataattttgtgatataaatatttgtgttgaatgcaaagatactagaatgaatgagagcatatgcacctgagagaaaatgaatgtggcaggagaaataatgaaaatattttctattccgtagtgctttgggcctattgctctgaataattcatgcatttaaatttatcatttgttcattggatctatcacattggtcttattcatgcttaaagtgaaagtatgtgtttaactaatatggtatttctctagtctagcatttctcaaattatgattttagaacagtatttccacaagattcccagaaaggaattcactgggaacaacctagacttccatatatataaaaatgtatgatttaaatatagtaaatgtgcatgatggaatattatgcaaagggaagaataaacaggttagatctttgtacagcaacatggaaagatttcaaaaatataattttgagtgaaaaaggtaagaaacagaatacaatgtataacacagagtattatcagaagcttaaagtagtgagaaatcaatgttagaaggaaactttattcatacttcatcaagtctgaattaaaaggaatctgtagaaagagctaagtgtgttaaaatcagtgagataagagaattaggtcagtcgccaactactaagcatactcaacaacttttcagactattttgttcaccaacctatgcatggcaaatactttctttttccaaagagcaaagtgactttccccactctatattttgtcctttggaattttaaagaacagtcaagatctagaccacacagtgccacaacagtaccctcagcacgaagggaggggtgcccttctctttcttagtgtgtcctcaggcacatcacaaacacatttatatgagcactcactatgtagtggaccctgtttttagtgctgggaagatgacaagcaaagaagcaagttaaagtccctgctcttgatatgtttacatgcattcagggaattaatcattcaaactacttttctctgaaattaatcttttctagccatttctatccctctcaatagtaattcagctcatggtgtaaagcaatagtttctttatttaaaaaaagaggaaaataaaataactttcttttctgttaatatcttaaaattttgaaagtatcatttcttatacaccaacataggacatctaacttctgtgcactcctgaatttgttacaagtctcttaaattacataaaatctaaagctcttctatttcagctaatattcccagttgttacctttttacttattttcttccccgctcccatcatttttttcttttaaaaacagggtctcacctgtctttaaaaaaggacaggggtcttgctatgttgtccagcttatctcaaactcctggcctcaagcaattctcccacctccacatcagctttccaaaacactgggattacaggtgtaagccactgagccttgctgtttacttaactatcatttcttaagtactaagtatatgctgggtacattgttatgaactttacctctattatgtcgtttaatcattatagcagtgttattattcacagaacacagatgagaaaagtagaagagattgtttccatcaaaacccattctattgtatggcaatgctggtgccaacatccctgaaacctgtcatatcccagagcaaagataagctgtcttgtatcttatcagtggtttcactcttttgtgctgacttctaagctaaggatgagcttgagtaattcaagtgtctgtgctgcaaatatctcaaatgacaggccttaggtcaatatgttgttcttagtgagtttaatgaaaagaggcttctcttgttttgatctctgcatatgttatttccaaagtgaaaaatacaggggcaaagcatagattcactcagttcttgtgcctatttacattcctagacaggaaattaaagagtgtataacctcttctggtcaactttcctcttgtttttaacgtatgccttttccacctggtatatcaccatagcctatcgggctacccattctcagacagacacagagcattctatttttatacaggttcatctttaaactcattttctgatatttagtaataaacataatagagctggaaaaaaaaaaaaaacttctaacttccctgactcatttcagatggtatgcttacttgaggaggtttaattgagaaaaaaaatgacatattttctcatttactaaatgcttgaaaggctttgatttaataggtaagtccccacctcaggaaagctggttaggagaagctgcatggtaagaggaaaattcagcctttcaatttcaagtcaatgacaccagacagtctccagagaaatctctgacaatgcattcatcttgattacaattttaatactctttacctttcaattaaacctgcattttctaatcttgtgggccacttaattaatgaactgacaatggccttatttctgcagccatctatctgagtaagtcctgccttgaagaatcgtgagtgcaaaccagtttgagagagaagaggaaaaataaatggtgagttggaattcagcttcactaaacactgccaacaccctcaccgaccacaaaaaagcatcttttaagtttattcttcaaccatttgtgcaaatcaaaaatagcgctcaggaaagcatatggcatggaagcatgctgatttgaccatctagcatttcaattagacaaaattaactgcttcaaaatgctttttttataatgacttccttagtctaggcccctcatttactgtagtttggtgtttcctcctttgaactttaataattcttctagcaattctatttgtaatactcagtggaaagctttggattttaaatctatttttatttgcatataatttcacataaatttacatgtaaaaaaatatgtatgtttttccccaaaccacaggacatactttctagaaccgattaataacagaagtattacatttgagagatataaacaaagcaacaaaaagataatatatttctcaaattttatatctacacttagtatatttgctggtaaaaattcagaggagtctttagaaattcagtttggaaatcatttagtttgggaagaaaggcatatagaaattaatacgtaatcattatatcactatgtatatgcaatatttttattttattatgtaatcaaatgcagtgttaatgacctctgtttttataattgccttctggtctcacatgagcccagggaatgctgtcatccaaaattactgtgcaaaacagtaatgtctcacggtcagccctgggctagacagcttgaaggtagaatcgcctgcataactaatgtaatgtgacaggcacaactggactcagaattttcacaaaaatcattgggtaagatggctcaagttaaaagaaaactgggtttaaattccatgtgcattatattttgtgcccccttgaatttttatgtatctatattctaattagaaagctttttggtctttttcctaaaactgcataatagaagactatgttaacatatcatggtgacttgggggatgcaagcctatttaaaatccaacatgctacaaaagtcattcccttggtagatgtgtacttggatacttagtaacttttgttttcaaaatcttctaatcaaggtacttagaatctttcaaaaagtggatgtttgtggaaatcaaaattgtcaagcagtctcaggctgtctgtccatcaagccatgaatcattcactatgctcctactgaaacgtacctatcttatatcttattcccactctgctttgctttgtggacaccaatttctcaatgtatatagagagctgccccaggtattaggctttctttgacaatagcttgctagagatgagtcagcttgtttttaaaccctggagagccggtactacagattgtttttaaatcctggagaggtcactacagattggttgggaacgtatttggaggcaaggtagggttttctcagtatccccacaatggctgttctgctgcactgcattgcttctgtgggccctagtcacatttgtcttcttgggcccattcatctattaaaaaatatatataatttttaatatatataatatattatattaaatataatatataataaataatattaaatgtaataaataatatacataaatatatatatattaaaaaccatgcagtttttttctttaatggtaactgaaacgtaactcgagattcacctacccaaggctcattttactcattgccctttttctttggaaggcactaatactgaaactaattttatatcagggacaagaggattatcttcaagcataataataaaaaagagagagttctactatatcattagcaaactagcatggcagaagtgattgacattagtgtgatacagtaaaaatactcagcacatttttggagagaatatatcttactgtacccctctgttcctgtgttcctgcagtaattcttgctgatcaaaaatttacattacgactacctaagacacatcaagtgacattctataatgttaatgtatataagggtagagcctatgaggaaattctctagatatcataaaacagttcttaaaagctttcttaaacatgtctctggccaggcgtggtggctcacgcttgtaatcccagcactgtgggaggccaaggcgagcggattacctgagctcaggagttcgagaacagcctgggcaacacagtgaaaccctgtctccaataaaatacaaaaaaattaaaaatatccctcagtatctatggaattagaacatgttacattatttgaacatttgatgacaccatgtcatgtcagtgtgtcctttatcttctattatcgtctcctcatctctctgattgcatctattatcactaacccagggctcacacacctctcaagatgttttctggtgtctgaaatgcaatgatagtataaaacatatttgagaactttttaatgaacccttgcattgcttgttctgagatgctgttttgagaggagcccagctgcctacaagtctgaccagaatccagggttaaagcctgaagtctttcacagattccctgacccaggtgggaaggatgctccctattgaatgaagctcccacctcaccctttgggctcctgctctaagtttgagtggctgccttgttcccatatcctgtccctctgcataatattactagaatgagaaggagacaaacccaacggcttagaaccaagactgaagttactcactccaagtttccttttcctttgacttgctccatctccccttcatttttctccaatagaaaaaaataaaacaaaaccttgttctggtcttattgtatgaaagaagagagagggaggtcatcaggaagcaattctaacagaggaaccaacctacttcttcagccaattaatgctcttgtccttaattctgactcatctttatggaggagagggaaagaatcttcaatctctataaatgcccaaaagatatatttgcttatttgatgcttcatgcatttgtacatttattaaaactcgacattctaagtacattagtacaatcaccaggcccagtaagcattgtagttaaagcatgtcagggctgagtcattgccaaccaaaaactcttttggcaggaaaagccaattttcaacagctctgacagtgtaaagcaggaggcatgtttgacaagatgctgcatattaatttaaaagactttagcatctggttaggtaacacctgctgtggcaaacactcccagacacacaaaatagcattcgagctgaatatttaaatctcccaacatagctcaacaaagctctaactctaaacaaaacaaaacaaaacaaaatcacatctctagcaatcagttataattatataaccaaaaatatttgggctacaacattgtttgctgttcactgagctgaaatgctgtagtgggtgctataaaagttgtaaaatctattgaaacatattttcctgccttgaagaatttaactgtgtacaacatttaaaattgcacactgtagctcagaaaatagcactttgtgttataatatgttatatcaatatacagctaagaagtttatcactggggggtggggggtgaaagcattaaataacagagtaaaagaagcaaaccatgagagagaaatctggaaagactcttctagccactctctctgtgaaagtacatcccagcctaagaattgtagttgtctggcaatagaggcgtatgagagttctggaattgttaggacacactaacatgacacggtgtcatcaaatgttcaaataatgtaacatgctctaattccatagatactgagggatattttttaattactcaattttttatgtcatttactgtagagaaggagcttgcccttgtcagcctagtttggatactggctcacttgacaatgcatttctctctgcaaattttaaaaactgacactttgattatttctctatttactcgacaaaattttattggatgcctaatatgtaggagagcctgtgaaatttttcagacaatacaatgtgtacaatggtgaaaaagacatcgtaaatagaagtaagtgaacaataattacaatgaaatgtgataaacgctgtgatggggttatatccagggtgccccgcatgcacccctgtaggagggtatgtgcgtgaagggggcatctaagatgaaatgtgaaaaatgagtaagagccaggcaaaatgtatgttgaatgaaaattcttccagataaagggagcatcatgagcaactttctaagatccaaaagagcctaagcatactaaacctataaaattcttacagaaatacatagaggtaaatctttgcaatcttggattaggtaatggtttcttaaatgtgacgccaaaagctcatacaacacaagttaaaatagtccagactccatatgctatgactgaattgtgtcaccaaatgcatatgttgaagccctaatccccaacatggtggtatgtggagatgggaacgttgggaaatcattaggtttagatgaagtcatgagtgtagtgctctccagctgggattatttcccattttagaagaggaagggacaccagagctctctctctgctatgtgagggcacagcgagaaggcagccatctgcaagccagaacgaggtctcagcagaacccatccatgctgaaactctgatctcaggtttccagcctccagaactgcgaggaaatatatctttgttgattaagccatccagtctatggtattttgttatggaagccagagttaattaatataccataaagttaagatgtttacacttcgagtagtatcattaagaaagtgaaagacaatccacagaatgagacaaaatatgagcaaactatatatctgataaagggctggttgtcaaaatatataaataactattacaattctataataagaagacaaataaccaaatttatacatgaacagataatctgaatacacagctctctaaagataagtagccaaaaagcacatggaaagctgttccacatcattaatcgtcagagaaatgaaagtcaaaagcacagtgaaatacaatttcacataacctagaatggctataatcaaaaacacaaataagcattggcaaagatgcagaggagcctcatacactgctggtgggagtgtaatatggtgcagccactttgcaaaacagtttgtcagtttctcaagcggtaaaacatagagttatcgtatggtctagcaatttctctactaggtatatacccaagaaaattgaaaacatatgtccacacagaatcttgtacatgaatgttcatagcagtgttattcattatatctaaaaggtggaaacaatccaaatgttcaacagtggaggaatgaatttttaaaatgcatatacttttttgttgttttatttcatatcgttttattttctgtgataagaacatttaacatgatatctgacctcttaacagatttctaagtacacaatacctaaattgtaaaccaaaggcactatgttgatcagtacatgtctggaacaaactcatcttgcacaattgtaattttatacccattgaacaacagctacccacataccccttcccccatctgctggtaaccaatgttctgttgtctacttctatttctgtaactattttagatgccacatatgtgaggaatcatgcagtagttgtccttctgtaactgacttatttccctcagcacaatgtcttccaggtcctttcatgttgtcacaaatggtaggatttcattcttcatttttttgtctttcctttatttatttatttatttatttatttatttatttatttatttatttgagacagagtcgtgctctgtcttccaggctggaatgcagtggtatgatcacaactcacaacttactgcatcctctacctcctgagctcaaggggaatccttccacttcagcctccaaggtggctgggaccatagatacactccactactcaaaggtagttttatttttatttatttatttatttattttggtaaaaaagagatctccctatatttcccaggctggtctcgaactcctgggctcaagggatcctgctgcttcagcctcccaaagtgctgagatttcagccatgagccacagtgcctggcttgggtttcctttttttttttttcaagggtgaataattttctattgtttgaatatatcacactttctttatccattcatctattgatggacatttaggttgttttaatttcttggttattctgaaaaatgttacaaaggacctaggggtgcagatgtttcttcaagattctgattttaatatctttggttatatacccagaagtgggattgctggatcatatgctcatcttatttttaatttttttgtgaaacctccatactattttccatagtggctgtaccctattacatttccaccaacagtgaatatgggtttcaatttctccacaaccttgccagcatttgttttcttttgcttttcatttttgaaaatagccattctaacaggtactaggtgacataaggaaatttttgaggtgatgaacatgtttattacctgaattccattgtggtgattgtaacatgagtatatacatatgtccaacctcacaaaattgtatacattaattatatgaagagtttttttaaacaaatacacacaaggaaatattattcaacaataaaaagaaatgtagtatacatgctataatatggatgctccttgaaaaatatgctaagttaaagaagccagtcacaaaggaccatattgttgtatgatcctcttaatatttaatgtccagaataggcaaatatacagaaacagaaaatgaattagtggttacctagggctaggggagttggagagattggaggaggtgagagctaaggagctctggatttccttctggggtaacaaaaatattccaaaattaattgtgatgaggatgcacaattttgcgaatatactaaatgccaatgaattgcatttttaatggctgaataaaatggtatgtgttgttgcaataaagctgtttaaataacagtagttcagtttggatggaatggagggtaagctatgttagttattttggtctttggtaaaaggcaataatgggcaccatggaaggaatttaggcaggtgaatgacattattaactttatcttccttattattagtttagcaaccactcaaggaaatttaaaacactaaatttctggacttgccagactaagggccagactctggacctcaccaaattcatcaaggtaatgtaaccctgaaatattctttttagtaaccagtatgcttgtggacacttaattcttttaacatcaatagcatttattgattgttgccattggacccatccttatgaccatcttaacatctccttccccagcaaaaaaacaaaacaaaacagaacaaaaaaaactaaaaacaaataatgcttcacattaaaaatatgccattttctctcctgttcctaggggacttcccttgctatgagtatcttgctggtcagtagaagcagaaagaatctcagatgactctgctttcttgggaagcactttgtaaaatacaattttcaaaaagaaaaaatatataaaattactcacatattatcttaatctttgcaattattcataagcagtttgcaaagactcatagtaggaataactcttgaattctctctatcctgtagctatttactcatttatggaacaagccttgtaagtattgaattgctacagaaacatatatgtacataaaactgcatgtagggccgggtgcggtgactcacgcctgtaatcccagcactctggggggctgaggtgcgtggatcacctgctgtcaagagttccagaccagcctggccaacatggtgaaaccttgtctctaccaaaaatacaaaaattagctgggcatgatgtgggggcgcctgtaatctcagctactagggaggctgaggcacaagaatggcttgaacccgggaggcggaggttgcagtgagccgagattgagccattgcactctagtctgggcaacagagtgagactccacctcaaacaaacaaacaaaaaaattccatattggtagcaaaatatataactgggtatataacaaattgaatttttgctattttataccatcttcctacagcttcatcagataaaccacatgtgtgataacactctgtactccttcgcctgagacatgaaattatcatgacatttttcctgaagcagccgcataatattccttgatgctggactttaggcagcaactacttaataacccaaactggcacccaagatgaattttattggccatgctgttctggaattgtaaattttttacatctccttcaaaatataaagtatagatcatagtccaagttagaaaaatatcctaccaaaaattgtccaactgcagaaccatgactttgcttattatttacttatatcaataaattacattagaatgattgactgttgtccatgttatgcacagaaatcaacataagataatcaccttatttgactgcagggccatagcattccttactcatttttatttatgtaataaataatgttacctgggaaaatggaaaaacggctatgtgtcaaagtgtgtattcagatgttctttcttctcacatttttctttaacaatatatttcaagagaaagactatatttcaagtaagaactccaatctttttttaataggaaaaaatgtttaacaccaaggtaggaaaatattctcaacatttccttcgtgtagaattgtattctttatttttaaattttaattaactaatttgttttgagatacagtctcaccacttcgtcaagcaggctggagagcagtggtgctctctcggctcactgcaacctccacctcccggtttcaagcaattcttgtgcctcagcctccccagtagctggaattacaggcatctaccgccaagcacagctaatttttgtatttttagtagagacggggtcttgccatgttttttgggctgctctcaaactcctggcctcaagtgatccactggcctcagcctcccaaactgctgggattacaggcatgcaccaccacacccagctaatttttgtatttttagtagagatgaggtttcaccatgctggctccactggtcttgaacccctgacctcaagtgatccgcctgtgccagcctcccaaagtgctgagattacaggcatgagctattgagcctggccctcttgtggagtttaaaatttttcttttaaacaatcccaaatttgtaaatacatactagcaccagtatcattttgttataacttaactgctgtgaaatataattattactttttgactgtattctttaaaaatcctgtaatacacttcataagcaaaaattgttattatttctaaatgtttttccatgaattaaagaaggtttagccttcttctaatgaactataagtttgctaattttgccctattgttttgtatagatcactcttagaatcatttaggtgataaagtcactagcagatacaaaagagggactctgactgactgaaaaatctagatagatgttgaaaatgtgaattatttataatagaataatacacaacacaaaaataaaatggtattttaagattaatgagatttctaggtgaattatttccaattttaattattcatactactctttctttgatttttgttagtaatcttggatagtcaatcttcagatcccactaagacagaacactagaagctttaattctattctgtcatacaaacctctgtatctagatgataaactctgtgagaaccagaactaaaactttctggccttcgttattttgccagctccttacatagggcctgaaatagagactgtgtatttgttaaaggaccatggtaaaaggatcacatttagtaactaaagtttgatgcagattagtaagcatttttatttaagtaaaaataagaacaaaaaatttgttcctgataaacctattggtgaatgaatcttaaaacatggcatatatgtttcattattttaaaactgttattctgtaaacattttaaacttattttatataatgtgttttataattttaaaattcgagaatacaatttgctatttattatttctcctgattctagcacaaggaaacatagttcttcccgtgattttaaatattgacttgcaagctcatatttggttattttaatccgttgagatttcttctgtaatgtccacctgaaggcacttcagagagaatatatattttccttctgctaggcactatgaatcaaggactactttaagttgaaagggttaaaaatgtgaacgctgatctttttgttattgttgttgttttgagacgagtctccttctgtcgcccaggctggagtgtagtggcgcgatctcggctcactgcaagctccgcctcctgagttcatgccattctccttctcagcctccagagtagctgggactacaggtgcccgccaccaaggccggctaattctttgtatttttagtagagacggggtttcaccttgttagccaggatggtctcaatcacctgaccttgtgacgatcatttttaaggacagcaatgtggtaactttttattgtccctccaccttagctcaagcttatattaatggtcaaactgatgtctttttgttgatgataagtttcttctaggctagtctatgtctttcagagtgaagctcctcagaggctctggacttatgctgaagttttagtttgacctcctttcattcctcaagtttctagttcctggaatcagcaaatatctacagggtgctccagctttcagaatacactctgctggtttttaatgatttggtttttcatgaaagtgatgttgagagtttaaaagcatttgtgttgcatttagtctaggtttttgtagtgagaagtctttcagactttcctatttgccacacagtctaaagcagaagttgaatatgatgaaatatttatagatgttaagctccaatactgaatattaaaagcaattcaagccattgcagaatcatccctgaaaatttgtatttattttctctctgccagttacctagtttgtgagacacatgattaaatgtgacataaaaattaagttcataaagaaaaatacaataaatctatatttatatcacataaatatgaactgtaaaataattcagtcaactaaaacagattcacatttcaatagtgaaagtgctctctgttaagaagtttggtctgcattgtggaagacagtgtggcaattcctcaaagacctagaaccagaaataccatttgacccagcaatccaattactgggtatatacccaaaggaatataaaccattctattttaaagatacatgcacacaagtgttcattgcagcagtattcacaacagcaaagacatggaaccaactcaatgcctatcaatgatagactggataaagaaaatgtggtgcataaacaccatggaatagtatgcatccataaaaaggaacgagatcatgtcctttgcagggacatggatgaagctggaagccattatccacagcaagctaacccaggaacagaaaaccaaacactacatgttctcactgatatgtgggagctgaacaatgagaacacatggacacagggaggggaacacacactggagcctgtctgggtggtagcgggggaagggagagcatcaggaaaaatagctaatgtatgctgtgcttaatacttaggtgatgggttgatgggggcagctaaccaccacagcacacatttacctatgtaacaaacgtgcacatactgtacatgtaccctggaacttaaaataaaatttaaaaaaagaaaaaaaaggaaatttagtctgaagaagaaagacaaaacctcaggattgagagaaaaggaggagagagagctactttcaattatttgaaaaggctttcacctggaaagcctttgacaaagttcctttgacagagaatgattatgaagaagtcaggaaaacatatttttacaaaatgatatattccaccatttgttcattgaatattttgaaagtgatggccatgtgtgaaaatctgtgctggtcttgtgccggtcttcaaagggaatgcttccagcttttgcccattctgtatgatattggctgtgggtttgtcataaatcgcttgtattattttgagatccattccatcagtacttagtttattgagagtttttagtatgaaggaatgttgaattttatcgaaggccttttctgcttctattgagataatcatgtagtttttgtcattggttctgtttatgtgatgaattacatttattgatttgcatatgttgaaccagccttgcatcctaggggtgaagccgacttgatcgtggtggataagctttttgatatgctgctagattcagtttgccagtattttattgaggattttcgcattgatgttcatcaggaatattggcctgaaattttttttttttttaattgttggatctctgccaggttttggtatcaggatgatgctggcctcataaaatgagttagggaggagtccctctttttctattgtttggaatagtttcagaagggatggtaccagctcctctttgtacctctggtggaattcggctgtgaatccatcttgtcctgggctttttttggttggtaggctattaattactgcctcaatttcagatcttgttatatgtctattcagggattcgacttcttcttaggttagtcttcggagggtgtatatgtccaggaatttacccatttcttctagattttctagtttatttgcatagagatgtttatagtattctctgacggtagtttgtatttctgtgggatcagtactgatatctcctttatcattttttttattgtgtctatttgattcttctctcttttcttctttattagtctggctagcagtctatctattttgttaatcttttcaaaaaaccacattctggattcattgatttttttgaaggattttacgtctctatcccttcagatctgctctgatcttagttatttcttgtcttctgctaggttttgaatttgtttgatcctgcttctctggttcttttaattgtgattttaggttgttcattttagattttagatctttcctgctttctcctgtggacatttaatgctataaatttccctctaaacactgctttagctgtgtcccagatattctgctacattgtgtctttgttcttattggtttcaaagaacttatttatttctgccttaatttcattatttacctagtagtcattcaggagcaggttatccagtttccatgtagttgtgtggttttaagtcagtttcttaatcctgagttctaatttaattgcactgtggtctgagagacggtttgttatgatttcctttcttttgcattatctgaggagtgttttacttccaattatgtggtcaattttagaataagtgcgatgtggtgctgagaagaatgtatattctgttgattcggagtggagagttctgtggatgtctattgagtccacttggtccagagctgaattcgagtcctgaatatccttattaattttctgtctcattgagctatttaatattgacagtggggtgttaaggtctcccactattactgtgtgggagtctaagtctctttctaggtctctaagaacttgctgtataaatctgggtgctcctgtattgggtccatatatatttaggatagttagctctacttgttgcattgatccctttaccagtatgtaatggccttctttgtcttttttgatctttgttggtttaaagtctgttttatcagagaccaggattgcaacccctgcttttttgtttgtttgtttgtttccacttgcttggtaaatattcctccgtccctttattttcagcctatgtgtgtatttgcatgtgagatggttctcctgaatacagcacaccgataggtcttgactctttatccaatttgccagtctgtatcttttaactggggcatttagcctttacatttaaggttaatattttcacgtgtgaatttaatcttgtcattatgatgctagctggttattttgcccattagttgatgcagtttcttcatagagtcgatggtctttacaatttggtatgtttttgcagtggctgatactggtttttcctttccatatttagtgcttccttcaggagcgcttgtaaggcaggcctggtggtgacaaaatctctcagcatttgcttgtctgtaaaggattttatttttcctttgcttatgaagcttagtttgactgaatatgaaatctgggttgaaaattcttttctttaagaatgttgaatattggcctccactcttctgcagagagatccgtggttagtctgatggacttccctttgtgggtaacccgacatttttctctggctgcccttaacattttttctttcatttcaaccttggtgaatctgatgattatgtgtcttggggttgctcttctcgaggagtctctttgtgttgttctctgcatttcctgaatttgaatgtttggcctgtcttgctaggttggggaagttctcctggatagtatcctgacgagtattttccaacttagttccattctccccatcactttcaggtacaccaatcaaacgtaggtttggtcttttcacatagtcccatatttcttggaggctttgtttgttgcttttctttctttttttctctaatcttgtcttcacactttatttcattaagttaatcttcaatctctgatgtcctttcttccacttgatcgatttcactattgatacttgtgtatgcttcatgaagtactcgtgttgtgttttttagctccatcaggtcatttatgttcttctctaaactggtcgttttagttagcaattcctctaaccttttttcaaggttcttagcttccttgtatggggttggaacatgatgctttatctcagaggagtttgttattacccaccttctgaagcctacttctgtcaattcatcaaactcattatctgtccagttttattcccttgctggtaaggagctgtgatcctttggaggagaagagacatattggttttgggaatattcagtctttttgcacttttttcctcatcttcgtggatttatctacctttggtctttgatgttggtgaccttcggatggggtttctgtgtggatgtcctttttgttgatgttgatgctcttcctttgtatttgttagttttccttctaacagtcaggcccctctgctgcaggtctgcttgagtttgctagaagtccactccagaccctgtttgcctgggtatcaccagaggaggctgcagacagcaaagattgctgcctgttccttcatctggaagcttcctcccagaggggcacctaccagatgccagccagagctcagctgtatgaggtgtgtcctctcttaccactcctattcaacatagtattggaagttctggccacagcaatcaggaaagagaaagaaataaaaggtattcaaataggaagagaggaagtcaaattgtctctgtttgcagatgacataattgtatatttggaaaaccccacagtctcagcaaaaaaatctcccgaagctgataagcagcttcaacaaagtctcaggatacaaaaccaatgtgtaaaaatcacaagcattcctatacaccaataatagagaaacagagagccaaatcatgagtgaactaccattcacaattgctacaaagtgaataaaatacataggaatacaactcacaagggatgtgtaggacctcttcaactagaactacaaacaactgctcaaggaaataagagaggacacaaacaaatggagaaacattccaagctcatggataggaagaacgaatatcgtgaaaatggccatactgcccaaggtaatttatagattcaatgctattcccatcaaactaccattgactttcttcacagaattagaaaaaactactttaaatttcatatggaaccaataaagagcccgcatagccaagacaatactaaacaaaaagaacaaagctggacacatcatgctacctgactgcaaacgatgctacaaggctacagtaaccaaaacatcatggtactggtaccaaaaaaaatacatagaccaatggaacagaacagaagcctcagaatatgccacacatctaccactatctgatctttgacaaacctgacaaaaacaagcaatggggaaaggaaatccatacttcatcaatggtgctgggaaaactggctagccatatgcagaaaactgaaactggaccacttccttacaactcatacaaaaattaactcaaggtggtttaaagacttgaatgtaagacctaaaaccataaaaaccctagaagaataactaggtaataccattcaggacataggcatgggcaaagacttcatgactgaaacaccaaaagcaagggcaacaaaagccaaaattgataaatgggagctaattaaactaaagagcttctgcacagcaaaagaaactatcatcagagtgaaaaggaaacctacagaatgggagaaaatttttgcaatctatccatctgacaaagggctaatatccagaatctacaaagaacttaaacaaattaacaagaaagaaacaaccccatcaaaaagtgggcaaaggacatgaacagacacttctcaaaagaagacatttatgcggccaacaaacatgaaaaaaaaagctcatcatcactgttcattaaagaaatgcacattaaaaccacaatgagataccatctcatgccagttagaatggcaattattaaaaagtcaggaaacaacagatgctggagaggatgtggagaaataggaacgcttttacactgttgttgggattgtaagttagttcaaccattgtggaagacagtgtggcaattcctcaaggatctagaaccagaaatatcatttgatccagcaatcccattactgggtatatacccaaaggattataattcattctactataaagacacatgcacacatatgtttactgcagcactgttcacaatagcaaaggcttggaacccacccatatgtccatcagtgatagacggataaagaaaatgtggcacatatacaccatggaatactatgcagccataaaaacggatgagttcatgtcctttgcagggacatggatgaagctggaaaccatcattctcagctaaccaacacaggaacagaaaaccaaacactgcatgttctcactcataacggggagctgaacaatgagaacacatggacacagggaggggaacatcacacactggatcctgtcagccagtgggggataggggagggatagcattacgagaaatacctaatagctgtagctgatgggttgatgggtgtagcaaaccaccatggcacatgtgtacttatgtaacaaacctgcaggttctgcacatgtatcccagaacttatatatatatatatactgtgctgggatcacaaagaataaactgtgttccagtgctaaaattctgcttacagtttaagaagacacaatttcaggatatactatgatacatattatttgtgataaaaattgaattgtgttttataaatgtgagatagaataattctgccacaacagctgtgcatattaaaaagttatgtagaaccctacattaagcaattcatcattgctggcagaactgcaaaatggcacagtcactttgaaaaatagcgtagaatttatttgaaatgttagagttaccatataacctagcaattccacttctagttatacatacaaggtaaatgaaaacacatgtctataaaaaagcttttatatgcgtgttcatagtagcattattcataatagccaataaatgaaaacaacccaaatatctattaactaatgaatggataaataaaatttgtacagccatgcagtggaatattaattggcaatatgaagaaataaagtatttataagctataacaaagattaatcttgaaagcaaaagaccccatattgtaaaatttcagttacagtatatgaaatgtccagaacagcaaatccatagaggaagaaagtagcctggtagttgccagggccttggaggtggggcaagtggggaataattgctaatagatacagagaagagggtgatgcacatgatctaaagttagatggtggtgaaggttgctcaactctgtgaataagctaaaaaaaacactgaactatacactttaaaaggtgaattttatgctatttttttttcttaatacagttgttatgaaaaactgtaaggaaaaaactatctaaggtatttaaaaatcaaaatggaaaataactttcatagaaggttctatttctgaagtttaatattttcaattctataagatatatatttcaattttaatgaaatttctgctgtacacttgggaacttataacattataaatgtaatcatttcaaagtattttatagaatcacccttctcccccctcccttttttttgggtttggtgaccgataaaagtaaattatttcttgcccttgtgcagaagtttgaagtatccctcggggtaggaatcacttttaaaatgtcctactgtttcactgatggtgctgtattcttaaaggacactgacaaaaaaataatgtggcattacctgggcgaaggtcatttccttattaataattctacaatatcctggtactttcagagtttcatttttctgccctatgaaagaccaaataaaaagcctaaaatgctgacagaatagaagtcaaaaactcttgaggtggctgtaatggacaaataaaaaaaaatagtccacactattttgagtctggcactatgctagacactttggaagaaggggtggttttaaccacagtgatgctgattacctagtggggaaaacaaagcacgtaaatagttatatacaatgagacagaggctagtgatgaagatgtgtgcaaagtgttctaggaacactctggaggaggtgggattaatggtgactgtgggaggcagaaataccctcaaagatattaatattttcatgttgtacaataatattcaaaatttttccaggcttcatttgccataatgaatttatacaattaaaattcacattctgtaatttaagtatactcccatgaattcacataatagcactattcattagagtactacggaaatgaattaccattaatattgagaatatacatgctaggccagacccttattctagcaagagaagcatttgaccaaacttgatctcagcttttaaatctctactttggcataatttaaaacttcatatgttaaatatctttcattaaaataaaaatagcattgctaattttaaattcccatatttctattaaggctataagttgtgatgattttcatataactaattttggagatgaaatttaactacatgtatcaaaatgttttaaaatgttttctttctttgaatcagtaattcaaagaaagtgattcagtaagtgatatgataaaattaacaatataatatatagctacaatataattatttcaaggatatttagagacataagaaaatgcttattttatatagtaggtgaaaattataggctaaaaactactttaaaattaatgattcaaattatttttaaggccaaaaggaaatcactagcttgagctatatttcaaaaagccagcctagtaaatgagtatagggattatgaagtttttgcttgtcttcaaatttctaattcaaagtgatacttccataaatgtgaacccaatgcattatctagtcaatatatgcacttttaagaagacatctcattttattttagttgttctcttatttatatcgtttttgtacaggttatgtttttcttttcatcatcatttagtctttttttaactccttaatacactttatataattattcttacatattacatactcaataaatatatattttttaaaaatccttaacctataagttagttgcacctgtgtcacttccaatatatttttcctctagtgctaagaaataaaagagtactttccccaaataactcactcagatatacaactctcacctcaaatctgtcaccccttttgtgaatgaaaaatatttattttaaaactctgtgctctattaacttcagcctagatctaaatgttgtgtgctagaacacaaatgaatcacaagttcacatgaaaatttgttttaataaaggtatttcaaattttgtgcaagaaatgtataacacaagtcacaaaatagtaaacaaatcacttaaaatataagtttctatgagacgataaaatgtaaatttttgccattattgattgcaaaatatgaaagtctgaaactgcaaataatttgacaccctttatttaaggaacattgaatgttaaatgtataataatataagcgacataatttttggaactaaatgacttggcaagttccattaaaacagactaagtaccccatctgcaattaaatttattaaattataacacagataattccagcatatatgaggtcattctgaaagaacattcctattttgactttacttttcatttagctcattgtacacaatctctgatatattatcatacatttttagcgttataaattaatttttaaatgaaatgtaacacataggattaatagtaaatataatttcactatatttcaagcactgttctaggcacttaatatgtatcagcttattgactataaacaataaccatatggtgttgctaccatgatgatcccattttacatgtagggaaatagtggcacaaagagtttaagtgattttctcagtgccttacatgccttactgtcttatgtggcagaattagtactcgaacccagctagctggtaacaaaagttcagtttaatcactaagactgtacttctactttcattttattattataacatgaacattgcaacataaactaatatgccatgcagaaaactttcaggatattaacacatataaaacatttaaaaacatagtatttctagaaattatattattgatagaattttcaggtacaaattgccttaggaaaaaattctatttatgataaacatatgccaatttttttaactgcagatttttagtgatagatctattcaataaatttgcacaaagattttcaaatttagatgctggatatttaaatcagcttgtcattacatcctaaaactaataagtatgccatgctttatccatgtaactcatatcatcaacagtaggacatcagccacacaacttcagtttagaaaagtagtactcatatccactcttggctgacagtaatcattaaaataataatagatgataacattttttagtccacctcaagaaataatttttatataactgtcaactccaattttttgatgaggaaataaaaatgaaactaaaagaaaaatataagatcttaattgaacctgaaaacatatgccaatcaactccatccccttcttatagtcaaataataaaccatataaagccttggtaccagatttcttttaaaaatacattaatccctttgtttactcaatgcatatttacattttgcaaaacacggtgtgatttctgtccttagaaagtttcccttaggaaagaaaaacacgtgatcatgcatagcacagtgtgttaagctttggagcatctggaacctcaatttgccttgactggactggcctagaatatccactggagtgagttggttatctgtctatttacatgagggagaaaggtgacccctggaaagacgaagtagcaaggaggttaaagtctccagctctcgaagcaactgcttgttatttgaattccagctccatcttttttagctgtgtgttcttgggaaatttagtttaccttttttgtgttttatcttattaatctgtaaaacacggataacagaaacaagcaaagtcttactgggttgttgtgagacttaactaagttattcaggttaaatgcttagacaagtatgagcacttggtaagtgttaacaatgaattactattattattattattattaattactggaacaaactcaaagcttgtatttttaagggtgggagggccttgtcactggcgattctaggagtaagctgtatgtctccaagtcctgccaatctataggtaccgatattgccacatagcagtggcaataatcagcttccatggctgatatctcacacccatgctttcagaattctatcaggcccactcttaggattctttcacagtcaattccagttatttctttaaggcaagaaacaaacagtgtaggcataatatcatgaaaatgacagatgtttaatggccattgtgatatctgaaaaagctgacaaaactatatggaaagaataattaatataaatgaccatagaaggcaaaagaaatatatcatatttaaaggtaatctgaaatgtgtgtgaggacaatgaggcccataatctgattttatgtttaacatctgcatttccatttaattttgtattcattatcacttttaaagtattgatttaaaaagccatgtaatatagttagttagtggatacattagttgtggccgataattcctttatttaaaccagagaaagtagttttcctatgtaacattactatacataacagttagggaggtttgatggtctatatttcattgtctgttcctgttattttattattccagtttcttgttatatttgcctttggagaatagaatcagacaaacatgaaacctttgtcatatacagaataggaccataataaagccagaatgaactccgatttttattgacaagtgagtaaagtgtactacgttctcatctgtttcctctctctaccaccacaattcttttcacctgacattttgccatttttgggaggttttcaaggatcatatcctatgcctccctgctctgtcataacaggggatttcactgaagttacccccaacacacacacaaacacacccacagagagacaaaggacaatacaaagctatctccctctctttctgtcaccatatccattatcatggcacctgatactatctgagtgaattctgtcactcactcaaaagcccacgggccttacagcctactcttaagacactgattttactaattttgcattgtttcttctgtttaaggtgctcttccttgccctgtctatttggaaaactcttcttcattctttagggctttgatgtcacatcccctattctaggaagcctatgatcttcagacaaaatttggaaacctctcctcaggtttcccattgatgagaatatatatttatggggctataattttttgtacagttgtctagttcccacacgagaacacatgactctgaagggatggatggtcctttcattttaaccttctcacaacaatgtttctgaaaagggcagggtcttaatgtgttagaatgaataagctacctaatggaatatatgtatacaattaggcacagcgcaatgattctatgactgcaggttagccacataaacaagtatctgtcctatttcgacaaattaggccagatcaccaatgcccaacttttcttggaccagatataccatttaccatattctcaatatgtgctgacttggtaacattgagagatacaaaaataataaactacagtaattggaattattaatgactcaggtatttcattaattttaggcaaagtatccttaaagcattggaaagagtttaaaatttagttccctagttgctcagtattctaatatctatttctgtatctatatatacatctaataatatatatgggtgtatatatattattaataggtaaaatattcataatagatcattattttttaagtatttcacaaaatgctttggaaggaaccgtaaaactcaagatgcattccctatgatcaaggacattacttttagctttctttatttgaatgtttgcatttgcacatgtttcaatgcacctgttgaaagcaaccaaaataacacagagaaaaatcattagacagttttgattatgaactgggagaaaaagaatgtagtttaaaaaattaaccttttccctacttttctcttagttaccatactccactgccacacagtacagaaaagaaaaaataaatctatctttgagaaatgtttcattttcacttgaaatgatgcaattagtcactgctccatatatttgtgtttgaaacgtttctatcaagtataatcttagccagagcaccctatagtgtacaagctatacatgaatagtgaaagtattgtatttgttatttgaaatgtgtcgatgcagcacacttaattcaaaacatttatgagtggaggttgacaagtctgtccttctaactcttatggcataacttactatttatatgctacctgtatttcaagatccattctgtgttctaacactatagagaaggccaattgaatattccctcagatagaaatgaaagttctctctctgtccatctatctatttttctatctctttttcttattattacaatctttcttttgtatgtatccacttaacccattgtaacattttccccattataagacctagcattcctcctcttattaagaataaacaccttagcagtattggctacatggctgatgttgaattaagcgaattaagttgttggaaacacacaattcaaatttactatgtttgtgaatccaaagataggtttactcgtggagttttaggagttataaggtcagcctttggaaaattctgaattcgttttttaattatttcctgcgaatattgctttgtaggatatttctagaaacgcaacccactgaaaatagccaatctaaacattacaatctcagcataaacatttgcctcagtggaagtccttaattaccaaatggagagaaatgcatgcaggctgtcagcatcatgtttctccttggtagtgtctctcaccattttgccaccacgaatgtttctaaatggccaacatactacttcttctcatttgaatgtttatgtttgagaaaatgcaaaaataagagcactaagtgcaaacagaggtttgctgaagtttgtgtatttagctcctatggcgttctggatgccagattcacattcattagacataaattgatgttaagcagccttgactgcaggaggaaaagcaacaacaaaaatctcttcatacctctaagactttcagtcagattcttttcttacagaaccccattctgccattccagcacactgttttctgttcagtcttatcagtcttttcctgctttattcttgttttttgactgctgtttatgccacttaggcatttgcttatactggtccccatagattttcctcctgtttaacatcacaatggactcaactttctttgaagcatacctcgtctatggaagcaaatgacatcctaatttgttaactctaaggcattacagaactttattccttcaaggcctctaactttacttttggccttatcttctgccatgtcccatctgaacacaatgctgctttcacctgttcctttatactctccaggaggactgtgcaattgttttccttctgcctgaaatactctgttctatgtcatcttctgagataaggcttcccttttcacccactctacagtaggtttctgcaactcatttttaccaattatgatctctctctcctctcatgttttaagacagttaccttttaatgtttctggaattactttttttgtttttttgctttgtctccactgtattgaaataattgccaatccaggtttcttactttcaaaccttcttatatttaattcattttacaggtaggttattacttatcacaaatccttgtttggacattttatttcctcatctccatttatttcctcattctccccaaaaaaagtcaccccaccatttgataaatccctcatgtttagaggataaaatgaattgtctttatttattgctagagagtgaatgtgaaccctcaaaattcatttgttgaagccctaagcccgatttgatgggaatttgaggtggggcctttgggaggtaattactgttagataaatccatgagggtggagccctcatgatgaaaagaggagacatgagatattgcgctctctctctgtgccacgtgaggatacaataggaagcagactctcaccagacactggatccaccagtgccttgatcttgaacttctcaacctccagaattgtgagaaataaatagctgtttaagccactcggtccatggtatttttgtcctagtatcctaaattgtcgaagacagcactttatcaaggtcatcatgtactagtctttacctatagccctaaaccaaaatgtctaatacttctctaaaaggaacactctgcttcagggaagaaagaatgtttacaacatttctgctgttcaatttagcctcacatcatttctcttgcctggaacattatcttattcacccttcaatgtttctaaatcctatatacttaatttaaggcctagttcaagttgtagtacttcattgaatacttctccaattgataatctttcaatttttattcataattacaagatcgaggcagaaagagttttgtgtgcctgactttgtagacttagtaaaaatagcttcaccatttttttttaggaaataaaagcataatgtaagtactacacggcttatgtttgatataataacatctgcacaaaaaaacccacaaaaagtctcaattactctttttttttcaaaagtttatcacattccttcatgcatttactaattcaaacacatttataggtttccttgaagaggtccaggcattctgccagaaaatgggattatagtagcagactaaatttagtcaaaacagatcaaactccttgcccctagggagcttacatccttgcagggatgatagtggggttggagaggaagacattaaagaagacagacaaatacagagtgtgttacatggtggtaggtgctatagagtaaaataaaacggggaggggtggagctgcaatctagatagagatggcagaaaacacttaggaggagtgtggcatttgagcaaaggcctaaagacagcaagggagtaagacatgtgagtagataaggggtagttggaatatttcagagatgacagagtacttgaagcagaaggagccatgaagaggagaccacatctcagaggtaacttaggactcaagtatgcaggactctatgggctattatgagaacttggcttttgggaagcaaatggaagatttagagcaaaaattgacatggtcagatttctgtataaatgtaatcctttcagctgctatttgaggaacagacttaggtgaggcaaaagaggaagtaggaaaatcaatgagaggactattgaaagaatctggaaaaagataaaggtgacttgaacctaagtgttagctatggaagtgattgaagtagatagattatgcatatgttttcaagataatgtcagcaggttgaacaattatatgtgggtgagagataaagaggaaagtcagagatgatggaagatgactcagagtttttgccaaagcagctggaacataagaagagagattggaaaaattatgagaaaaggtttggaatgggaaagggaattaggaatcagtttttgatgcgttaaattgagatgtcaattagacaactaagttaagatacacatttttggtgtctggagtttgggagaagggtccaagttggagacgctaatatagaagtcatcatttataaaaaggtacttaaatctctaattcagcccaaattgctaaaggtatgagatagacttaatacacagagaagaggttcaaggactgagtcttggtacacttctcagtgttcagatgctgggaagacaagaagagagctaatgaaagatactgagagagtggctattacagggatgggaaacaccagagaagtgtgttactgggagcctggaacatgttacaaggaggaagttactaactctgagaaatagccctgaggacttaaaatctgtcaccagatttggcaacacagaaatcactgatgttgttaatattgtcaggttcactgaagagatagggggcaacagcctgggaagatacagaagagaaaaattggagataatgggcattcaaaactttttgaatcactttgctgtaaaggaactgatagaaatcaggatggaaggtaactagtagcacagatggaattgagtgtgtgtttgtgtgtgtgtgtgtgtgtgtgtctatatatatatatatatatatatatatatatatacacattggaaaaaataacagcattttgaacatagaaacatagatgaaggcaggtggggagatatgatgttcagagatgctgttttctcagagaaagaagcagagtcaataagaaaataaacatgaaaaagttattattagaaatttcagaaaaagcaaagttgaaaaagtgtcatttaggttagacctaaaaccataaaaaccctagaagaaaacctaggcattaccattcaggacaggcatgggcaaggacttcatgtctaaaacaccaaaagcaatggcaacaaaagacaaaattgacaaatgggatctaattaaactaaagagtttctgcacagcaaaagaaactaccatcagagtgaacaggcaacctacaaaatgggaaaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagtcaaaaaacacatgaaaaaatgctcaccatcactggccatcagagaaatgcaaatcaaaaccacaatgagatatcatctcacaccagttagaatggcaatcattaaaaagtcaggaaacaacaggtgctggtgaggaagtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatttatgtttattgcagcattattcacaatagcaaagacttggaaccaacccaaatgtccaacaacaatatactggattaagaaaatgtggcacatatacaccatggaatactatgcagccataaaaaaggatgagtccatgtcctttgtagggacatggatgaaattggaaatcatcattctcagtaaactatcacaaggacaaaaaaccaaacaccgcatgttctcactcataggtgggaattgaacaatgagaacacatagacacaggaaggggaacatcacaccctggggactgttgtggggtggggggaggggggagggatagcattaggagatatacctaatgctaaatgatgagttatgggtgcagcacaccagcatggcacatgtatacatatgtaactaacctgcacattgtgcacatgtaccctaaaacttaaagtataataataataaaattttaaaaaaaagaaaaagtgtcgtttaggacatcagtcttcaaacatgtttgctcaatcatcccctaacagaaatttagcaactgtgcctcctcacacatctataaattaacatctaaaatttgttattctatgtttacctgaatgccaagtatggaatttctgatataatgtaaattttggcatatatcaaattgaatcataacatttttgctattctaccctcaccattttacatgaataaaaaaaacataaattcttctttaaaatagaaaatttatatttttttattttgcctaaattgtagttcctttttttataacacagaaaatatttttaaacttaaagccacttactgatcacctaacataattctctgcaataaatacacttaaatactttgattttaaaatgtgtagggctaggtatggtggctcatgcctgtaatgccagcactttgggagactcaggcagaaggattgcttgagcccaggaattcaagatcagcctgggcaacatagtgaaaccccatctctacacaaaatacaaatacaaataaaaattaactaggcatgatggtgagcatctgtagtcccagctactcaggaacctgaggcaggagaatcacttgggccccagggtttgagcctacagtgggctataattgtgccactgcactttagcctgggcaacacagtaagatcctgtttccaaaacaaaacaaaacaaaagtataatattataaggctccaattttaaaatgttcttttgtgtttgaattctcataaattattattaattgaaaatgttaaaaacacatattataaagtttaatgtttaaatatgaaagacaggaagtaaattttattggcaatatatagtataatgacaaagataagaagtgatattatgacttaattgagaactacttcacagatgacaatgcagtgttttgttgtattgtttggagacccaggagtttttataacttagagcaatgcacaataaaagaatttgggatgaatgaaagtgatgcatctcctccctcctccgcttctctcttttatttgaaggagataagcattttaaaatggatatgagaaaggtgaatcaactggattcttcaataggcaaatcatttttaggaaaggagctcttagaagttttaaattatccacaagcaatgtgtgatccgtgatttaattttggagtgaattaacaaaaaactataaagaagaagaatatttttggagacaattgcagaaaattgccaatatattagataatgctattatatcatgtgaaatttcttgggtgtaataatggtattggggttataataggagaaagtcctcatgagactttctgaagtcactgaagagagacactgaagactttaggagtgatagatcatattttctgctttgtagtatcaaatatgtcagcaaaatgtgttgaggaaagaaatagatgaggtaaatgtggcaaaacaatcataaatccacgtgaatgaaaggaatcaataacaatactttctgcatactctgtcagctttaatatacaagatcagagagtccaatgtttctaggctctaaccctctgggatagaatgggaaaattcaacatgtagaaataaaactgaaggaatatgctgagtaaatgtatagcatgggaggtcaatgttgttacatttatatgagtaaaaccagaagaatggtttaatatgctaaaaatgggagccaactttgaggcataaaaataaatctgagaagttggatatcctatgccacagaccacagtctactcttcttgagtatgacatgccccagagcaaataaagcagacacgagaggctctaaaatggctttagccctactgaagctccatctacctggaggaagggtttacaatttttttaagtcaacaatcagtaataaaaagttgtcataattaaaattcccaaataataaaggtcaacatatatgtcctaactcatgcttggttcttcatgcatatgagctgcttgccagcagtgccacctccctagagacaaccaaatgtttaactcaccaatgacaagtgtgacttcagaaataatcctcttactgatttttatttgtgataaattaaaatgataatagaagcaattgcaccaagcccacattttcagatcattttatgattatttgtggctcacgagatgcttctaaatttctaactgagaccagtgtcttccttttttatctttccaagattatttgtaaattactcctttctattaattgtctcttcattagggcaaagttttcttatacacttttggtatatgagttaacataggaacacataatagagacagaagtagaaaaagggtctcctgccttccccatgttagtctttaagtgacatccctatttcattgatgtcttttttttttttttttttttttttttggggcagagttttgctcttattgcccaggctggagtgcaatggtgcgatctcggctcactgccactgcagcctcccaggttcaagcgattctcctgtctcagcctcctgagtagctggcattacaggcacacgccaccacgtccagctaattttgtatttttagtagagacagggtttctccatgttgatcaggctggtctcgaactcctgacctcaggtgatctgcctgcctctgcctcccaaaatgctgggattacaggcatgagccaccacacctgaccctcatagttgtcttttttgatgttctgaaatataacctaagttctagttctaaagagtttccttcaccttccatgagcactgctcagtttccttttccataatttttcctttcccaggcctttcaattaaattggtttggaaaagacacagacaaggaggagggcacagtatcccaaatgctgataacaaaccaaaaaccttaagggctgctgttctgcaaatttacagagttggcatggtgcaagaaagcaagctgtagtctgtcacagatttttttctcaaatttagtttgaaataattttagatgtataaaagagttacaaagatactacaaagagttctcatatactctttactcagcttcacctactgtttgcatcacacataatcatggtacatctatcaaataaattaaaattaatgaaaaactacagactgtcttcagatttttcaatttctactaatattactctgttccaggatccaattcaggatacagatgaaatgttgtatttcatcaggtctccttagtctcatctaatttgtgacaatttctcagtctttccttgtctttcatgatcttcacaggtttgaagagtactggtcacataatctgtaaaatgtccctcagtttggatttttctggtattttttcatgattactcatgattacactgtgaatttttggaagagcagcacagagaggatgtgtccttcttattgtatcctttcagggaatacagccatggggattttatttaacttattaatttatttattcattatttatttatttatttattgagacggagtctcactctgtcacccaggcttgagtgcagtggcgtgatctcggctcactgcaacctccacctcccaggttcaagtgattctcttgcctcagcctcccaagtagctgggattacaggcacacaccaccatgcttggataatttttgtatattttgtagagacggggtttcactatgttggccaggctagtctcgaactactgaccttgtgatccccctgccttggcctcccaaattgctgggattagagacgtgagccaccgtgcccggcatcatggggattgtaaaatgcatgtttcccattgagaaagtgaggtaaagaaaagaactgtgcatcaagcaatagaaaaaaaatcaatattctgtttttactggcacttttggcctgctggccataagccaatactataaactagcaggtagggtgctgcaagaatgtcaatacttctgccacattaatctttgcaggcttgccgcccctgcagttaactcatggagcatcctttgccaggacatacatctgcctctgtaccatgcccctgtaatgtgtcttcaaagggtgcaccattccacatctgttctctatcttttatgaccaaccactacaaaaactagagagaatccccaactgtttgttttctttcgttccagttaagaaaattgatgataatctcaaaaaaggggctattaactcttattatctctttcattttatcttcttcctctcttttaccctacatctgagcagggggccatggttagaagcaatgccttcaggaagtacgcactctttcccaaattaattctcatcatggaggtataggatcagctaataataattatatttttgaggaacagagaaagaggacaaaggggagaggagtcaccacttataatccctaccaggatagctttgtactgtgctaaacactttttgtcagatcccatttaaatctgagatgcctataaggtaagtatcattttctctatttgactgatgagaagagtggacttcagtagaatttaaaaaattcttcaaggttagctggttagtaaatgagtagagaccacaggtcatagtattttctctctccctcacctggaagaataaatcattcataccacctcagtatgggttaaagccagacatcttgtcagtgcttcctaaaaaaaaaagaaagaaagaaaagaaagaaattgtttttcatatgagattctgtgtctgggtccctgatgatttcctatgcctaagtatctacttgataatctctccaaaacgccactcttccaacactctgtgttgctattttcagtcctctccaggaactcttaaactaaaggacatgacccccatgcactgacaactacttcagccacctcaactctgaccagtccctcaaagcaggaagccatctgttgttattttcaccactaacaaatattcacggcctcatgttttcccggcacatagtgaacacgcacttatcttccccctttgaaactaggtgtggccatattcaaatcaaaatcctgccctttggtagttataagacacacaaaaaaactgaggcaggtattagagttagaattctagtctctctggcccaaactctgacctcataaccactgcaagataccctccctatcctatagagcctagtactacactaccccctcccaactttagcctccacatatagtaaagtgcttggaacacaaaaaacacttcataaattgtgctgaatgaaatcatttccatgagtgtttatggattttgagttcatttgtaccttttacctaaaattctagccactttaatttggagagtttccagagcaaagggcacagatcccaggcataacaacgctttgcgtatacagcaaccaatatcttgtcaacccaagaaagttcctccattgatacctagtagaaatagcccagtttttaaagtcctcaaaactgtaacaaattacttgtttttaaaatttaacttaaattaatacaatcagatttttgtgttatttgggtattagagtatgttaaagcacatatatcccagagacatagagtttccgtttcaaaaagtcatgcattcatgtgtgctaatgacaatcctatcctgacccgctatgtgacttgtatctctaaaccataggctttcctgaattttatctgttaatttaaccctgatttctcagcagcagcttctctttgtaaatagacttgcctcttctgtgtctgacctctgctcctcataatcagattaactcagataaagctgcttcagggaagaggtcaaaaccgttgccaaaaatagtagttgccctacttcagtctattttcaacagagtagccaggagatcctgttcacaccaaagtccaatcagccctactgttagcactctgctcacaagcctccagtggcttccgacctcactcacagtaaaagccaagtcatcctttagcctatgatgtcctacatgatttgaattcccttccattgatttttgtcactgatttttaaaaatccaaattcattctcatacagctgaattgtcctctttgctttaagtatgccaggattatttctacctcagggcctttgcacttgatattcccttcaccttttccaagatagttattccctcacctcagtcaagcctttatttagatgcccccttctcatcaaggcattctctgatctccttatttaaatgtatgacaccccttctttgctttacatttaatcagaacatgtatcactatctagcatataatacatttgcttgacctcttttgtttactgtctatgcctcctgaatactgtgtaagctccatgatacaggcacttttctctatttcgagcactgttgtattacagagccttaaaagtacctggcacttactagattaccaaaacacatttatcacacgactgaaaaagtaaatgaatagacacatcattattgatttttgcaaatgtttgaggcatgtattattattacccaataatgctagccagctaatacagctaattttatgtggtcatatttactaaaactttacacttttgttagaggtttatcattagtatttttattttcaaatgaagttttaaaaagaatatgctaaaggcagtattcttttcaaggtgaaagttggctcttaggcatatgtaatgctcctaacactgctattgtcaatttgttgctaagaaagatcaaaggagaaattgaaagccaaggatgcatagagctaggagatattaatgtggctttgaagaggaatatatccgagccctggcggtgggagagtttcataaaatagggcattttctctcagaaaaagggacgtgcagttttcggaacacttctctgttttccagtggaacaccatattttcacagaaaccatgccctgacctgatttataattttgagaaaatagttcaaatgcccttttctcattatgagaagatcatactgctgccaccacaagcatttcaccactgataattttaatactgactctcagagaaccaagtaagtagttgaacttaattccccagaaattattttgcaagaaaatttaccagcagttgctgcctacataaaaacgatatggaactgcaaacttgccatttaagaatcagccttttccctaaaacaaaggaaaattggttatagattaagaaacatttgtgcaatgtagaatcagttttcagttctggctgcatgtttacctgggaacttttgaaaatattagtatgtggtatttcatgtctatacttctcccacttccaaagatattctaatttagtgagtcttggtaggtcctagtaatcactatttttgacaagttcatccaaacgatttaatgtgcaactaactttaagggaaacatgtagtgggagaaaatgtatacaggcatatctgcctaatactcttcattgatgattcattcgttcatcctaaattacatcaagtacccactatgtgctaggaactgtgctaggggaaaaaggtgatggggtttagactgtagtctagaaaaaataacattgagcagaagagcagaaagtactactcaaatgttaataccactgctacattaatctcaacaacacactattgataatttctttccttttatcctcactcaagttaatctaatttatttgtaatcatttatctaaataatatctaagatctagtataactagtcatctataatctaatgcaacttgtaccactccactgcttccctgtttggaatgcctcctctaggacaaaacacaccctccatcaaaagccgtatgtctatggaaattttaagagagacagaggaagagaaagagaattcaacttcacttcaaaaccagacaaaaactctccacttcaaaaccttgcatatggattcttttctctagactaaacattcccacttcccataaataacacttctttctctctgatgagtcctttctgcctctccctcccactgccactgccctggtctggagttcctccgatgaggactgtggtaacaaccttctaactgatttttttaaatttttttatttttatttttatttttccttttagaagcttcaccctccaaatagtccttcactattccaagaatatctctgatatccagatctgctcatccacgctgtccaaaaaaacaaaacaaaaaacaaacaaacaaaaactctgtcaaatttccaccatccacatgataaagaccaaatggttttcccactgaccacatcataagaccaagtggtttagcatgacacacacagtcttctagaacttgactctggtcaaattctccagtgcagctctagctagccaagtctagatatacaggattactcatccttttgttattttgctaaaaaaaaaaaaaaagtttcattccatgaggaaataaaagaaaaaaaaaactttttagtcatttatgtaaatttttataaacttatagataaactgtgaattaaaatctagttttgtacagtaattaattatctctggtccctaataagttgagcacattgcttatttttctctagttataaattttatatttaaaaattgacctaaaagcctaaatagccatgtaaatgcatatgtataaacaaggcaaagctattttaagcagaatctacaatgtatgaaaaactggggcaaactaagtaatgcttagtcttaagactcattaaaaacaaaattctttttgttactgtagcatttaaaaaaatacaatttttaattgtatttgagcaaatacaattaagtacaattaaataaatttaatttgagcaaaacaatatatttaaaataagatgattaaagttagacagtgatatattggagacattattatttgttttgagatacttttatgtgcagctaatgagaaataattaaattataaagtaattataaataaattaggtatttcccatatatttaaaagtcttaatcaatgcaaaattctcttcctcataaattcttgaagctcagagataatggaactatggaaagaacaggcaatctatagaatgggataaaatttttgcaatctatccatctgacaaacggctaatatctagaatctacaaggaacttaaacaaatttacgagaaaaatcaaacaaccccatcaaaaagtgggcgaaagatatgaacagacacttctcaaaagaagatatttatatggccaacaagcatatgaaaaaaaagcttatcactggtcattagagaaatgcaaatcaaaaccacaatgagacaccatctcacaccagttagaatggcgatcattaaaaagtcaggaaacaacagatgctggagaggacatggagaaataggaatgcttttacactgttggtgggagtgtaaactagttcaaccattgtggaagacagtgtggtcattcctcaaggatctagaaataaaaataccatttgacccagcaatctcattactgggtatatactcaaagaattataaatcattctactataaggacacatgtacagctatgtttattgcaacactattctcaatagcaaagaattggaaccaacccaaatgcccatcagtgatagactggataaagaaaatgtggcacatatataccatggaatactatgcagccataaaaaaggatgagttcatatcctttgcagggacatggatgaagccggaaaccatcattctcagcaaactaacacaggaacagaaaaccaaacaccacatgttctcactcataagtgggagttgaacaatgagaacacatggacacaaggaggggaacatcacacaccgggccctgtcagggggtggggtgctaggggagggatagcattaggagaaatacctaatgtagataacgggttgatgcatgtagcagtggtacattcccacttccaaatatattctgatttagtgagtctttgtacgtcccagtaatcagtatttttgacaagttcctccgaatgatttaatgtgcaactaggtttaagagaaacatgcagcaaaccaccatggcacatgtatacctatgtaacaaacctgcacattctgcacatgtatcccagaacttaaagtataattaaaaaaaaaaaaaagaaagaaaagggaagaaagggccaaactactcaaaagaatgctgaaaataagaggttcagttgaatatgttgaaagtaatggtagaggggctgttaatgcttcatcttggcaaagacatagaaaatcttggtgattaatcaaaaggtcagaatccgttactctatttcctttccaagtgttttccccaggatggtttttgtttggtgttttattgagctcttgcttcctctgcaagtgagcctaatctatatgcagctctggagcaatgtctagcaattgattgttattttctggactctggctgcaggcttgtccatgaaagttggaaggtctaccacaaaattgcaagtggaggctcagtgctgaccccttctttttcctccacctctgttccacacaatgagttccctcttgtacatgtgtatgccctgagccacatgtaccagcttctcaactacaagcagtctccttttggctctatggtcctaaggatacatatgtcagagatgaggtttgcagacaaaggaggaggcccattcagtccttagaaataggctcagagcattggattagggattttcagggttcctggtacatgcagatggtgtagaagaggtaatgggatactgaattggatctagattcttggcctcaggaacatctgttctagtggtaaggaatgagaccaaaagaagaccagagcagggctgaagcacagagcatccgacagggttgcctcgattttctcacgtccctgatgtacagtaagcatttagtaccaataagtcatttagcagctgctgtatcatgaaaatgtttccatgctggtggaaggaaccagaatgaggatgtcagaagttatctgcaaagttacattaggcttatacaatattttttgtactcatatttctacaaagacctcagttataacttttattatttgcttatgcctatcattccattagaatacttcttttctttcttgtctgcctgaaaattttgcaagttttctttaaaagcccaggtcaaacttatactctgtatgaaactttccccaatcttccatcagcagaattaacttatgtttagatagcactttatacataactctaacttaacactgccacacagcattacatttaggtatatgtattttctctattagaatataaattcactgaacacatgatatttgctcattctttctttaccccaaaccaaatacagtatttggtatatacaaaggatacaactaacttttgatgaattgaattaaacacatatgttaagtttcctattcctacactgttttgtttatctttttcttgaaactaacttttgtcaagatcttttgtggaaaatgtgacagaatattctaggtattatgtaaccaggatggtctaaagtaggcaaattatctttattgattcagccaatcatttggaaacctttatttctgcaaagggccagatagtaaataatttaggcttttctgactatacagtctctttcctgccactcaactctgatgttatagcacaaaagcaacacagataatatgtatacagcaggcatggctgtgttccagtaaaactttatttacaaaaacaggtagcaggccagatgtggccctgatctataccagcacttcttaaacatggttacacaagagaataagtcctaatgctttaaagcatccaattacacactaacttccctcatacacatacagaatggtgatagttatgtactatcttaagagaattgagaaaatagttattcaaatagtatttttttttctatggttcagatgagcaatgctggctgacagaaatgcttatctagacactagacttccattcatagataagcctaagactatatgatatttttaacacaagctatcattggttcatattgattttctttccagacaaatccgcttaggtcttttatacttcagttgttttattatatctaaatggaaactgcatatttatcattattaattcttttcttgttggttttataaagaaaatctcccatttcttccataataaagcagtatttttttcaatctatatcttatgagcttgaaattgtatatatacaactaaaatccagaacataattattattaaaatgtctgagaaattgtttttaattgagttttatatgtacctcctaagtgactttttgtatccaatactccatccaagctctgtagatgttatcaaggcccaaaacttgaactctcaattagctcctctcttttattttttattcagtttgttagaaaagtttgttggatttatttttccaaacacatccagcatataaccactagcaaccatgctggtctgagtcatctttatctttcctctcaattactgtagtaacctaactgatctttgcttctgtccctgtctcctttagtctacgctaggcatactgctagaggagtccttttaaaacataaaacatatttgtctctcctttgttcaaaacccaaagagtaatcagttttagatggagaaaaatttatgagaaacgggagagacctgtccaatgtcacatagactggtaggtctgggcactagagcacaaacatctatcattgaatctgaaaccctatcacataaccaaaagtttctaaatgtaaattcatgtgctatttgttttcttagtattagacatttaaaaaaaataataccaaagagtatctactcctacttctgacataaataagtgctaagttccttagatctcaattctagtagtcacattgtattaaacttcagggtggggcattaactttattataggtacgcaatatataaatatatgtatgcttcttcatctctgaaataaagtttatagtataaatactatattcctcgtgtattatctgcaaggatcaaatgagataacatttatggtaagagctttgtggggccgggcacggtgggtcacgcctgtaatcccagcactttgggaggccgaggtgggtggatcacctgaggtcgggaggtcgagaccagcctgaccaacatagagaaaccccgtttctaccaaaaatacaaaattagcctggtatggtggcacatgcttgtaatcccagctattcgggaggctgaggcaggagaatcacttgaacccaggaggcggaagttgtggtgagccaagatcatgccattgcactccagcctggacaacaagagcaaaattccacctcaaaaaaaaaaaaaaaaaaaaaaaagctttgtaaaacttaaagaattataaatagcaagagtttactttctttttttttctctctttttaaaatttatttattattattatactttaagttttagggtacatgtgcacaatgtgcaggttagttacatatgtatacatgtgccttgctggtgcgctgcatccactaactcatcatctagcattaggtatatctcccgatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttacacatgcacacgtatgtttattgtggcattattcacaatagcaaagacttggaaccaacccaaatgtccaacaacgatagactggattaagaaaatgtggcacatatacaccatggactactatgcagccataaaaaatgatgagttcatgtcctttgtagggacatggatgaaactggaaatcatcattctcagtaaactatcgcaagagtttactttcacaggtatttaaagaatagaaataacgttacttcattgggatccaaaccaaagcagaaccttttgtccaattattatcagtgagatgtttgtttagatgtgtagatggtgaaactctagattatgccccttctcagtggctcacagacttccaaatattacacagaaattagaaaatggtaagagaaagaaggttttccattttagccatcatcttgatgacaaaagaccttcaaattttattattgaaagattcctatttcatcctcctctaacttttggactaaaagttgagaccagggtgaaataccaggtatagagcccaagtgaacaagcttttatttgcaggcatttatatagggtcttttctctgtcccaaggagattaggggccttggtgcccttgaaatctctgtcttcttcacccatattttcttgcttcaggaaaatacttcgaggtcttgcttctgaacctgctcactccacctaaccttttttttttttttgctcttgattcctgacttcctctgtggactcaaactatataaagtctgtccccatctcaaagttgtggatcacctctactcacttctacaaccatatatgctttctgtggacctagaacaggttggaattctgggaatctagcttgaacaagaaaggaacttggacgtcatctttaaagaaaatgttctcctttttccctgaatacaaaggactcagcatcattttggtgagaactcaaccttgcctttcttcatcagaagtaaaaagtgaatgtttttgaaagttcagaaccattctatgctatctgttagatgttaaaggcaactggaatttagaagaggagaaaagaacacacaccaaagataaaagcaacctcaccactccaactgcttaatttcctatgcttcacgttttggtttcttcagttggcaggttccaaaagttatctttacacatattcaaaatgtcaattgtatttcagaatccaaaaaattaatattttccaaacagctattatatatatttattatatatcaatattttccaagcagctattatatatatttccttaataacatatatacaaataaacagatgaggcaggcagatgcatacaaatgtgtgtgtttctgtatgtgtgtgtgagctccaatcacacttcccacaggaaccatacatttctcatgagctcctgtaatttgaactttaccaaacttgtcttcatactaacttttccaattaatcacatagaaactcaaactcgttttacatttgaatctggtaattgtgtaatctttatcagcagagcaaaaagctgaaataaattttaaaacaggtatatacaatatcatatctagaatgtattaattacttaggtatgagacactattcaaagctctttacagattttatttctttaattctaaagacaacatcatgagataggttctatgattgtaccaattttagcaacaacaaaggagatatggaaagtcacaaatgtgtgtggcaggcatagcaggaatttaaacagatgataaccctgagttaagaataacccgtggaatttctgatttgtgggtggaagaagaattctcactcttaactgttttttaaaaaattaatatagtgatgtactagttttgtatagtcatcataaaagaaaaaaatcttcaaagaaattgctattacaaacaaaatattcatgactaacaagcataaaaataaggccatgtctgaaatcatgttcacccacatgaaacattaaactcagaatcagccagggaggctgatgtgcaactaattagaaaacattctaattagttttctttatagttttccttgtttttcatctttatcctttccttaatcttcaaatggcagctgggtagatgtggtgaagttacatacacaacaataatttaccaggaaaaggaaagccatgttcaataagattttcattgcaagatacataacaaaaaaatctgttaattttcaagcaaagcaatgaaagctgaacactccctagcatacagagatgattctgaaaaatattgggtcaattttgtgaccatttttgacccatatctgggcattttccaatagtgtcaagagacatcatttacatttgaaaatgcgtatacaaaggaaaaaagaaacctctcaccactgccaacagacactttgtgatgggtgtgtcaattagcacaaacttttggaaaattattaagaaaataatacatcttcaaggaaaacattataagaaaataattagaaatgaacatcaagatttataaacaataatatccataggtaaaattgattaaaatgtaatttataatcatgcaaatttggataacataggaaaatatttcaaataatagtacatttttaaaaaggactgtacaggattatatctaccagtagatttcaaatacacaaaaatatattcaaagttgcatcaagctatttcctctatactgtaggttctgtgaggggaaaaacgaaaaacaaccctgatgtttactttcatacctttggcatctacatcagtatatggaacataatcaatgctcggtacaaaaaagaaagttaaatgatgaatgaatacatgtatttcccttcatatatattcaatatatgcctggtaagcagtcctttaagaacccaacatttccaagtcctgagctgattgtctaactgaatagaccaaacatttctacaggaagcagacagtgtctattcaaagaaagagtcctttcttctactcttagttttgctaaattgggcagtagaatgtttctgtttgttaatttgaaaaaaaaaaagataatagtctaacaactttttaggtttcttgtgcagtttatgtgacacaaggcatgaaaaacatttagcatataaacacatagcactaaataaatcagaggtgcagttactccagtaaacggaatctctcaaggcctatagagatgtattgtgtgattttctttttctgcctgcttttaagtttttttctgtagtgtccgtcaatgtcagcatgttagctaacaatgtgtttaatacttagcagatgctgtcttatcatcccttacttaaagtcccttaacggctccctaatgccttcattacaaaatctaaacacctcatgctgacacaaaacatacctgatgtcctggtcggcctctggctctcccttcccatctcccactgctatctcttatgtacctgcagccaaaacaaattacttacattctctgagcattctaccttctaaactttgtgatgctggacccagcctaaaatggaatttttctttaatctaaattctaatcttcctttaaagttaactcattagtttttattgcacttaaaaataattttagcttttctcaaaaatgtttaatttctaaactttttattgcttatttttatttcaaaatatttggggttcaggtggtttttggttacatggatgagttctctggtggtgatttctgagattttggtgcacctgtcattcgagcaatatactgtatactcaatatgtagtcttttttccctcactcccctcccattcttccccacaagtcccaaaagttcattacctcattcttatgcttttacagcctcatagcttagcttccacttataaataaatgagaacaaaatattgtatttggttttccattcctgatttacttcacttagaataatcaccttcagcttcatccaaattgtagcaaaagacattattttgttcctttttatgcctgagtagtattccatggtgttaagtaaaaagcttctgaacagaaaaataaataatcagcagagtaaacagacaacccactgggtaggagaaaatatttacaaactacgcatctgacaaaggaataatatccagaattgacacagaactcaaccaaatcagcaaggaaaataataataatcccatcaaaaagtgggcaaaggacatgaatagacaattttcaatagaagatatacaaatggccaacaaacatggaaaaatgctcaacatcactaattatcagggaaacgcaaagttaaaccacaatgagataccaacttattcttgcagggatgtacataatttaaaaagtcaaaaaacaatatatgttggcatggatgtggtgaaaagggaacacttttacactgctggtgggaatgtaaactagtacaaccactatggaaaacagtatggaaattccacagaaaactaaaagtagaactaccatttgatccagcaaccccactactgggtatctacccaaaggaaaataagtcattatacgaaaaagaaacatgcacctgcaagtttacagcagcaaaattcacaattgcaaagatatggaaccaacctaagttcccatcaacccagtggttaactttttattttgaaaggattttagatttatagaagagctataaagatagtacacagagttcacatgtacctttcatcctctttcctctaatgttgacatcttatggtatgttcaccatactaagaaattaatatttgtgtaacagtttacttttatttttaaaaatgattttatgtagttttaaaaatctatgccacttgaaattggtcaacaatatataataaagatagaacaatcaggcatacataggtgggtaacctttctctgaagatcattgtcataagaatgttttctctatattttccattagcaaattatgaagtgaatccagatttgtcatctatgacatttaaatggcaataaattagcagcctgatttataaatgattttcctctcagtgccagaattaaactgcattgctctacaaaaatgaacaagcaaagaaaccacaaagtcatattcaagtatttgttttttatctttttgtttacccatatgattatttcttgaattaatactacatgagcagattgatttggaattgttacaacagacaaaaaatcttttatctctgcctcactagaacttccagaatttaattaaaatttattcattgattctgccctcttctatcccagtcaagttccccccctgaacaaatacagtatatagggtcagtgcaatgagcagaattgctcagaaaatgtcctctctcctattaaccttacccacatgtgaacatctactgatgttagcatttaaaacaccttatctttcttttattctaaaagaaaattaatttaagtaataagtaaaattcagaattaaggtcttcactgttacattctatcatagtgcaattcacatattaagttgctaaataatgacaacacctgtaacttttcttctgtaatcatctgagcaaatgaattaactgtaagttaagttactttattttgacacttctaagagtgctttttttaaaattaggattttcatacatgtaactttaggacatttttggaggtatgcactgtcttatactgtatccacatgcaagtaaactcacttactaaggctgaaattagaaataaaacagtttaaggaaatttggtatgcttaaatcatgcaattctgatacaactaaatgatactttttttgacacatatgaccattcaaaataattacttttatacaatgataaagttgatgtctgttttaaaaattaaatatactaaattatcctgcatgggctacctttattccttgtttaaatccactgtgctttccttgatacaagattggtagaaataaattaactcatttattattctatgacattttatcatttaagctgtcacttatgcttttattatagagaagaatctctggtggattcttagagactttcttcttatccacttttttgcattccttaagtgttgttttctgctattatattcaatctttaagatcatatacagctaaaataaatttaatgagagagaaagtatgtgtttctattactggcattgccgtgaattttatatcactggtttgctttggtatttttacactgaaaaatgaagatacataaaatcatcataataaaaaacaaactgccaattaaaattatactttatttataatgaacagtatttgagaggtgctgaagtaactaatgctaattcaagtaatggggggtacaaggttacccctttctttcctaccagctacatgtaccaaagagtaaatcaaaagaaacctttcctgtaggatagaaagcgtgctgtgtttctgaaatcttgaagattacccaacatagatgtaaacacactctggtaaatgcaaataacatacaaatctaaaagcatattatttatattgataaatatgctgtgtttacacaaattaataaaaatgtaaatagcaaaaattctaaagattttgctacaattattttagctttatcatcaatttctctttctgacttgggtttggatttagctgctcttcaactactctgatggccagtctaggctactgaagactatcacttgctttattcatcagcttagatgcttatactacaccttctcagtgagtgtcatctggatgttttaaagtcaactcaaattcaatgtcttcaaaacttacctcccccacattttctctttttgaatattgtttgataaacactggattatttaacaattctatttttcaaatcagaaatctgggagtcattctacattcatttttctcatgagtacatccagtatatcaccaaagcctaaaacttctaccccaaatagatttctagagtctcactcttttctctcttttctcacatttgatcatctcttaccaaaactctttcttgaatttccactataccagcacatcatatacttggaaagaccttaaactcccagcatgccaaatttttttttttgtatctcatggtttaaatggttttaaagatattatattttttccacatggattgtgggaattaaggaaaagatgttctccaaatttataattcttatatagcttttctatttggggaagagtagaagagtggaaaagcatattggatttgtttcagatagattagttttatcatttctaagttcaaataatgtctttatgcttgtttaaagttggccaagttattgtaactaccaggagatagattctacttatttgtaagaggaggataattcttcctgaaagagttcttgttgagattaaatcagatgtaatatataatgttcctgtcttcatttatcaactcttctatccacttagctttcagttaccagacatttccaattataatttgatatataaaataaaatttcactttgttgttatgggttgagttgtgtcctctgccaaatatgtcgaagtcctaaccctagtactttaaagtttgaacctatttggaaatagggtctttgcagacgttaaaaataagtgatttggttgggtcctaacccaatatgactgtgtccttataagcaggagaaatttggacagagacaaacacatacacaggaagacaatatgaagacacagggagaggtcatctacaacacaaggaatctgaggcaatcaaaagttcaaagaatggaccagattcttgcaaagagccttcagaaggaactaaccctgcaaacaccttgattttagacttttagcatccagactgtgagataacaaatttctgttgtgtaagccacagtggtacattcttatggcagcctcagccaactaataaaattgttttattatgttttatataaatgtgcccattcttatgttaacttttttggaaggttaactaaggaaagatctgaaccagaaacacagataacttgtcatatcacttagtgaagtaccccaggaaactaggcaattcatgaaagatgttgataatcttagacatgaaaccaagaggaaaatatgtttaatgaattgctctcgcattctgcagaaccaaagagaaggcttcatgattaaaagacaagtaaaataaaatatgcagcatttttccttaaccccacattgtagcttttttttttttttttttggctgttttgcattgttcagagctctagtagaagacaacagaatccactcaaactagtgggaaatttgtcacacatgttaaatgtcttaccgaatcactggtagggatgattaaatagactttaagccaaacatttagtaactaatcctaaagctacccggcagaacaaggatccaggagaattactgtctcttccaaagttaggaagtcaccagcttcagttctccaccactactgcaacgatgaggaaggatatgtagctgtagcagctccagaaacccagcatgtcttctacagcctgcaccagtgaaaatcattccacacacttctcaagatcctcaaagttgctgacgaggtgccgagacctcggctaatgctgccaagaaacactccacatgcctttgactgtgcttgttggcagatagaacaggagcgactgaaatacggctatctgagaaaggttaagattgactgaacctccatcacattgagaacactagttgcaagagaatcttgaagatgtagattgtagctttccatattctgcaattcttcaaggaccattaaaaggagattggtatggtgttgagcaccaagccactatactcaccaaataacacagaaacgttggttagttatgaaactctcttagttacctgatgcagcctcgactttaggaattcttactattcattaccacatacaagctattagcctttctctttcctgaaaacatacagttttgaggctgctactctcaggtgacactgcctgctacctttccttgtaataatttacaaatgccccagattggcctgtcgtggggtggggggagggataccattaggagatacacctaatgtaaatgatgagttaatgggtgcagcacaccaacatggcacatgtatacatatgcaacaaacttgcacgttgtgcacatgtaccctagaacttaaagtataataaaacaaacaaacaaaaaacaaaacatacacacaaaaaatgccccagatttacttccttaaagattttaacacctggatcatggccaatttcactattccagtcaaaattcttgatgatccaataccaacatggaaggatattgaccatctcttttacaatgacttgatcctgaatcatatctcagccatctactttcaaggtcatatctatgtcctgctaataacaacaagtacaccccaattccataatctcaaccttaaacatctcattctctatctactagttttctctatttccaatgcttttactccctcaaatagccaagattcagtaattcttcaaagctaggagtaccaaatccactgcagatcactcctccacgctttctcatgttctcacctccctagctattcatcttagatagtacaacccatcatggtaagcactttcttactgacaccttcacctttctaagcatttagctattcatcttagatagtacaacccatcatggtaagcactttcttactgacaccttcacctttctaagcatttctttctcttccacagaactccctacaaactttccctgccttatcattttttataatatctatctatctattaatagttgcctcttttcctacttggccataatttccacaagggcaaagactcttctgtttattgctattgtctcagatggtgaaactgtggctagtatgtaataagagctcaataaatatttactgagtaaattaatgacataatattttaggttaactagaatattgtccgtcaggttaaagctgctcaaatattttactgaataaatgagtcatatagaataaaccctaagataaaacaaacctttaaagcctatttgatctactcattgaaggtagaatgaaaaatcaattgtgtaaagccaatgatatacaaaataaacaaatgtattctattctttttgtcatataacatactttgaaacttttcttccctttttaaaaacttttcctcctaaatctcctaccttttaaatggaaattacctcaattaaagcaacaatatgattttcaaagattaaaaatatatgagataactaattgaataaactcttacattggtccattaaaataactataggttatattaatattgtgctggaactgattatcttcaaattgattctattctcctcaatctgtctttaaggaaggatattaaaagacttgaaaatacttaaagactaattttaatgctgtctttcagcagtcacaatgtagttcccaaattattaattacatcaggtaaatcaaccatgacaagctattaataggaaatggagaagaaaattacattagtaaaaactatttaaactgattatctaattatagagagacccacattacataagcatgcaataggacagcctataggggtacagttagtcgcaggtctgtatctttgactgtttacagtgatgtcgcttccgctactataatgaaccattaagtgacctacaatatatcaaatggcatggaatcgtgtacttaaagaaatgtctcaagaccttgtttaactaacatgctcctaaaaccttcacagcatttagctatagaagcaaacaacacaaattgctattcagaacttataataacgaagaaagattaattttaaaatggacttttcagtttatatacagtcccccgttatccatggaggaatacattccaagatccccagtaaatgtctgaaaacaggtagtaccaaattttatatatgtctttccctgtatatatgtacatgtaataaagtttaatttgtaaattagacacagtaggagattaacaaaaataaaataggacaattataacaacatactctaataaaagttatgtggatgtggtctctctctcaaaaattatcttactgcactgttttcacacttctccttgtgatgatgtgagatgatataatgtctatgtgataagatggaatgaggtaaaagatgtaggcatttaacactgggttacttggcccttctgacaatatgtcagaagaaggatcatctgctttaggtgattctggatcactgatctatcatgatgttgatggctggatgtcaggagtagatgatgttgatgcctaacgcgcaggtagtgcagacagcatggatatgctggatatggggaggattcatgtctcaggcagaacgaagcaggttggcatgagatttcatcacactactctgaatggtgggtagcaacttaaaacttataaactgtttatttctggaattttccatttaatatttttgagccgtacaactgaccttaggtaaccgaaaccacaatactgaactgaaagtgaaactatgaatatgtggggactactgtacttgtaactcacaaagtatgcaataaacacttgttctttccttccttcactttgattctttcttcttttcttcttcgtttcttcttttgacatatattacttgtcacctactacatgtcaggtgctttgacatgtctggcagaatagtacataacaagacagacaaggtgactgagatctgaaggataggaagtagtcagttaagacaacagctgagaggaagagggtcaggaggtggtgaccacccttcctgagagcatccccacacacttctgttggtaagaaatgcatggtatattctaggagccagggtgctgaacacagaatcagtgacagtgcatgtgtcaagaggagagagagagtaagtaggcaggatttataccatgcagtgcctggtagcccaggaagagggtttgttcctattagaactgcaatgggaaatcattatagcagatttttttagggggggtgaggaagggaggtgtcatatgatataaacattgtaaaacataatagcagaaatgtctatttatatgttgctctattttgtatatagtgctagggaatcatataattccaaaaattatgccatgtttttacaaaagtgaggtcctaaatattcacaaaagaatgactagactataactcaatgattagagtcaatggaatacaatgcattcttgactgtttctagaaatttcaggaatcacgagaaaaaaaaaaaaagtgcggtgtaaagatcgctaccaaaagatcaaggtgagttttgagccttctgcatgccctctttaacagcccctcacaaatgcagtttaaaatagtaactgtcgtgagtgataacttgacgtatttatcatctaattgagctggtgatggtttattctgatatttactaaacacttattctttggaaacgattcatctgcaatgtatcatccacagtggtaagtacagtgtacatatgcagtaagtgcaatatactaacattttcttatttgagaacaattttgaaaagtaatgtcatccaaaggaacagtgtttgaagtattcatagccttttgttaaaatcgttgcccagcactttgggacgccgaggcgggcagatcacgaggtcaggagatcgagaccatcctggctaacaaggatctctaataaaatacaaaaaaaaaaaaaaaaaaaatagccaggcatggtggcgggcgcctgtagtcccagctactccggaggctgaggcaggagaatggcgtgaacacgggaggcggagcttgcagtgagctgagatcgcgccgctgcactccagcctgggcgacagagcaactccatctcacaaaaaaaaaaaaaaaaattattgcacattttttgtaaaaatctatgatcttgtattatgaaactaaattgcatccaggactgctcaattttgtttataaagtttacattgtagattgttacataaaggattaatttttgcaattgttctttttccaaccaaacatgatcataaaatgcatttacctattggaataaagatgaatcaaataaaatatttgaaataagtcattgtacatatacttgttccataatagctttttgaaagtattaaatctatagatgtgaaagaagcaaaaatataaaaaatctgaaactggacaacaaacattcattatgcaagatatttaaagctagctattgaattgcttcaaaataatttgttgtaggctactgttttcttcttgattccactgcctacaccttaacagggaataaataaatactctcctatgtgtacaaacaccttctttttagaaatattaaccatctactgtggattttatagatacactacaatataaggaaagttggatgcaactacatatgtcttgcatgatcagaaaaatatgatatattaaaagaatattctttctgaagattcactctctgaaaaaaaaagttctaaaagggcttatacagagcgatttaaatacaaaaatttgaatcaatcagcactacatctctgtaagtatacaataggaaaatttctgaatgagaaattacacatgctttctgtcatcaggctcctgctagctcagtgctataattcatcctacactgctgcaaatatatctttataaaaattacagcactactactaatattttgtgcttcatttcaccaaattttaacctaatcacttccctgccgtccaaatttttcctcagaagcccttttccatgacaaataactcttatctaccttgattcttcacagaacggtttttctccagcttgctttgactgcaaaaactttatttagagtgcatcactgtcctatgatcctcactcacagagacaatattgtgtattggttaaggtagtggtagcttctgtaacaaataaatcctgaaatctcaatagaggtttttctaattagtggactgggggaattttctccccacattcactcaaggacccaggctgatggaggttctgccatctttaacatgctgcttctagtttgctcaaaggatcaacactcatctatcagaggattacatgagattgtttttttggccaggccagaaacctatgtatgctaatcttgccactatttcattggcgataaatctgtcatgtggctgctcctgacagaaagggaggatgggatatacattatagccaagtgcccagcaagaaagaagaagagttttgctaaatagctaaatagtctctcacagtcccacagacttcacatatactaggcacaggagtttgttagcatttttctagttagtaaatagttccttattcctaggacacttgtacaaactacatcttccttagaattgaccaccccctatattcttatccctgtgagatgttttaatcttcacatggttgacccattccaaaacgtatcttcctaattaaaaacacaaaagtatttcaacataaatgttctttactgtctacctcttctgctagtcatattcaaggacatgcatgcacctcacttagcacatttttgtcattagaacacttgaattattattaattattgaatactccatcctttttttcatctacatgcctctgggaaatattatttcattaaataatagaaccctctaataaaatcttcactaaactacccttctcattcctgggggtggtatctgtacactgtgctgccaaaaaaacctagagcttacctctacaatgtgaggaacgcttagaacacgaaaattttctactaacttaacaagacctaagactaaacttttccacccatacttcttgctaaactcaaattaacccaccaatagctgctaaaccttggtcacagtcttgctttttttacatctactaccatggttaatgaaacatcagtttgcccataccttccaaaaatataaacaatgaaaaattcttagaacaaaactgaacctttagaactttggaccatctaattacctagatgcctttccctcctttatctgtcttacaaaagttctcttattttccactaccatacttacatgttacacattgtatgatgcctctgctgcccccagcaaagctgtgggagtgactacctccatcttgttttcaaaggaagtcatgaagaacatcagtgcccaggaagagaactgccatgagggtggggtcacttcagacagtccccactgagtcaatgcccagtggagccatagggttggttctaccctcaagaccttagactggtagagcaaccagagttctattccagcacagaagagctctggtgtgggccgcacccagcaaaaccaagcagggatgcctggagccctggagcccatttgcccagtaaagctgagaagatggagcctctaccccactgtgtccacaaggagacctctgccccagtgggcctcaagggcagacaactgagtcaaagaagattcttccacaacatttatgttttggacttgttcaggacctatcatttatttcttctttcctatttctttattttccagtgggaatgtctttccttgcctgtcccaccattatattttggaagcacataatttgttttatttcactggttcacaactggacaaaaatttgcctcagaatgaattgtatcttgagtctcatccatatctgatttagataatatttagatgagatgtgaactttagacttctaagttgatattagaacaagttaatacttttggggtaattgaaatgaatgcattttacatttgagaaggacatgcctttttgggggatggggcagaatgaaatggtctaaatatatccccttaaaattcatatgttcaaaccctaacctccaaggtgatggcattaagaaatgaagcctttgtgaggtgatgagctgatgagggcaaatccttcatgaatgagattagtgtccttattaaagagtctgaaactcctcaccaattaaagctgccatatgaagttacagtgaaaagacaactatctatgaaacagaaactgagtccttactagacactgaatttgagggtgccttgatcttggattttcaagcatccaaactgtgagaaataaatttctgctgtctataagttacccagttcatggtattttgttataacaactcaaaaggattaagacacattccttaataattctctacccctttagatagagtcaatttggctcctgtgatggatagatcctatggacaaggtcaagacactggtattttttcctctggtgttcactttctatacattccctcttatgttacagaacttgtgatttgcccctcaccaaggtgaagaggtgaaaagatttttgcacatgtaatgaaggtcccaaatcacttgcctttgggttaatcaaaaggaatattattctagatgaggttgactaaaccaggtaaaagctcttttgaaaaaagatatgaagcaccctgcaggtaagggaaatattcctgctgaacttgaaggaaagtgtaggtaacccctaagagctgagggtctcagtactacaatcacagggcctaaattctagcagccaccctgtgagcttggaagagggctctgagctccagttgaggactcaaatctggcctctgaaactttgagcagaagactcacctagattgtgtctagatccctgaaccaaggaaactgtgataatgtgtgctgtcttaagttgctaaatgtgtggtgatttatttccaagcactggaaattaatgcagaacccttatatatgttctccttatattgtttactaactccattacaacactggacatgaaaaactgttgctcatcagtgactttcttcccagtgagattccaaattccacaaaggcaagaaccatatctcatttataaaattcagtaatcagaacatattttatttttggctagaataatatagatacacaacaaaattcttagaaattttcccactattctagtctaagtaatctagtcattggttaaaaaaaaatataaaattagaaaatcaaaaactccttattaaaaatccaggtctcaggtctcaatagcagacattgatgaatccttttttcctttccaagtacttagatattagactaggtatttagccttttacatgcacccctgtagtttaaggaaagccaattaatctcctaccttcagataactcttttagcttgagacagcattttttattcccctaatctcaaatgtcagcatagggatgtgatttcagtgaacctcttacttggaatgccagaaacagagtggtctttttcctgatagttgagaataagggtgcatgtggccctgattgctaatgcaggccaatttgtggctgtgagcttttgcctgtttggggatggaaataatatcatgaactgaagagcagggaaacacaatcaattgtgtttaatgacatgattgaagacctgtaccaccattgctgaatcctgccttatttctggatttgagtcaccagtaaatctctttactgtttaaagccagtattagctgggattctgttgctttaacatatagtcctaaatgaggccatttctaaaactatattatcaaagaatcactaggattggtataaagcaaacatttggtcattcaactaattatttacaggatgtcaaatagctgaatggacaactttgttaatacatcctcatattttatgattgtggaaatagaacactatgactttttagattaatgttgatttgtaaagatagaagcaacaaatttttaaaatatttaacatttttgcttagtatttatctctagctcctcaatacccagtggttctgagtaggtttagtttgcatatcattgatatctattttaattggtagatacagtcactcatatattagaattctcataacagatttgtacctatgcttctagctgaaggtatgacctaaaagttaaaatacagaattattctctgggagaatttaaattagcctttgatcagaacaaatagggtcacataataccaataccaagatggtgggaacttcacataattgtaaagtggtgatggcaaggaggattaattttgcaaaatccatgccaatgatacaataaaaatattcgtgtcttaatttagtcattttctttgccttcaagaattcagctaatcaatattttattttaataggtgtcagcactgtaaaagtaagacacagaaacagaccaagaaaccagcattgggcatctgatgcatcattacttttctttctttcctgaaccattcccaccatgccacaatttcaatcatcctaagaaaacatattattaatactctcatcttccattttctaacactaggtatttactcctactatatacaccccggggagctccattttatgcttctgtttagagtaaaattctttgaagaagttgtctcttcattgtattgacttccacttttcttagtctctttcaaagccttctgactaatcttagcaaggtccacatgaacacatcctcccctccccctactcaaatatatgcatagttccttctttacttccttttttgagttttatgtccaaatggaaccttctcaggcaagcctttcctcataccttcggtgttccctgctttatttttttctttagtgcttaatgcttatttaattacaatttattatatatttctgatggactgaattcttatgttccacccaaattcgtatgttggaactctatcacctaatgtgatggtattaggaggtggagtctttggaaggtaattagaattagatgatgtcatgagggtttagtgaccttacaggagtcctaagagagcctgcttcctgcttccatcatataaggacacaaggcaccacctatgaatgaaaatctgctgggctttcaccagacaccaaatctgctgacactttgatcttggacttcctagcttccagaattgtgagaaataaacttctgttgtttataagctactcggtttatggtattttgttgtagcagcctgaacgaactaagacaacatttataatcaccaccaatcactcctactagaatgtaagttccatgaaagagggttttttatttattctattaacctcattatttcagttcctagaatagtacctaccccttagcagatattcagtatttttttgaatgaatgagagagtgccattgatcaagtgagcaaaaattagggcagtcaccaacaatagacagaggatctgagggtacatcttgaagcagacagatcaattaagagaaatcaagaactcagatagtgatatgggtaacaagaattcagaagcgcaacaaaatgattaggtaaaatgcacagaattccatgttccagaatagaattaggtaaagtgtcagctttctactgaagaaaatatccgtacgcactttatatagtctagagactgaatttatttcaaacctggctgatttataagtggaatcaggcaaatataactaacttctaggtatgaggggaaataaaacaagttcctgacaacagaattggctttctattcaaattattgagtacatgtgttcatccctaagcagcaatgctttataattgtctatgaccacaaaatataatttaagttcacgaatttataaatatatttactaataaatacacagaaaaataacaccaatattagaaacaatctacaaatgtgttgtgaaaagcatttccatagcaacatcagaataattatcgctataatcagcagtagagaaaatgtgctaaagccaagctttatttttctcagaatcatgggactgcagtgctcacccacacaaccgaatcagcagcatgaaaaacaacagaaaattatattttatgtataaaagagtaattgagcactctacaattatatagaaatcaatgagtacaaaaaatagattaacagctatgaaaagagacaattatgacatttttagtgtcagtaaaatgtatcatattctaatatgagattatttttctaaaattaatgcactgtagctggagacccaattttagaagaagaaatgaaaactcatatcaaacatcttaatttgtaactcattaatgcaactagcatgacttcatctggaatcaagaaaggcacagtctctcagagtcaatgtgtcagagaaaagataaaactgacaaccctcaagagaattattcttattttaatggactacattaaacaaagaaaatactacaaaatatgtacttttctgtgttacataaagatataagccatgaagtataaaaacaaagtcatcatagatttctatagtcaatcaaaaagacacctgagtctatttgctaatattttatttactttttcagcatcaagtgataaagtaatgtcttaattttcttgaatttatatttttctgctattttcaatcttctatgagagaagaaaaacccaatccaatagtccaccaggaagaaataacctcccaaggagaatataagctgtatatttattccaagtaaatagagagagagagacacacacacacacacaaagagtggcgggggggcagtggaaagagagagagagagagagagagagattcatataccaggattgctccaggcactaaaaatacaaaggcaagcaaggccattttttgttcaatgtcagctgaatgcctttaaaaattgtaatttttcaatgggggttggctaactccagctcctccggttaaatacagctgactacttgttgcatggtccaggtgctaaatatgttttttacacttttaaattgtccagttggaggagaacaacacacacaggggctactggagggtagagggtgagaggtgagagaggataaagaaaaataactaatgggtactaggcttaataccttggtggtggaacaatctgtacaaaaaaaaccatggcacaagtttacctgtgtaacaaacctgcacatgtacccctgaacttaaaataaaagttttttaaaaaaatgatgtagaccaacacatacaatgctataaactaaaataagaagaaaaagaactttcaaagattatatgacatgaaaattatatcaaattcaactttcagcatccataaagatgttttattggaacacagccatgaccacccattccttcatgcattgtctgtcactgcctttgagccacaagagcagaggtgggtagctgacacagactctatgacctcccaaagctcaaaatatcaactgtctggctctttacagaaaattttgctaactactattgggttaagcaaagctttgacagatattcagaatacaaatgaacacaattttagtatcctgaaaatttggagcttcaagataggaagaaatttaaaaagaaggcagaattctgtcagaaggtgaatagaacttaaatactctctcctaagagccaaagaaatgcaagatccaatctaatgatgtaatagcctaggtcaggaatgtaagctttgtgaacagacctggagtttgtgaactgcaagatgcagtagagcaacttttaaaaaaattgttcaagtttattattttaaaagagggcgaagtgtggcaactggaatgaacagaaaaaccactcggaatgtccacagctattcaactcctgctcagccacaatctctagttgaaaagtcagcacatcagctgaagagggtacagtctccttagtagtacacagtaaatagtaagcctggataagcccagagaaaattgaggaggataaaaaagagaaaaaaaaaaacacattatataatatatgtgtttaaaaagaaatctctacatatttggaatattatgtatttgcaatgttttagacattctgtccttattagagatagaagtcaggctcgtgattgaaatttaaaatgatttagaattgtgactttaggcagaaatcttactatgtttgtatgcagtatttacataattaagaaaactcagatttcaatatattaagttatctgatttcccttttaattatctaagttgtttgacagacaacatcataataaattttttaatgtactcttaaacttttataaattcaagatgcaggaagtttcaattctttggtctgagttacaaaaataatttcaatgcaataacttgaattactttgcaaccagtttacttattcccagcgaatagaagccatgccagtaaatcaaattggcataaatagtacaaaatttattcatccaaaaataccaattaagtagttagttgtaatttgtctagaattcaatgtggcactacatattcgagatgaatgataatatccctgcccttcagaaaactaaagaatggtggaagagacagataattaaatcactagggtagaagtatgataatagtataaatggagtgtaccatgaaatcacacatgcagaaaaaaggaaacaaaacccaacatcaagagatcacagaggactttctgggtgaattaaagcttacgtggaatgctgaataaaaatgaagaatcccctaggctataaatagatcacatttagtcaacttacaaaggacaaaacaaaacaatcatgaggaagagaatgatgataattaataacgaataagtgataaggatgattgagatattggcatatgaggatatagcaagatacgagatagaacggaagacagggtctactgtaccaggaacattgtagaatatttaaaggatagattttcttctaaaggtaatgaggaggttttaaagattattttatttctttaaacaagagagcaacacaggtaaggtacccttgactggagaaggactggaggcaaagagatgaactcaaaggctttaataataatggtactggtaagaaataatgaggacagtagaatctgaaaatgagaaattcaaagagcaaggtttattaaatcacttgtggaaataattttgaattaatttgatattaattagaaaataagtataatggacacatttcttgataaatgagctgctcaattcctaaaaggtcagcatgatctcaatgcaatccatggctgcaaccccaaaccacaacctctggccacagttacttgaatcaaaaattgtctttggaaataaaagcagccgtgacatttgttatacagaaaacttttcactttggtggcctggctttaacagatgagcaaatccagtcaaattagagatttaaagattcccactagcaagctgtagactttgcagctggaagattatatacccttgggttgtggggtggacattttcagatttgtgcaagctgatgactaagtctatttgtagaaataggaggatagggcagagcagagagaaaaaaagaaagtgagatgaaaatcatatagtccctgagagactatcagagcagctcagctcccaaaatcttgccagttgccatgaggtcaagtagtcctttcactaccatccttggattttgtgaggcccttcaaagctttacaatttactgtctgttcttgatctagtttacatgggttccattgctcgcaaacaaaaggctctgggtagaaaatgcaaagaaccactaatgatatagataaaatactatacagttagaaatcttttactctacctacaaaagaaattttttagcttctccttgaatattttcagtgaccacatgcataactgtttctgattacaatctatcccatttgcagaatttagatatttgcagccaattctttttattatgattaaatttatcctgattcccattttatttttaaagcaagagctatgactcttatttgtttctttgttttcctcatgccataacctccttctcttaagcagagtgcctaaaaatgtttttaaaattattatttgcatttcccctctcaacatattaactgaagcagtttttcactgatagaataaaatcccctttatctcaaccaagaaggcatcttcatttaacaaatatcatttaatttttttttgttagtaatgtgtttcttatgtatttggtttttggccaaaatgcagctgacagtgcaactttgtatcataatgttggtgaggggcacttaactttctgagtaaagttttagagctcagtttcatatccagtgttaccaatatcttggtagaagaaagggatttaataaaatgaaatgtttaaccatgatggaaagggcattggataaaatgttcaaaatgcatttaggtattgaagtatataatggttacaaatgacatcacaacgttttaatataaaaggatgacatcacaatattttagtataaaaggatattctataaaggtactcacattctccaaagcttacttacgattgtataatttatcaaatttatgcatatatttttaaatagtttgtatattcaatgcctttcttatcctattctttaggcctaggttatttaaaaaagtacaacctagaagatctcaaatttatgccaaattaagtgctggtagattacactgagttacagactttctgcagtgattttccacaacttgaaattttccacctttgaaaattcgtgaattttggggggcagaaactgaatttggatgcaaaaattgctctgaataagaaatagttttatagttatgaatatgtgaacaatgaattagaacttatcaatgttataccaaaactcctctttgattgtaacggtttctaaattcacaaatctatctatctatctatctatctatctatctatctatctatctatatatctatctatctacatatatatatacacatttgtgtatatacaaatgtgtgtatatatatgataatttgtgaattatcaggatatatatatatttcctgaagtcactgtatcatcctagtaaatttgcacaataatatcatatttgtctttaaattatcactcccttgctagtttttttaccaaaataaaaaaacgaatgggtaaagaatatgtgacatatatacacaatagaatacaatttggccataaaaacatgaaatcctgtcatttacagcaacatggatggatatgtaggtcattaggttaagtgaaataagcaaggcacagaaagacaaatattgcatgttctcactcatatgtgtgagctaaaattttcctttcatggaggttgagagtagaatggtagttaccagaggctgggaagggtgtgtgtgtaaaaagagggagataaagagaggttgattaatgggtacaaacatagaggtagatagaaggaataagttctaaaagtccatagcagagtggggtgactattactatagtaaacaaaaatttatcatatatttcaaaatgttaacaactagaagagaggacttaaaacgttcccaccacataaaattgagaaattttcagggtgatggatatcctaaatgccctgattttattattacatgttctatgcatgtaacaaaatatcacaggtactccataaagatgtacaaatattatgtatcaggaaaaaatattttgaaactctattaatgcattttccctcttggaaattatactggtttctttttacttttcattcttttaaaaaagactataagggaccctaagcactaataatttactgttaaactttgagtttcaaatttaactcaaaaattcatagcaaggcactctttcaagagggagaaaaagaacttttctagaaacaacccaagcacacttgatatacatcaagaaccaaagctgagaagacagttcatgaagtcagaagtgagagcagataaagtaattgccacacaagaactctttcagaagtagaggagggaagcaagaagatgagaaaaaagagagtagtgctgatatgcaaatggcttgctccccagtcagtgttgaaattctagggagggagaagatggagtagtttgaaagattcaggttgattggagaaatggataattagggggaggtttcctgcttcccccagtacagtcccggcaagttctaacgtcttcagagaagttcccattttagcaggtgttatggccaccatgcaacaagaagatttcaaatatgtgaacaataaatttgaacttattgttatagcaaagatcttcttggattataatggtatatacatatatatgtctccatataggcaaaattgcctatattgggtgaaatgttgcctagttgagtagacatgagagcagcctcagatggtctggtacactacagcttggagtatgaaatgtgtagttgaaattttaagggcaatggacagcagagcatgcacaagaagttctgagaatgctggtggatttcaagaggactggattcaggaaaagagggttccggagtttgggaactcttgattattggcaaaggccagatctatagtcaccagcactggatttcagaacaacacttgaaagacaagatggtacccaccatatctcagtggacactaggtcatgatgctcaatatcctgaaaggcagaatctcactgtagcaggtgccatgagatcaggttgagacacctaaaatgaagaacatctaactcaataacacaaaaatacatacatttctctgtccttctagatactaccttggcaagggaggaaggaaaaaagttcctaaaacagaaccaccccacagcaaacacacacatacacacacacacacaaaactagtgagagtgtttcaaactaaaagagactgagatctcttttatgacacgtgttactttatatgaggaaatgaaagttcaggagcaagaagatattcatcatagaaaacaggaaaatttacaggaatgtattttcttttatttttagaaattgcatgaaaatttcacttgttataactataacttggcaaactccttcattcatgctgcctttgtggtaactgtatatatctaccttttctaaataaaaccagaatataacacaaggtaacatctaggaagaaagcattagcaaaccgtgctattagccacttcattaaatcaggcaggtcataaaaaacaagcaaagccacattttcaaatttgttcctcagattcattttcacacatcatcaaatctaagtcttcagtgaatatatgagtgttataaatatagtcagcatctcagcctgcaaagaatacactatgagaattaattaccaaagcacttaaaattcatcaaaatcacaacaaagctgacaactattatttacttccatatcagatcagttgaagattaatgtgaaacaagataaatgtatcatctgttctgaactacctacacagtaatcatctctggctcagtataatttccaaatttcactctaacatactcataaatacttaatattacatatagcctgtattttatctgaaacttttatggtgctttaccataaaaataatcgctttcaattatattttccaagccattcaaatgccacactaagaaatatcaacaaccttattttagataccaacgaaagacaagtattgtttccccaaatatctttattacagaaaattaaaaaaagaaaacttttccttaaagttccaaaattttaaattttatattgaaaaaaatcaatttattcaatttcccaaagggaaaccaaaaaaagtgaacagcaaattgactattgaagattaaccaattagtaataaatatatttattgagtttattgcagattattcaattaatatatacatgctatatatatatagcatgtaatatacatatatacacaaatatatatacataaacatatatatatatatatatatatagttttgaagaaaaatataaaataacttctccattagaaaattatctctgagatgtggtaaggagaagaggaaatgaagaattttttttttttaggttaacatgacatagctagaaaaacacgctatatttcaaatatagcagttaagactgatgggaaagtaaacattttttaaaattcatgataagttccccaccggttattgacaggtttatggttttacgttagtaaatattgatttattaagtatatactctttatagaatacaatacagccctaaagtctgagtggaaagcagaaggagaattacaaaagaaatgaaaaataagcatcttccaatgaagcacttaattatgtatgtatgttgtaggcaaaatgaaaaatttaatatggaacacttgtagagaaaccaggcaacagaagataattctttgatgtgtttaaagtttaaaaaaattctgctgggacaattatgtagtatatgaatttcagtatttagacatttgacttttcccattatctcacaaatcctccccactggcaatggagacaccatctccttatttcaacacttataagtaaaaaagagacataaataaaagaggagaaagagttaagggaggaagtgaacaaaaagaaagtatggccctaattataatcaaaggcatccaaaaaatacagaactgaaaaatcaattattccttactgtgtgcctttgccatgcaatgccaaataaaagaactgagtgtacttggattccctcttgcccttcacaccaatgttttgtggaccacttactcatctaacctaatacctgagatgcctcccttataactcttggtaaacttagatgttctctacagaccacgtattctaatgtcaacatgcctcaattagagtgcatatcaagacgtattttaagaatcccttcttcctattagactgttaatgagttcttcgttttaccaatttttccagggcctgacaccatgcctggcctgccccatgtctgacctctgcaaatgttcaatctgaacaaaagatgagctctaagggagaagagaactggctggctaaaaggaatctcaagatgtaacattttcttactgaatattccctagatcagtgccttccccgcaatcttttggggttaaatatttgattttgttcaggacactaacagtggatcaatctctcaaacgtagactcacattatccatgtttgcaatctgataataagcaaaagtcccaagaaatgaatagcaaacctcacagtatagtaggtgagagcacaattcttggattgaattgaatcaaatgttacccccactaggctgtaatgttagaaagttattatatcccaatgaacttgtttcctcccttgcaaaataagcataaaaatagtcacctcaatagttggttgtgaagattaaaaatgataaggtatggtgaatacatagcataattactgcatattgataataaagaacaaatgttgatattatcatgacaatattaaagaaaagaagttgtagatcttgatgatcaatccattcctccattacatgcatgttcatgggtgtcagacagtattcttaatacatggatatattattatataaaacataatggagtttaggttctagtgcagatagaaataaacaataaaaatacacaataaatatgttttatgtaacagagagaagatatatgctttggaaaatataatagaggatgttcgggaagattggaaatgctgaggatgagggaaggggtattgccattttaagttgggaagtcccagtaggtatcatagagaagatgctatttcaacaaagacttgaaagaagtgaacatgtggatatcaggagtaaaagtattttattatagaaaacagcaaatacaagggccctcaggtgtaatgtactgtctgttttgtggaacaggatgggggctggtgcagacaacatggagtgaactagggaaaacatagtatgaggtgaagtcagagcatgagtcgtgtccatgggtcattctaagaatgttggcttccatctggagtaagacaggtagtctggagggttctgagggcaataataacaaaaactgagttttagcatcactttggctgctgtgttgagaacagaccatagagcgaccagggtagaagtatggtttaggatatgtagttagaggactattgtaataatccagatgaaagatgatgctcagaccagggtggcagcaatagaggtggcgaaatgtggtcagatttctgtatgggttgtattgtgtgaaagagagaactcaaggatgatttcaagattttatactaatccactggaattgaattgttatcagttaagatggggaagactctgcggggagcagttgagagatgaagtccaagagttctgctttaagatacgtcaactgagatgcctattagaaatagaaatggagaggttgggtagacatttgcatatatgtgtctgaaggtcaggggagaaatctgggcaggaaatatacatttgagagccttggcctacaaaatgatatttaaagtcacgaggttgggtgacatttgatgagatcaccaaataaccaaggtctgcatttgcagtattccagtcttaggatgtctggagaggaaaagaagctagcaatgaaatttgagaagaaacaagcgatgtaggagtaaaacttgatgtggttttcccacaattagcatcaatagcatcataacagaccttgctagaaatgcaaacctcttaccccacccatgccataacgaatcagtggggcccagcaatttgtgttttagtaacttccaggtgattcttatgcatgctaaagtttaagaaccactgctgtagaggggcagtagaatttggggtaaaaattatgaattttaattaatctccttaaatgttaatacagtgtcactgaacctctttgaggaataactcaactagatacagaacgaagcagtccctcattgagctcaaactcaagcactccacctttagatgctaccacacttagattaatgttttcacacactctatatttcttattttctcattttccattgctgttaggtgtgattgcttagaataagttttattccctcaatttgatttcactaagttcaatttctttccattaaatctgattaaagaaactcaaatttaactaaggttttaaacatccaggcattattagcattccagaagaggggtttgtttatctgcaagaattcccacaatgtggaaaaacagagagagagaggagacagagagagagagaaagagaaagagagagaccaatagatatttgtgtttatagccaatttcaggcagattctgtacttctcaccaactcctgttctcttgccctatcaaagcaaacaaaccaaaataaaatgacagttaacaaggtaataaaaacaccaaaccagggaataaagaagtaaaccttttaaagtcttctttaatatttaaatagaaatatttatcataagacttagcaattaagaatggaaagagctatgttttatatcaattcaacaactgatttggggaaagtgatttaacctctcagagtttctgcatgtttaacgatacaaatgtgtacagaaagtaaatattccctgtaaacttaccacaaaggctgggcttggtctcttatatgggaaaatgctttgtcagctgaagaactaagcagagattaaattgatgttaaaataaatttttaaaatgtatctttcattaagggaagaaactttaggacagggagaatttatcaattttaaattttaaataaatgtagctctttaggagtttaaaaaatatttcaagggaagattgcatatatatagtcttgatatacattgttggcattgttttattgatacaaatggagtattcaaaacaaaaattcatatacttaaataattaagtatctatactcaaatattattgcagtttagaattctaagctattttggcctatttaaatgaaaataacatagagaagagtagaaaataaaatgacataccctatatctatcattaagatttaagaagtattttcctactgctatattatatttagatctctctttaggaagacaaatatgtcacaaaaacaattaaagttggtgcctccgcattccatttctctttatctctttccccaggggtgcctgctatcctgaaactggaatctattattcccatgcaaattcttgcacattatatacataggtagatactcataaacaacatatattatcattatgtatttaaacatttgcataaacaacttactttttaaacataacattaagttttaaaatttatcagtgttgatacatgttgttaaatagtcttctattataagaataaaactatttaggctgctacacagaatcagttaggctgtttccacatttttccccatattataaacagttcattggcaggcattttctttttttaatgagtgctattcaaatgaattcagctgtgggaaattgtttgtggctcattcacatctgacaattctgttcatgggctcctcctcaacagctgtccctactaatgcaagataattttatgtaaaattaatgtttccataagaaggcctcatgagaggagttgtcttctgtggtaggaagtcaagaaccaaaggaaaactataaactcaaagaagaaatatgcaacaaagtaaatcagttttggtgatttcccaggtgattttacaggttctatgccaatttggaaaatgcgttctcttcttttgttgaaaaataaaaaaatacttgtgaaaaaattgttactgctcaacaaatagttctctttcattatattaattagacaaattatgtctttaaagcaataaaaaaaaccctgctaatagttccttgaatatttggcatttttgtgatcagactgctggactaaaaagacttttatttcttgagttgtcttcctcaggagttgacttgttccaggctacaagtgaacaattctgaaaccactatacatgtatgatggaattgggtaattaagtaaatggtgactgatgctgggagccaggcttctcatattggagttggaagttacagacaagcaagctttgaagactagaatgattggtatattactggattagggttagaaacatcaggatgaactcatgttcagtttaatatagatgtagatggataccgcagtgagctgattggtgacttccaaaaaaaaaaaaatgtatctgttctaatccctggaacttacgaacattaccttatatggcaaaatatgtgatttaactaagaattttgagaagagtttattctggtgtacttgggtgggccttacatgcactcacatgtatcctttaagacagggcaagagagagctttgggacagatgagcaggcaatgagaccatgcaagctgagactggggtgagtgcagataccatggaatgcctaaagccacaggaggctgaaagaggcaaggactatattctcctctaggagccttgggaaaggagcatggctctgccagcacctcactttaggacttctggcttccagtctgtgacagaataaatttatatcgttttaagccactgattttgtggtaatttgttaccacagggcagacacaggaaacaaataaaatagatacgtagaagtttttataaatatgtgcatatacaagggttagaatgcacatatgtttactttgctccatctgctgagtgatcctagaagtaatgggaccccagtaacaaagataatgctgactaatataaccttaaagtttccctcagctggactaaattttaacagactttttcctgactctaggctcctgacctcttttctaaagcttttaccttagaaaatttgtgaatataaatatttctatgttcctttgagatataaatcttttaaacagcctctagccagctttatagccaggaatgtctttttcaggaatctggaagccattcttttgcaatgtaatcataaaatagtttcctcatctcccaggctctgggagaatgagcccccaacttcctagggcatgatggttcaagctataaaactaccttcagtcatgaagatcagagaaagtttacttttccattggataaggaaaattagaaaacaaaagtggcctaggattcccctatcccagctcttaaaatttcttccgccatttgttttaaggagaattaagctcagattaacttgtggcctctctccatgtctgcagttgccttgaatgaatcttccttttactgcttttactgtttaaatttgccaggcacagttttggctttgacaatacctagagcctagctgttggtttctaacaccattctccaataaaagaagttaaagatccacggagaaatagctgattctaggactgggttgggaaatatacaagacaagcctggaacattttgtagtgccagaagtgctaaaaacaacagcaacatagcaataaataaaccacacaccaacacacacataaacacacacaaaaaatgatggggtctgtcaaaaggacagcagtgaatagagctcctaatgaccaaagtgtgcaaattttgagcaacaaaaaaggcagaaataaagtagtattgtattacaacttaaaggataaaacaaatatccatgaatccataatcacataaataaatgatgatataagtaaataaatgtgaagaatatagaaatcttacaaaggtttgcagaattcaaaataatttatatggatactcttccttaagtaggtggagcataactccctactctttaaaggtggactgtcaatagtgactttctttcaaagacaaatggaagtggaatgagttcacagagtatggacgtgggcaggaaaaaaataactttatagtgaagaaacccgacaaacaattcctcagccaggtgatcaagattaaaatcaacagtgatatgtaatattgacagtatgtactcttcatatgatgtgatgttaatggcactttacctctgtggtcttcttccccaaacccataactctaatctgatcataagaaaaatatcagacaaatacaagttcagggatattcttcccaacacgtgactagtatacttcaaaactgtcaaggtcatcaaaaacaagcaaagtctgagaaacagccaagataaatattatgtggtatcctggaagagatctttgaacacaaaaaggaccttaggaaagagccaaagagatacgaataaagcttagactttagttaataaaaatatatcaacattgcttcattagttctgaccaatgtaccataccaatgtaagatgttaataacaggggagacttggtgagggtatatgctttctgtgctatcttcacaatttttctgtaaccctaaaagtattcttataaaagcttattaaaaaatagatctttatttttgagttgattttctcagcagataaagaaataaggtccaggtttcctacaagaatgttcattatcttccccagaactgatggttataatccccaagatgagaatgtgctcaggcagcatggtcttaatggagtgatagtgtacctcatgcccagtctccagagcagtttttatgcaaatgactattgccattaggatgaagaggagctgttctagctaatggggcagcccaacatacttccggcatagcttttgaatgtctctttgaacattcactttgtttataattatctgactgtacctaatttgattctacatgaaaatttatataattatgtaattattccattttaatgtaagactgaaacagactgttaccactattcttgagattccacagagaactgcatgcttttgctattaaaagaccactgttgaagtatttgaatattatctcttaggaactgatgaaatatagaggtttcaagcatttccatcagcacacaattattcacaacaaccttctagatgcttattttctatcttttcctatacaagctgcttccaaatcaccgtcattactactgaagaattcaaagtcctgagctcaaaagcaatcagaacccataaggtagcataattaatagtacaaaatttcagttaaatgcttaaatcatagcaaactacaaataatataacaccaaatagaatattattgtctcaatgaggtaatgactcatcaactaaaaccacctaagatagaactttttggtatctgctttctattggtacaacactttcattcttaatgtttcttatggcttcacaggttttagaaataaaacaatacattttcagccttccacagtaatcaacactttcaaaaactgagatacacatatgcatgctacactaacttacaatatacaagtatttggttatatattaactctcaaagaacacaactgtttactattccctttccacaattgttaacaggatgcactttctttaaatataaagtgaagaaaaatcagaaattttgcaaccaatattttccttcagttttctactttatcatcttctgataccaccataccctgaggcagttgttgttctcgggtcagagtttgacctgggcctcctctaagcagtaggatgattattccatgtgctagagtacaatggaggataagatggggggcgggtgccacatgtctaaaaagagtgctgctgatatactgctgccaaacaaatacccaatattcctccagttcccacaccagtccagaatcctggtccagaattttcatatgcttgtcctgcaaaaggacagtcaaaaatagaagttgcaccatggctagaattctgcagtcctgtgaatgcagaataaagactggcatcaggggtcctgctcagttggtgaatttctgacaacggtgggaaatgcacaatactcagaatatggtggcatagaatattgaccattgcttaggaacagtctataaactacaaggtagaagcaccacagtggtaatcaatccactgatgccacaggaatctgcagagtaccactaataaaaattatctgagaggccaggcgccatggctcatgcctgtaatcccagaactttgggaggccgaggcaggcggatcaccttaggtcagaagttcgagaccagcatggccaacatggtgaaacctgtctctaccaaaaatacaaaaattagccagaggtggtggcatgtgcctgtaatcccagctactcgggaggtcgaggcaggagaatcacttgaacctgggaggcagaggttgcagtgattcaagatcacgccactgcactccagcctgggcaacagagtgagactgtgtctcaaaaaaaaaaaaaaaaaaaaaaaattcatccgagaaagaggtaaagctgtggtgttttccagattctgaatttcttcaggccaagttccaagaccatacaacctaagttatattccaagccacaggaacctctttgtacacacaggtgttcaggggattcatagcatttacagcttaccactgtttttttctaaatttgtgtgcaatatctaaatcactctcacattcccatggggtctttccagcccagtgtagagcttgcaattactagaggcaaatgcaggctgtggtagtgcatgcttctgtgcagttacgccaggagctccagtaaaaggaaagtcacttctacactgttttaacatacatgaatttccccgccgtagaattaccatgtacatctaggataaatttattttatttaaaaacatttcggaaagtcccactaccaatcgcccaatttgtcaatataatataccccatctatcacacccacagagatcttaggtataagtaaaagcatctaatgaattcactatgcttggtcatgcctgaacatttacatattaaaatatgtgctatttattatgcattgactttctcttacctctttttttttttaacatttcagagaaactgggctttttaaaaatatttcttctttagatagatcatgttttttatgtgtttagatttaggaagtaaaagagcattggcttagaaagcaatggatttatggtaagtcgcagcagttgggcccagaaagtgtgaggaccactggtccagagaacttctgattctctacctgtcttcttctctaatagggaaagagttagcaggacgtcacttctcagttcctaatcatgccctaagcctggcagtgagaagcgtggcagatgctaggggtgggcgtactggaagggaaaagaaaataatattttccagtgcctagattttggtgttggcaggaaaattatttgcccgtgacaaactgcatttatcttttatggaaactgtgctcaatttatgaactacactcactttaaattaactagaaaccaaagttatattgtgtaaatttcagttgaattccaattttactaaccaaaactcctgttggttaattatacattttacataatattgaattcagataacaaaagtcgagcctcaatctctcaatctaaaacaaaattcagcacacttcactgtagggtaacaactgttaacttattgactaacttttttttctttccttttttttttctttttgagacagagttttgctcttgttgcccaggctggagtgcaatggcatgatctccactcaccgcaacctctgcctccctggttcaagcgattctcctgcctcaggttcctgagtagctgggattacaggcatgcgccactacacctgcctaattttgtatttttcgtggagacggggtttctccatgttggccaggctggtctcgaacttactgactaagttttaaatgaatcagtgctacatttaatttgaagaagtaacaaagagttagagaaaaaacaaagataactggggaattgggtgcaagtccaccataatctgttgacactctataaaaattccatgtgagtaatattttaaccagaaaaataggaataatgactgttctctagagcaaccataaccagtacctagaaaatatgtaataaacaaggaaatggactagaacactaatgtggttttctggcaaagaactatccttacttaaaaataatgagaagaatattcaaatacttactttcctttaaataatgaaaactttaattcatgactcccatagctgttgttaggatttatgagtgaagtcactaaactaacattcattgagcacatgctaggtactatagcaagtgctttgtatattgcatttcaatcagctttccaaataatggtatgaggttattgctactatatatcgtaatttccaagccaaaacttagaaaagatcagtaatttttccaaagtctatataatcaagaaacaccagagtaggagatagatcccaagattcgttgactccaaaggctatttttctaaactctaagctctatttactgcctatatagtaagaggggattagcagcaacattggaatttacacagggaaatacacggggaatgttcgatcatctaaggccttccaataatttttcttttttccaaaagaaagcaagagcaagtttattttctgttttaattaatatttcaaaaaaagccatcaagaagtctgcttgtttgaatttctaagttttcacatcaagattctgatttttaggtttgtccaaagctggagaataataaagtttgatatattcaaaacaatgttttcctttatatgtttttctagagatgggagtctcaatatgttacctagactgcacttaaactcctgtgctcaagcaatcctctcacctaagtctctcaagtaggtggaactatagacatgcaccatcccacctggcttaaattgggatatattaatgttagtcaatggttcatccataaatgaattttcaaaagcctcatttataatatttaaagcttgtatgtaaaaatgcacgtagccttcagaatttgacatatttcccaaattcaatgtagtgccagatgataaaaaaatccaaaagaatgcaacacaataagtatgttgaataaatgttaagcaaattttattttgcatttaaaaacatattctttttgcccatttggaatagacatcatgattttaaacaaagaaactgcaggtacttactatggaactatacaactaaatatgcaaagacaatatttgtgttatttcaaagctttcattggtaagctttttattagcaaaaatataaggaagcttagtttcctgcaagagaaataaatagtaaaaattaatgtctctgagccatagcttgcctccacacaagtagtgaatcatttctcccatctgtcccaacctgaatatatcccttagagatatctgcctttctgggaagagcgttggcatgtatatttattattactttcatttatatacagttctagctttgctgctatcttcctagagccttcagttcttctgtgatgttgagtaagagttatatgttttactggaaagatatcagtcactattattcataattagaaataaaatctttgaattgattagaagataattaatgtatattctaagaaaaaaatctacttttaagatacataatgatacacattagagacaccacaagaatggatagaacttttggtttctctaaaaatatgacctagatgtcaactagagtcttcctcattttgatagttaaataatactaactgctgtccccatatcatggcctatgggaagtctaatgcattcctctttgatgcttttaagtatacaggagttttcattcttgcaacaacctggtcgctccaatgttcttatctcactaaatccttgaatatgtcccattccattagacactctcaaaacatcactcacataaggcttttgtgtgcttatgaggtaagaaacaataatcatagatcaaatagtaatatgcataaacaatagcaatcagaatataaggcattcttattttaagattttcttttttagccatgttttctactcactggcaggtcattttgctgtctggctggtcattttcctgctggggtctctattctctctccacatccatatatcccaattaacatattatatgaagctatttttttaatctctatttcccctcgcttgactaaaccatccccaaataatttttatcttagcaaaaacaaaaacaaaaaactaagatttttaaggtatattccaaggcaaagatagctttctttctgaaaggaccctttaaatatcctattacaaaaacagtttagtctaaatattgtctttaatctcaaataaattgacgaattacttagcaggaggcactagagacttagagtaaatgacaaaaatctctgccctttcgaaactctgtctacctgggaaaatgtacaaatgaagaaggttacagacaatgcactaagtgttataatagagttgtatgggtttaaggagcagggaaaatctggggattagaggtctaggggctcacagattcacatagaaggaaacatctgagctaagactttcagaatgaataagaatttgctaggcacttgggaaattaaggcattccagatccagggaaaacatttgtcaaggcataacgataatttatttgaaaaaatagtaattggatatctttgacagggtatgtatagaagcgatgtgatccaattagacagaaggtaggggatttaagtgatatattttgaaggtctaagtaagacaggctgtggaagtaaacagtagaggatctgaaacagatttcctgttgggagtttggtttcaaggaactcaggtttctggctgaggcatctctgcagaacagcattaaaatatccaatggtgatttttagtttgacatttgatttatgctgatattgatgtgcataggggatgttgaggttagttctttagtagaactaatcaaaataaactcaaggtgccattaaaacagcaaaggcaaatatgtcaataaagatacaaggggaaatcatttaagggggaagaccagtggactaacgactgaactctggggggaaaatctatatttaatggctaaaaagaggaagaatctgagatgggaagaggtctcagaaggaaattggaagaaccaggtgatagcgctttcttagaatcctaatgaaagaattcaagaaggagggagttatcaatggtgataaatggtgcattatgatgcattgagatcaaataagagagtaaaaaatagttattgaatttggcaagtagaagaacagaaaagatagagaaagcaactttattggcatgactaggataaacacattacagtgagtggaaaatgatcaggctagaaatgtacgctcagaatttggtgttgctgccaacacatcaaggtcagacagcaggacttacttagcatgtagcagatgttcaataaagtttatggtataaatgaatgaaaagatgaatggcaaatgaaattctggggtgagccatatccaaaatgaaacatggactatatgttttactatcaggtgctgcattattaaatttagttaatttcattattttaccatactatcattttgaaaggaagctattctgtcattagaaagtacagtccaccttccatgtccaaacagataaaaaatattcaggaaaaaacaattaaaaataacaataaaacaatttaaaatacaaataaaaacaaagtgactatttacaaagcactcacattgcatgatttacatagtattcgcattgtattagatattataagcaatctagagatgatctaaagtatagtgaaggataagcatccatggattttggtttctgaggggtgaaataaaccccccatggatagcaaaggacaacagtaatctattcttgaaatcttatgtttttatagttacttatttgtgtactatcatatttacttctgagtgtgtgaaactgttattttagaagtgatttttgtattgtatatataaagtcttttcaaataagcatatttatgtatccttttacgacctccttaattacaatctctgttttattcactcattctcaaaaagaacaaggaaacaaggtgatactgtggaatcttattttttattagataactacaactggattaattactttaatttctctcttattcaagatgcttttaaattaaatgcctatactgaggcctagatgaatattctgaacacaaaaattctaagaaattatttcagtataaccaatttaaagaacttaattatttaacttacacaattttaatagataaaattaataattaatttaaaaacaatgtttatataatttcaataatatttatcactattatagtaaccaaaataatactatataataaccaaaattattgaactttagaaataaatggcaaaactactttataaggttaatcagaacctcagaaattatggattgaagaatcaacactattaaatatgtaagcatagaactctatgcaggaggagaaagtaagaaaaccttctggttaagtaaattatttcatattacattgtgtccccttctaagtgtaaactgcactgtgtaatatacacattttttttttcttgaacagacttagtcataacagttaattacagagacaggtatttactttgtaaatatagatgcaactaaattgaaagtattattctggaaccaatgtataggtttctgacttgccaaacatgttacaattgaaatgtcaagaaacagtaccttctagtatctaagttatcaatcatgatgactatatcaataaaaacttattatatgtttgaacaatataatgaaaaatatgaatcttttgttatttaatgtttggtggtttaaatatcaaaaattcatgtgtgtagctttccaaaatgataataattcaaataaacaactcagttcaattaatactctaaattcaatttttgactaaattttacataagtgaaaaagtagtttcctatttagaagatatgatcccattcacgctaaacagtaaagtagctttagtcatttttgatgatgtaggttacccagagaaactatattacagatctatgccacctacactcagtccatcgacaacgaaacaagtagttgtaatgtagcctattaaaaatcaaatgagtaattcacattttttccatataataaatagtaactgagtcctctgccattcactttgctcatcactgaggacacagaaatcaaagaccgatttttttttccccctaatgaaagagccacagttcatgtacagagtgtggtatgacaggaacacatggatacatgaaattccagagaagaagcattaatctcacgggctgagaggccagagaaggtatcttaggcgagctgtaatctgagctaaggtttgaagaatgaataggatttagccagataaataagggaaataaattgaagcattctaagcaaaggaaataaaaataggaaaaaaaaccaagaagcattagaatgtaactaactcaggaatacattaataattaaaactgtgcctgtaatattaatggtggtaaattgtatttttcaaagatggataccagaaaatatcctatctttgcatactcttttgaacgttagcttgtcctactcccatcaagatgaagactggacttcatttctttgaatcttagcaggccctgtgagcactttaacccatagcatgtggcagaagttggtagcataaaagacacaagcatagcacttcaattacctaacaacttctaccttctgcttcttgtagccctaatcctggacctcatgtaagaagttcaggaaccacaagactctgcggaagagaggagccatagaggagcactgagctgctagacatgtgagtgaagaaaccatccttgcttgacaccagcccatcaaagactttgcatgatgctagtcccatctgctttccaattggaactgcattgagagactttgggtgagaattatccaatcaactccctggtcagaaaaaatagtgataaggtggtgttttaagcctccatgttttggagtttttgtcaataacagtaaataactgagatataaagtgtctgttttgatggtgatgatggagtaggtggtaagagctggataagtgacttggaaccagattaagaatggttttcatggcatttaagattttggttttagttttaagggcaatgctatggcaaaaagaaattaattgatttaatacaacttttttttgctagaaatggggatttgatccaatttatactaaatatcacaatataaattaaaagaggtgagcactagaatgaggagactcagttgaagggtgcttcagtaattgaagtaaaaatgataagtctgaactaaaatggcaacagtaggaagaaggggatacaagtgatgtcaagatttacctaggagataaaatttgtaggacttgatcagttgtataggagagatataattttaggtacttaattagtaaaaagtgatggcaactcaaattttcctaagccaaagtgggatatgttttcaggataatggtgcttctcttggaactcaaagactgggatgtgtctgggtctcagggacaactggaactgggaaccgaaatgtcactttccactttttaactctgctcctacctaaatctttattttctttctctgtaccatggcttcttccaattttcttattataatggaggaacacatggcctccaaattgaccaagatttacatctaatagttttaagatccaacaaaatctactatctctttctcagatccaggaacaaaatgttcaagaaatcttctgatcagatatttgaaaagaattgattttaatttgctcatgtcctcaaagcaacaaggggagtttgaggtgtagtgaatagtttcttagaagaacaacgattgtattccaattaagggaacataattcttgatcttagatcaggtggacatttatagttctgggatttgaaatataaatgttttctgaactaaaaacgtatacagttatttcagcacaagaactgaaggctgttcagaaatgtataccaaagtttttcttgttcagtaccatgtgagatcatttcaaactctcagtaacagagatgagtcaaccttctaataagtattggtcttctctttctctaaagatagacatttttgggggaataggatctcagagtacagtttgtgatcaaatctcaaaaaagtttattgcatttacaacagcatttttcaaagagaacacctctaaatacgacacacagttttgtggtcacacgaatcctcaaagtgctatattttatgtctgccttcaaggtattcactatatagatgagaagattaaaagctctaagaaatctgtaaacacacacatgcttctaaaactagtattttctaatgtatttgacaacctttttaatagtctttctaatatcccatattatatgttgtaggaaattcatataaagtaatattgatttagatatctaagtccatgatttcaaaatggaaagtttttgtcccaatttaagacatatggtatgtaatatagcataagatataataatgtgtataaaacgtcttcactgatactcttagtcaaatgacattttattgatataactttaattaatgaatgatgttggcacattaatccttttctgtttcccagtagatattatgctttattattctgcaattcttgaaattgataatttataaatcttaacaggcacaattttcaaacagtgacagactttcatgaggagaaaagaaatatttagtcataggtttgtttaaattaatattttcaccatttgggatgacaaagcacaaaaaattacaatttctttttatagaggataagaataaaattagagcacaaatctgtaagtcagtaaattaatagagttgagatttttaaaacatctagtattttaatgcaatgaagagaagaaaacatacagaatcccacaactcatgtctgcagatcaataaaaaggtacagacttgatacatattactgctatgcttcttctgggtacttaaatatggctctaacaaaatataataggccactgtcaaattcagtgttttctgaaccttgtcgcccatcaggataattcagagtttttaaaaatagagacccttggggtttcatcctctaaattaagtgttagttgggatggaactaagaaatgtttatgtttaaaagcatctctggtgattctgacatcactggtctgtaactagccatgatatgtgggaaacactggactgggtgttcctggatcatttggctactatttccaaatactgtaaatactgtgtgttatattatatattccaacttttcaattatctttacttattcatcaaaatgaaatgttattaattagaccaatactttgaagtgatggtagcctaataatattccttgataaatgcacggtggtcattttaccaaaattaatcagatgaatacataaaagtttatggctgtcaattgaataatacttcttatcatgaataatgcaaatgggtttattggggtcctaacattttaaactacatacatgtcaaacttaattaactctgctttcataaccacctacagaatgtcttacccttttttcatgcacattagaagatgcaaaactctgaactgttttccacaaactaacataacatatattgataggacttaataggctatcttacaagtgaaggctaattgctaaaggtgagattaggtaagttgaaaagtggtgctggacatcaaacaagtgggaaaatttgtgcaagtttttaatcaatattttgataggttattatagttcaatatatctaccccctacattaacttccgtggttgtggagtattaaaaaaaaaatcaagcaaaactttatcagtgataatcaaccaatttaagagagaaattccacatatggcctaaaacctgggggctacccattgttgggatccttattactgaaattcaccatcaatctaatagaagctaaaatataagatgtacatgaggactgcacatctttcactttttgcacttatttgcatttttaatcagcaagaatgttgaaaattaatttttatttcaataaaaattcaatattagtttcaataaaagtcaagctgttaatttcttaactgctgaaaatattttttaaaatatttgtagaagtgatctaagttatcttgatgactggcatttttttttccctcaatgagaccatcagcagtaaaaggaggaattaaacaggaagtatttatcaggtctcattcttatatgcttttactgaagtgtatttctctccctgatcaatagctatgcattagagaggacagatatagatcttatatctacacacacacacacacacacacgtatacatatacataaaaatacagatattatacgtatgtataggtataataatataaagagtaatttctaaataaatatttgtctagaaatttgactgaactctgtgggtggagggacaagatcttttattcatcatgatattcccaaatcccagtttctgatagagtaaagactccccaaatccccatatcttaaatggatatttatatcctttctatagaggcatccaatttcaaacttactttggttaaaatccctgcatattttctttcccattgaccaaagtggagaagtatctttaaaactggtcaaccctagcaagctatttaatagctacagtgaatgctttcttactcaaagatctcatcattaaagctatcaattgttccaggaatcagcattatttcagcagttttcaccagctatctttaaaactagtctttgtataggtgaataggtatagaaatttcctttctctataatttaagctaattcataaaaatacactaagctaggtcattactcagagttaaatactttcagattataactgagccttctcaaattaaatggcatttagctcactaaatgtgtaatttacttaaaagtattaatagtcttgagagaattagtgcttatgctaaaatataattacaaactctctggccataaattatttttctaataccatctgagactcagaaaatgtgtgtaaaggcatgccatggcctaatctgggtagcacaattataggggattatctctggaattggtggtcctgtctcaaatctaccattataatagggaaagtaatgtttaaacagtttttgcattattcttgttattcttaagatactccatttatactcaaatcaccctaaaaagataagaatctatcaagtttatgaaataaaactttctgaattcccaggttgtggctcatttctcaaaggggatgtagatgactcattctgcctagtgtataaataatatcattgcataatgcccaattcttctagcaactaagttgaaatatatagagaatcatattcatgcttttccacattttctttgtacttctcaagttgtggagcttggacgtaagccagtacttagaatgaatggaagattgatcagtagttactgtgatctacatttctttatcctagggcaactatattttcatacacattacaatttgatacaagcttgctgacaataattagaaaattcaggcaatcaaaatacaaataaatcaataatagttacactacctggagagaacattcccgtgctttcacatggaatataggatggccctcgcacattggtggtagtggagacagcccatcccagtgtgatcacagagctgtagaacaatgcacatcaaagaagccaggacagcagaaggagttaacagtctctcaaaggatttgtttaggaggacttccaagatatctacagggacttgaaaaatacttgaagaggtggctatgtatttctgatcctgtaatggcaggtgtgggcagagctggtgaaaaagggattactactttctaatttccactctggctggagtggcctggggaagcacacactataatatatgttacgaatatgtgtgtttttccattctatatcacacaatggcattagtgtcatttctagaagagtgtattgtgtattcaaaaggccaaaatatagtcccttctaaactagaacaagtataatacttattctgataagttcttgaattacaatatatggctacttggctagcttaatctattttcttaaattcatttcagagttaatagccctgaaaattaagaaatctttgaaccatttgaaaaagacatactttgtgcaatagctgaaacaattttaaaacacacagagaaaatactacccttcatttatttaaaggagttaagaattgcttcaaggtactctaactgatagaaaatgtgggtaatatcagctaatcatatttcaacaataagagggttaaaggaccttgatgctcattattaaaaaggaatgtgggtgtggtagaaacagcgtgtgcatttgcacgtgtggatgcatgtgcatgcacgtgcatgtgtgtgtgtgcacatataatagttagcaaggatattataggacaataaaacatgacacaatattgtcattccagagttgttgtgtgttatgggtccttcaaaggactcaaattttattttgttgtattctattgggagaaaaataatttttattccaaagctaagttaatgttttcatgttgcataatcaaaatgatgactttgatctaatgagattttataagcacattaaaaattatacccttataattataaacgtaccattagaagactctttttcttagaaactccgttataaacttaagaatgggttcaattgctattgtgtcaaggatttctcaaaaacatcaaaaggaaaacttttttatatttaggtgagatcttgtaaacctctttgaaattataaatgcaagatacttattaagtgattttacatttcatttatttttcttacccaatgctttttacatgatgcttagttgtttttttttttgttgttgtttttttgcaatcttctgtctcatttcccccaacccaaataatttgacacacatcgtttcaaataaattaacatcctatctcagtggactcctttggccaaaatagaaagttcaaatcctaatttgtgggctgacacatgtggcctcctctatccaagatataacacgttattacactttgcactaacagacactgaagagctatgagccttctttcttattcttgtcttttaaactgaggtttgaattgacgtatacctgtgatcctgaataatacaggtactgtagactggaatgtaaaagagacaaaagtaaggtccaaatggtacagatactagaggtagtgtggtaaaggtgtttaaaatattatcaaaagtacgggcatgtctttaaaaaaacagaattgtggtggggggtatgtgtgtgtgtgtctgtgtgtatgtgtgtgtgtgagagagagagagagctagagagagagacagagagaacaggcaaaggagagaaagaacaaatcctaatttagctttagatgtagaactatatgtgaaaggtggaaggtaatcatatgtcattagttttacattcttacatgacctcaccatctgattgtttttatagaaatactagcagagtcatatgtgttttaaaaaagaactaggagaattcattaggatgacttacttctttcataaataaaaactggattgacttatttaataaatgtcctgtaagagcctatgtgtcaggcagaaaaccagactctctctcagagaatacttcttcagatcttaaaattttggtctaaatattttaactgagcttaaatgtgttcaaaaatttgcctttactgcctttcaacatcatgtaaccctagatttataaacacagaaaagcatggaatagaagaaaaaggtcgtatttggaatcgcagagatgtaagtctatttctcagctctagtacaggtgcctctgattctattaagatgggaataagttattaatgaacatacaagcttaaatttataaaatttagagaaataaatctatctgaaaacagctgataatttttaatctattgaaacttctgatcagggaagaatagatatcaacaaatcaccttttatgcaaaagactttctgcccacgttttaaatcaatgagctttgttcctaaatgaaaaactaattgtgtatgtatgtgtgtgtgtatttatatataatcttagctattttatgcaatgatttacataactcactaagtttaaaagtgtaatggcattccaaattttttcctatgattcatttaagataacagcatctatttctattgtagtttacatgagaagaaagaaagacccaggctgtgtatatgatatgagatggcaaagagcaaacttcatgaacagaatatgctgtctcctatgttccacctttcccttatgatattgcagcaaatttaatctcactagtttcagacataacatttcaattagcatagctaataatttagaaaaacaattttggaggctttttaatatgataggcaactatgatagtataagtaagaattagacacagttcatgcttcaaaaacttacaatctctcatgtgaagcaaatagaaatacagtaatgaattaatgaggtaagtgtagagattgtgatgtgccagggtaatacaggagggagtccccccccaaaaaaaacgttaagcaaatctgttggtatgttagaaaaactcctgtccaaagggctcatatagctatcttcctattacttcccctctctctgataaataaattttatattctctggagtgctgtctggggtaattttacaaatcactttttttaaattatagcatagggttcagatggaattagtaacagacgcaagctgccaacttcggtttcttatgtgaaagccacttgttctcaaagggtctccactttctaggcttgcttggtttttgttttctgagtctggttcaaactttaccatatgttcttaaaaaaattaactgcttaagagttgatttatcttgtctgcattgaatagcttattatctttaaccatgcatctacctggagtattcttttgatgaagttttaccaaacaaaattctaactagactttcttttaaccttaacaaatacttcatgttcacatttatgttttgctaatgtcagaaaacaggtatcatcaaagataaaaatcatttaataagttaatattgacagtacttcttttattctaaagttttgttgtctcttaaaaagataggcctttatgtttttcagatctagttttataggtctgtaacagattgtctgttgctaagcattccagaaaaagaaatgtaacttagagggtacaaaaagaaaattataaaatccagtgaaagaaacataaaaattgaatacatctaaaagtagtaagttataagaagaataaattatgctactttaagccaagggttaattgtcttgatgttctttgaatataaaattataattatagccaaaaataattaggccagtacataaaatgaaaataattctgaaaatggtaccctattatatttactgccaagtgtttatttttattctacagatagtcacagagaaaacactattaggggaaaacattgaaaacttatatagttagaactgaagatgataggtaaataagtttcactgaggaatatttcaagaacatgtaggcattttgtaagagagtatgttgaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaaaaaaaaaaaaaaagagagagtatgttgaatgtacaataactacttacagtgaatatttccaataggataatataacattcattctttcaggatattaggcaaggaaagatattcttgcaagtcattgccaatgtcaatagacaacgaacattgtctaaacagagatgtcatggccctcattttttgtctttctttttgaggagtgaatgtctccatcttgtcctcttttctatatatatgttcttcttgtttttaaattatctttcctaagaaacttcactacatattcctgcccaagtatatcagtttgtctatgtcattgcttctgtcttttatctcctctggtttgtgactccactacttagtctgggtccccctttcttctggcatctccactagatcctgagcctgaacttcaaacattatacactattgacagcacttaaggatttactaacacgtgcttttcatacatgtacaacctctgttctactgtcttagatttctcttttccacaattacccttcttaaagaggtagtccaacttcactgtttccacttgcttttcaagtggaaaagcttgtggaacttgcttgtggaaaaacgtgtttactccatactcattgcaatctggtttcctttttagtgaattaaatccaaaatcctcttcttagttcacatctaatcttttaaatatatgacataatatgtgacataatatgactcaagaacaacccctctactcagcatggaggtctgttgagaaaacagactacagctcaccagaagaaatcaacacacgctgttaaaatcagctaattgaactgctttactctaaatataaatgacttaaatcttagcatctatgatgatacactagtcagtcgttattcattaatttgtgtatttaaaagatataaagccattatcatgcagcaggcatcattacagatgctaagttataaagctgagaatcatatggtcccagcatttgtgaggggaaaaagtacacaaataattgtaataaaatgtgttatgctataatagagatatttgccattgcagtatggtatcatagaagatgagtcacttacaaaaaacctttaatacatatcattgtgtccaagtatataaaaacaataaaaaagtattcaacataaatctttttatttaaaagggaataaaaaattggcttctaaagatttttgtgtgaatgacatcaaacatcacacactcattttgcaaaatagacataagtatgaaaaacaattattttgaatgtattattaattctgataaacattgtacatagaaatcattcatcttcattgaacattcatgacattgatcattcaaatagcacttcaaaagcagagcatttgaaatgagaaaatttacagaactatagatttttcaagctgaaggaaagaaacttagagactatttggtccacactcatcattttacaaagaaggaattgatgctctgggagacacttgcacacaaattctctgaagcataactgaaatagaagcgagcctgctctactgctagtgacctttctaccaaaatgcaaactgaccaaaataggttgtctgtacagtgaactgctattaaggatggagttcttttgttggttttgaggtttccggagttggctgcttaatatgattaggcccaaaaatgctaaggactctacttccaatagtatgtagaacactgatagtccttggtgtgaactgtttagagagttatgcaaaataaatgcatttaacattcctgattcactgcttgtgagaggcaagcagtttactgaccctatacctaatacctttgaccatatgcggagaaccaaggaacataatgaagctggttggttgtttctaagttcagtggacaaagtgatgaaagaaaatgatgtactcagggatgctaactcccggcttcaaaagcagatactgagcctcaaatctgctaagactgccctgagtgagagtcttatcctctctgtagagaaagagttgaaattgtggaaaaacagacacaagctcttatcatacaagtggctgacctgcaaggaaaggtgcatgcacaacctcaccagctgtctactgttaaagtgagggcattgattggaaaagaataggaccctgcaactcggaatggggatgtgtgggaggaccctgataaagctggagatactgagtttataaactctgatgaaccttttttgccagaagaaacagcttacccatccccagtagtggtaacatcccctccccgatccatgctgccatcagcctctccacctttgtctgaggagataaaccctgtgctgcctgaggcaacagtgatgacctcccctgaggcagttgccaggcaagataatgttgattctcctcaggagccacccccaacactcctgtttgcttctagacctataactagactggcctagcctcccagcctacatctttctcccgtgctggatgcttcctgccctcgaatatcagactccaagttcttcagttttgggactcggactggctctccttgttcctcagcctgcagatggcctattgtgggaccttgtgatcatgtgagttaataataaactcctgtctatctatctacctatctatctgtctatcatctacctaattcgttctgtccctctacagaacactaactaatacaactgcatacactcctttctgaaagtatttacaatagcctgagaaaaatattttaatgaggactgtgtgtgttttgccaccacttcattttctccaattataaaattatagaccaactcctaaacacagtgttaaactcccaggaatcctcaaatagatattacttaacataactgagattgtgttgccctaagaaattaataaggaaatcaaatgcctagaaacagctttcatatcttataaaaattacaagctctgccccccaaaaatgtcatgggtaatgccacaaatattttctttatctgtcatctgatcacttcattttaggacaaatctataactatttactttcctttgtaataattacttgccagaggcagaccagaatttgatgtattcaaacctgtcacatatgtatatttacagggaaagcacatcttctctgtgggagagaattaggttttaaagttagttcataaggcaaaagtcaatgtattcaaaaccaccctggatggtccctcagggaagcaccagtctgaagatcaaatactgagtcccactatgctcactccaggcatttttcttcagagttagaatatatcactcctcctaggcaagaggacccagtaaatgacctgccctgccataagggctttgtcttatgaaaagtacatgtacgttttggccgggcacggtggctcatgcctgtaatcccagcactttgggaggctgaggcaggtagagcatgaggtcaagagatcgagaccatcctggccaacatggtaaaaccccatctgtactaagaaaatacaaaaatcagctaggcttggtggtgggtgcctgtagtcccagatactcgggaggttgaggcagaagaatcacttgaagccgggaggcggaggttgcagtgggccaagattgtgccactacactccagcctagcagcctggtgacacagtgagactccaactcaaaaaaaaaaaaaaaaaaaaaagaaaagaaaagaaaaaaagaaaagtacatgtactttttaatgtatgaaaagtgtctttatcaactaggattacattcagcattagagagtgctcacttcaagagaaggacacatttttcaagtttccgtattcacattctcttagggggatatacactcattgcaatggattcctgtaagatttcagtggttatttgtgtcccatatttttgttgttgtagaacatgtgtgactgtatttatacaagatacatgtgcaactgatgccattccacttactacatacactttctcatatatctatgtttatacactgacatagatgtatatcagtactcaactgtacatacgtgtgtactgtaagaaatgttttatggtataagtttgtttcaggaaacaactgcatgttgtaagaataaaattataatagtaatgcagtttataaaatatgtaattgttgtataataatttgtctgatctttttccctccctgggagaaactttctttttcttgagactgagtggcgctctgtcgcccaggctagagtgcagtggcgcaatctcggctcactgcaagctctgcctcccgggattcacgccattttcctgcctcggcctcccgagtagctgggaccacaggcacccaccaccatgcctggctaatttcttttgtatttttagtagagatggggtttcaccgtgttagccaggatggtctcgatctcctgacctcgtgatccacctgcctcggcttcccaaagtgctgggattacaggcgtgatccactgcgcccggccaggagagactttctagacccttataattgataggagtgtttttattattaatacctgattttgtgctaataaaatgacttatgctgggcctttagatagttttagaataagagatggtcatgtcaaaaatatgaagcatgtgattagtggatttggggctttgatccatgtaatatttgactaaactcctgactccagtgagaggaggggtctacagattgagtccaatcacttggccaatgattcacctaatcatacctgcatgataaaactccagtgaaaactttggacacctgaagtgaacttcctggttgatgatatgcactgatgtgctgggagtgtgatacatcctgataacaaagaagcttcaaatttgggaccctcccattccagggcttatgtgtctcttcatttggctggtcctgatttgtgtcctttctactgaaactgtaattgaaaatatagcactttcctgaattctatgagttgttctagtgaattattgaacctcggtggaaaatgtaaaccttcacatttatagacacttgatcagaaatgtaggtggcctggcaacctcagagctttcaactggtgtttgaagtgagcatagtcttgtggatgcctgtgtccttaacctgtaaagtctgcactaattccaggtagtgatagaattgcattgcagtaatcatgttcctaatctgactaacactaggtttaaatgaacagattaagttgtttgtttaatatgcaattcatgtaaacttcctcaagaagctgtacccactagggggtggataaaacattaatttaatccaatctgataatttaaacagtttcttgagataaaggacttccatatctcctgctctggctactctctgagatgacagtgcagggtacaggtcatatataaactcatgaaaaaggacaagagtcagaggcctagaatgtgctatcttttgcctcttctgtcaccaaggcactgtcccttgtttgtctgatggtgggtctcctttcttgtattcaaacatttgtctggggttaatataacttgggatctctgttgaagcctggtcgccattgccagttagactttccttagctaagcccctagctctatagagcttcctgaatgggtggccggccctccacctttactgctgggttaagttgctttttcccatggctggcccaattgcaggccttcaggcactcaaatctgcagctttcagcgtgtcctctcagggagatttgatctgagaactcataagtctttccatcctacaggggatacaagggagtgtcttgtctcatatacagaacaagaatgcatgatgagaaaccatccctccaccttgatatgcctttctttttatcaaatacgtcttacatcagcttcatgcctggccttccttttcttccattccccatcttgatggagaggaatagactctctaccctattctctacagcgttactcagtgtcagaggtcaaaaactacatggtataatggggaaattaaaacaattcagattaatttcttcaaaatggtatcttttgttaaataaagataaatattcatatttatatatttaaagaattaaaacatgtatgtggccaaaatagaaaatcactgttttgataaaaatatattagatattgttctacttttcttcataatggtattcaaataggacagctaaagacaaaacagtatttaaactatttaatttagttatcaacatgcattcattttgaatcatgatttttaaataatattgctgaaaatttaaagtagtgtggttggtgagaatcatagcttctttctatgtgttcatatttcattgaataatagagttgctttttttatctttaacaaataaaaacatgatcaatacctagcattagatttcttacaatttgaagaaactttataccatattggttctgctgtacaaatgagagataaaattgctattttaagatgagaattgtacgtaacttttatcttccctaacaaaaagtaatgtgcatttactccacaacgatttgaaagtgtgaataaaaagtgaaataatctaaactccgactactccaacaaaaaagcctttagcttccaatacgtaaaatcactgaatcctatggttcagagaaacaaaactagttgctaatatctttccaggtatacttgcagatttttcaaaatgcattcattgaaaaacatttataacaataatattacactgtagaggaatattgtgtcctatattttaaatttaacaccaaataataaacaaaattagaatattaaacaagtttggaacattgtcattgtggaattaggaaagaactatataataataccaatagcttctacttactggcacttaatcaatacaaggatactgcaaagagctttatttatatatgctaaaattttatttaatacacaaaatataggaagtaagtgctattattgttccttttactgatttttttatagataggttagaaatgattatgtcaaccatccaaggttacaaagctggtaataggcagtgagggcatttgaactctaaactatccacaatttaaaccccaagtttgataactgagagaatgagccatacctataagctctttctccctgtttccaaatctagacacaggctagccagttatcctgaattatttcaaaacccagcaaagcaagtgttcactcttttcccttccccttattttccaacctatgctcattactacttcctatttctcaaatatatgatggctaaccatatggttaacatcatatatattatcttgggaatcaaagatgatgtattgaaagataagttttcactaaacccagtgataatagaacaagagatgctgttttttgacttgacaattacatttaatattgatttgtatgttttcctcaaatgttgataatatttttttcaaaattcattggccccatttattcctttgaaaaatccacactaaagtttttttctcctcccccttcacttattgccagactaaatttagagaaagacaagtgctgtgttgccaaatcgtgaaatgtgtttgggcgaggtgatgagagttggtttgtgagcagtaagggctgctgctatttttgccaagagaagtataatatacatgactctttaaaaattatctattgtgtgtcttttaagcaatcttggttttaaaatctattgtgggtcttttatgcaatcttggttttaaaaattgaagcattctttaacattcatcagttgtgaaaatttttcttaaaaagggggaatttatctcattcctttaaaaaataattttataattacataaaaatataatattttataatatataaaatatatcaattaatataatttataggtaaaaatttatgtattaatttcaaaatagtaactgtaatgtggattataaaaacagtttcaccatgtctaccaggagatatcatcccatcatagaaagccggttcgaaactaactgaagatatgatctcttactggtttatattcttctaaagttttgactggctagattcattgaaatctagattcacaaggtattttcatttatatggtcatatttaattgcatcccctagtaaaaaaaatcatctagaatatttattctattcattatggtgtaacaacttgcatttgatttttttcatactgagaatttttttccctactctactgtgctatgattacatgaaatagctatgataccagcatttatagaatctaattagagtatgcctatgtggagaatgattccaggattgaaaatttcttgcgtaaaatgctttaaaatattcttccaaatcaactctgattttgaatttaattgtggtggcccattactgcttttaacatttctggactacattcttggcattaaacttgtcttgggagtggaaggaagaaggaaaaaatatcccagtaactagtaaacaaaaacaggcagaatattagaaggaaaatattcatattcatcctaccacctctccctgctgccatttgacctagctaccagcaacgtaaccgagcagcttatttgaagagtctattatactggttcaaggactgggaagcagactccttgggttgaaatcccagctcttcacttacaagttgtgccatcttaagcaagttactcatctggaagtagtttaacaagcaaataacctagcatgctggattataataaaggtcaactggttaatatgcatgggtaaaccacttaggacagaacacacagggtacacaaaatatatgtgtttctaaagtaaaataatctcattccttgtgatttataaccttgaaataattatatccatttaataatctactcattcacatattcagaaaacatttacagagtactataactgtttttcactttttttctgggcctagaataattttgtccaatgtgacaagcaacaatttttgtcgacacattgtaggtattaagaattgaataaaagagaaatccagtgtattccatctacttctttcatatactgaagtggcattccaaatgaaatgttgtctaattccgtatctgagccaaagtggtaaacccaatgctggatcatgtagtcttaatatgcaagagcactgaagagagaacctgttttagggtatcccccaggacataacagatatgcagatctgtctgatcaccttgtcactctgctacagccatgctggtctccttgctttgttaggacatgtcaaacaatcttccacctcaggagattcatatttgctgctccttgtctagagcactccacttctcctaatctccctacttctatccctgctctgacacacaatctgcttgacccatgtcctcatctccttcaggtctcaactcaaaagtcaagttctcagtaagccttccttggaccaccctttaaaaaatagcaacttctcccatatactcagcatttttgtcctgctttgttttcctctttatcactatcatcttgtaatataataaatatgtgtttccttaagtattgttttcattttacatgtaaagacatatttattttctttatgtatcctttcccatacagtgtaagctcaattagaacagtcactctatttgtatactcaatgccaaaaacagtgcctaccacatatcacatgtccaaatgtttaataaactttagaataaatgtagttactttatctatttgcctgtgtcttgggctatttgctttcttttgtgcaaactaaatagaacctgcagcaacctggagttatgcccaatgagcactacaaattagtggtagttctctagtagcaatgggacatcctggtgctcagatctgttttttaaacaccttttcccattaaaaggaactgagatcctttgaagaactggctgatttcaggtctaaagaaggcgagcctgagatagttgtgtgtttgtgtgtgtgtgtgttcagaaaatacgcatacaaagactaatggaagtatgtcaaaggacatatggatcaacttgaaggagctttcactggcaaaatttgggatgacttgtgtactaaaaagaagtgagtgtaatttattttaatgcaacaaagaaagaaaaacacacaagtgtattaatattgagagagagagagagagagactgagactcatttgcaacactggaactaatacagcttcattggtttcagagaagacaataataagttaattaaatgacatgtccaaaatgtcaaatatgacttcagattttcagagcgtgttgcagattaattggcagaaacagcatgtgtgtactttctataagctctcaacatgaagggtggaggccacagacttaacagaagagggagcaccacacaaaacagtagcatatcttattctgtatttttttaaattaatgataccctacagagtgggtacatagctgtcattcacattctctgcagcggtgagaaaatagtcaatttcttgctaacaacaacacaaaagtggtttatacttagagcttagatcgccattctggaatgctaaccatctatgttgaaaaaaatgtttatagacatccattcttctgcttctcaaaccacatttggtattagcaggagtacattctcaaagaaggaactgcagaatcagtaactaggttccataggcagtctctatttctaggttatttccggtaaatgtgaatctccacactcagatttcagtgctttcatcttgtgattctgatatttggtttaaccaccacaatcatgaagcacgcctctatctccccaactatgaatgtatactcccccaaagagaacagcatgtctttaatcactgatgccaggggcttcaaaattgttaattaaaatgctcctgtagaacagcagttaatcctagtcctcaatgatattaaattatctttaaaatatttattgtggttaaagaagcttttatcgactccaaggtcctactgtggtcagtagttctttgtaacctaaaaacagcctaatatcataattgaaagaaaaaagaaacaatttgtaaactgctctatgctggaaacactcaaagttggatttgaatcattgactttcaccctgttattagagttttacttaatatgtccagatctgagatcataattttggcttacaactagacagatggtactcaattacacatttaatgctacattttctaatgtaacaatacaaaaatagttatcaggggctgcatatccattttctgtagacacccaggagaaataactttcacatttcctcttttatcatctacttctgtgcagccagaaggttgcatgccactccttaccatctgtcaatgtattgcttgctaatatatttttctttaatcagagaattgatgggacattctggataagattctatttaatagcaaaagatgatcattttttaaagaattagattatacttgagtactaaaattacatgaaacattattgacattctccttaatatttcagatggctcatcagttttgatattccttgtattttttttaaagaaagagcttacaaaaatcccataaaatagaaaatgatcagaatcagaagaggtgatccttatttctatgccactatgttcaccatccctggtgtaaaagattgcatccttctattaagaccaattgaatgcaataaaaaattgcaaaacctactaagtacctttttagtcatatctccagaataccccatgacttttcagttcccatgaataacacaggtgtaaataaaattttgcctgtagttaccatggtgtttttataaatgttttattattattgggaaaaaaaaaacaccactcttctgatagggcttgcatgcaattagtcacgtgtatttatagaaacaaagtcctaatttaactgatacttttatggttcaccttactcttacagatgcaaagtttaattgtttgctgctgtatgcctttgtgttaccaagggttagataacatgtaaccaaaaagactttgatttttctcctcttttcatggaattgtattaaaactaatttgaatgctaaataaattgatgtctctcttggttctgaaaactggcagaatattttctgtgaagcaaaagaacacacactcacacctctgcaatttatgtagaggatggttatataatcatttcacacagatgaactctaaaatttaaaatgaaatatttgtgagaccactgacttttaaatcacctaagaatgttacatttctatcttgttgttgatttgtaaatgcacgtttaatcattacttttcaatatccccttatccacaatggaaatagtttctgaaagtgaagatatatgtatttaagatatctggaaactatagatggtgaatgtaatcgttccaccaaatgattctcaccactcctctcatcagttaggttttatgacaaagcagatagttacaaattcattactactgctgaacagccaaccaatgcaagcatagtgctgtataataatttttattcaaagtgtttcatgagaaatttaaagtctcaattaagcttatgagtcttagattataaatattggcaatgtgatcacaccatatttaacaggtatttatgaaacatttattttgtcatcagcactatgatagacatcggtgatataaaggtgaacagaaagatatatgggctctgctctctggaaagttccattcaaaaagagaaaaaacaatatatataaatgtataattatatactgagataacctgtatgaaagaaaaaatatggggttataaacctataaaacagaggaacatgatcatatctatttggtcaggaaaggctgttatattagctatgatgagattcagttgcatatgtaagtatcacgaaataagagtgacagaaatgagaaagaagtttactactcttttataaaaaagactactgaatataggtgttccaaggtcatgcacagaagctgcaagttgacaaaggtccatactccttctcttttgtttctgccattttaagcatgtgcttccactttataaacaaagatggctggttgagccccagcaatcaggtttgcattccagttagcaagtagaaggaaagctttatgcaacctgttcccttacattagcaggtgaacacttagtcatacagccaaccatagccatcccatttcacgtgaccacaccagcttcccttcagttttaagttcccttacaattgaagggaagctggtgtggtcatgtgaaatgtgcctgattaagaatggggtgtccttcaataaagcagaagaaaagaatggatatttggaggcaggtagcagtacctatcatagatgtcttgagaaaatgactttggatctgagatttgaaggataaagagatgttagccagatggagtgaggaagggaagactgaaaagcagtccagacacatggctgcaccagcctcacttgcaactgaacttgaacttcctgtatccagcagtctttatgtgggaaacaaaacttctttcagtcaatgccattttgtgatttttaacatatgtgattgaacttaatcctaccaaataaaacaaccgttgctgaccctttagataaggcctacttattctatttttactgtttttctgggtctcatgcatgactaatggtttttgttttgttttgtttattaataatagcaggtttactcttaccatgagtttatgatagcatctaatatcacaaacccaaaagtaaataaatctctatcaaggctatataaatgtctttagaatgcatacaaattttataagtagcttcttgaagtatttcttattgctgaactataccaaagattttgaaaacttttagataatcacgtcatattttaggaaattggaaagcattttaaaacaagttattcaactagtatgatttcatctgaaaatattccctgtattttttttggagggagggattggtaatttattcaaaataatttcaaatgctgttaatccattcatttgtttttgacacatccagactcagcatgaatttttttataatacagctgaagatactagaatttcacatacatataatatttcaagtataaattaattgagctgtagagataagaaaataaatgtttatctaattttgttactcaggataataaagtgctttactaaacaggctattttcctttgtagatttacttaataggaattcaaattctttcaacagaaaatgtttccaaaacagacaaacattagaatatcttgtctttcataaaataattatcccaaataatgagcttagtaaaattaacattcctctgcttagaggaaaaccagacattatagtaaaatatttcacttttaagaagagcttttaaaaagtttattcttttattgttttcctccacattttctctttggattggttccctcctgtatgaaaggttcctatcctgtgcacagtattagcaagtagatataaccgtcaaacatatttttcctactaagaagaagccattggcaaatgccagagagcattcattaaaccaccataataggaaatataaccatatgagtgagttgttcaaaacaattcaaagaagaggaggttggacacctgttgacaaacaacatagaagtatataatgtaaactttttagaaaagattttcagcaagaaagtttcattaaattgattgaatgtgaaagatattgatgccttaaaattagagtatttatgacaataaagtatttaggtaaagtgaggtgcaaagataaattgggtggagaggaagagcaggttggtttagctagaaaggccgtgttagcagtaatgaaatatagatgaacataattggttactgtgaacttgtttagtgacaacaaagctgactttcaactttggcagttgtatcagttaactattgttttataagaaattatcccaaaatttagtggcttatggcagtgattatatttagcctgtttttctggttcaggatttggggatggcttagttgagtggtccaaccttgggatctctcatgaggtttcagccagtggtcagcttgagaagtgtcatctggaatctttctattacgagaagatccacttctttcattctgtgaatgaaaaaagtgtttcattcacaggaccagcaatttagtgctggctatgggctggaggccttagtgactttctatgtgggcatctctacagggctgtgtaagtgtctttaagcatggtagctggtttgtgagcaatcaagagaggtaggtagaagctgaaatgccttcatgatctcatttcagaaggcacacactgtcacttgcaccatataatattcacacaaggtgacctctaatttaatgaagaaggggtctacacaaaggcagacatatcaggaagtgagggtgtttgggggttgtccttgaggttatcaaccaaattaggtattattattatcatcatcatcaccatcaccataatgatgaacattagaatatcttgtctttcataaaaaattatcccaactaaccagcttactaaaattaacacccctctgcttagaaagaaactgtaagttatagtaaaatatctcacttttaaaaagaacttttaatgagtttattttatttttatttaaaaagtttcatgacgaggatgatgatcaacatttttattatagaaaggctaatacttagtagcttacatcatttctaatctttataaaatttctttatatcatttccaatctttataacaattctgtgagataggttttattattttcattttatagtgagagcgtagttaaataacttgcccaaagtcacatggttagtaaatggtagcatatctgtccatctgattcaaatctcacattcttttagccatatcatgatgcctctcaggaaatattgtctgctctgggctgattttgctagatatcataaatgcctgtatagtgattgatacacctcttaaatgaagcacaaagtacaggagaaggagacactaatcaacatcaataattcaggtactttaaagtattgtttcccataatagttaaaatacatttaaaaataatgctcattttacaatattagaataagattgccaattttcttctaagtgaagctaaattgaaaaaaatcatgagacaagttattagtgaatatttagctggtcataagcaagtgctttctttacgacttttctaatattacattttttgtatcaatttgtaatttcgaacttttataaaagcaaaagtgacactcataataggccttattattgagatgtagctaaaggtaaaaagataatgaccaaatccactaggagggattgtgtactcgaggaatagcaaccacataatacccctctagtaatgaacattaattgttttaatcaagctctaatttgaaatcagaattttaaaaaactaatcacatttattgtagtggataatttaaagcttttgtttcattttaaacagattctcagtgacagataaatcattatttaggaagagacgaatatcattcctgacatggcaatatattaagtctaagtctggaaattcctggacaaacatatgccctaaaggaggtataagctaaaggtcattattacagagggctgttccacaatttaattagcttattttcatgtgaaaaaagtagtttggtatcctcacaatgcatacatcaattggagttacaaattggcttacgaaggaaataattaaatgacttcatcacacaaatcaaagcacatctttctaaaatataattatttataactgaaggaaggctctgtgaatatttaaccttccattcaccattcttcacatagacggtaccgtttgtagtgctaaaaatactccatctcttatacactattttccaatttgtgatatttttgcataggcatcacctcagattcagattaaaaatgctaattcattttctcctacatattttctgcatcatctctggaggtagtcttggtagtctgcattttggataattatgcattctgaagttcgagaatcactgtaacaattccaaggatcttttactctgatccaagagagagaagagataaaataaaatgcagccaataaaatctgaaactcacaggcaatttctagagagaatttgaattgacagtaacaattaattatattattaaggaacaaagtatttcatttaaatatttgatactttgtaatgatattaataaaatagtactgtaagtacacctgttttgcattcgtgcatgtcaagcctcatgatgggttctttacatatgcagtatctcagttcaccttgatgacaatcccttgaggttggtattcctatctgccccattttacagatgtaaaaagtgaagttagaaagattaaatcccttgtccagaaggtggtaaagaatgattaacactcagctctgtatgacttcaaatgctataaggattccatactaataactttagggaaaacggtttgctattaaaagaaaattgaagctgatttgaatagcacggtatggttgaacatcaaacagattgaaatggaatatctatattttatatggtatttatataaagtacaggtagcctgatattaaatacacattaaatataaataaatatattttaaattttaaaatattttaaaacttttatgttaaaatgcttacaataataaattatttccctcacttataacttctctctaccaaataaacaaaaacatcaacaactacacacatgcataaatgataattatatcctgttagatacttcatattctatagaaacgatgtcaactttaatgaatatatcgccaacataaagcttggtacaacatgtgctttgtgccctttgagataattacatatatcctttatatatttagacatttattgaacacccacaatttgttcacctaaaaaagtgtatttttttccttaaggaactcacagaatcatgggaaaacagatatgcataattaaatcagatatgtggtaattattataattgaggtaagcgcaacattatatgcaatctcaacaagagtaatggtgaacctaaattgagggactgtgacacattcatatattgcaccggactctgaagaaacagtgagattttagcacacagaagtagaaaatggggaaaggatggcacagaaagaaagtgttagaagaagtgaggactgtacagatgtcatagacacttttttttttttttttggtcttaaaggaaatctaaaatctccttgagcacaatctgtggtgtaccttgttatagcaggtgggacagtgttgggacaggggttgagcaagccaggcacaagaccagcagatcacagcatatacatgattaaacgaggtccagattgggccagccacattttctctgccttgagtagagggctgtgagtacagttaaactatctagtgatggatgacattgtaaagagactgcccttcagtgcattctagtacagagatctccaaagctgctttgattcctccaggactttacgcgcaggtcctcttctctgtgaggcctctcctccccatatcatttaaactgcacactctaacactcccttcccacttcctatgttccctatttctccttagcttttatcactgcccagcatgctatacatcatcctatttattttgctattatctattttatcctattagaatataagctccatgtttcacttccttgccgtaatttatccagtaactagaatagaactttgtacataatagtcacgtgagtcaaacaaaacaaaacaaaacgaacaaacaaacaaacaaacaaaaacaaccctgatatttttggttttctttcagtgtttctgtatcattctgatacatttttattttgtttaatgtgcccataagtttctgctgctttcaactgcaagcctcaactgaatggtgttttaaaatgtataaaatgccttccaatatattttctcttcaaccttgagaaacatatttactatttttattactttaaaaataaactgaacctcggggaaattcaatatttgcatattaacgtttcaagtttagatataaggcccaaattcatatttcctgctccttgcattttgtagtccgcctcatctagaaaatccccaatatcgagatttgactaagattccatttttaatgattattttactccaatacttattgattcatatttatatccaattgaaacatcttgtttacattcacttttatgtattcccacaggtttctcaccagacatggtgaacaataataatgtattcaaatcaaagagtcttgcttttgaatagatggaattgagtttctcttccatgttcttttcctcagactacataatgcctgtgattttcttcatcctttcttcttaagatctatttttcacttagtaaattatattggcagcatttcatattaaatatttctctatattttttgaaaatgtaatatactaactggctatattaataaaattagattaacgcaatattaaaaataaggctaattttctaggcctgtgagtgtatttgacccttctctacaaaagcacaaattctcctacctttcgtttagcttataaaaaacactatgactgtccctctcatcattatctacaatggttgatgtgctcacacgtccttcaatgcatgtttcatactgctacttattctttcttattagatatatgtaaaagttaaatttggggattacttaatagtgcaaaatatattaactttatttcagttacaatattttacaaggtaaaaaaaaatcttcaaatttgtattaccaaataacatctattcacttcacatatatttttggagtgtcacatatgatgaaatgtcctgggaatcatcattgaataaaatacattttcttggaatttatgtctgtaacatggtactataataacattaagcaaagtacaattttccggggagtttttctatttttttgagaagtgaaatatattttcaataaaaatatcacttcctatgttcattacctaaagaataacccatattcagtcagttcaacattactcattgaaaccttgaattccttgcctccttaatatttcgtggcatctgccaatacgtatttccatttcaattctgtttagaaagataatcacagaaatctacttaaaagacagctacacatctatgcttccaattgcaccttgactctcattgctgctaacatctattatcccccaaaaagacattatttccaatatttcccactctcctgaagcatgcaacgtcattcctgtgccatttacttttggtacagtgattaggataaagccatttgatgtaaattgtttcaaaatgctttctatcaagttttattacgtctctttacccatcttctcttttccttttttttttctaagaaaatgaagcattagtcactacaaggtttatgtgctagctcttaacctcacccttttcaatttcttcagcattctctgccttctatcaataaatacagtaaagatcagagaaaatacatattttccttcttgtcatgcaaataacctagaagaatatttaaaaataaatataggatgtttaagatttattaaaacaaattggccattgctttttccagtaaaacatgctaaaacagaaactagcctgttctcagaacaaggctcttagctgatggagtattcttcataattaccatcaccaatgggttgtactgaatgagtgtgtctatgtgtgcataacacaacatggagacagggaatggcatccctaaagatctggaggcctagggtccacagtatgttttagaacttcaagaaggtaaagaaaacaaaaattctagggaatgtctgccatggagaagctctgcctagaatggtccctcagttcatggcccattggccagccataaaccatggctggtatgtatgtattaataaaatacttctttacttatgtttttgtaatataattatttcaaaattcctcaagactttttaaagaataaaattcttcctcaaattctttctcaattgacacatttagaattaactgattcttttagcacaatataactgcatcttacaatcgtctattaaaatatttgttttaacctcttatgctttacaaaaactgctccctgaaaatatacttcacatctaaagcaagttcttgataagtgtttcctgaatgaaagaacagtgtatgcaaatatttgaaatatattgttgttaaaacatgtgattccttatatattaaatatttaacattaaacaaaattgtgttaaaacaaataatgtagtcagacagtgataaattataatgctcgaaatacagttaatgtataatattttatttatgatgccatatatcatttaggatttcaaagatggcttcattttcagcatctgtgtaacatcaaccaactacacctatggcttcttatagtcctattataacctcagagctggatcatcttaaaaagagcagaataataatgtgccaaagaagacagaagtacaggataaagtatgctacagttatacatcatctaatgactggcttgtgttctgagaagtgcgtaattaggtgattttgtcatgtaaacatcatgacacaatacataaatctagatggcgagcctactacgcatctagcctatatggcatagcttactgctcctaggccacaaacctgtacagcatgctactgtagtgattactgtaggcattgtaatatggtagtaattgtatatctaaatatatataaggcctatctaaaacatatggtaaatatatagcataaaagaataaaaagcattatatataatatatatatttattatatacaataaatttattatatttacatattttataattataaatataatataattatattatataattatatattaattatatttatatataatatattatatattaattatatttatatataatatattatatattaattatatttatatataatatattatatattaattatatttatatataatatattaattatatttatatataatatattaattatatttatatataatatattatataattatataatatataaatataatatatataatatataaaagaataaaaagcataaatatatagcataaaataataaaaaagaataaatatagggcacttaccataaatggagcttgcaggactgcaaattgctctgggtgaattggtgagtgagtggttggtgaatgtgaaggcctaggacattactgtacactactgcaggcatagtaaacgatgtacacttgggctacactaaatttacaaaacatatttttcttccttcaatgataaattagccttagcttactgtaactgttttactttataaactttaggttatttttttcactttttgactcttctgtaataacacttagcttaaaacataaacacattgtatagctggacaaaaatattttctttctttatatccgtattctataagcttcttttctatttgatttttgtttttactttttaaacttttaaattaaaaataagacacagacatgcacattagcccaggcccacagaggctcatgatcatcaccaccattgtcgtccacctccacattttgtcttacaagaaggtcttcaggaacaataacacccacagagctgtcaccacctatgataatagtgccttcttctggaattcttcctgaagtacctgcctgagactatttcacagttaagttttttttaataagtagaagtacactccaaaatatcaattaaaatattgtatagtaaatgtataatccagtaacatagaagtttattatcattatcaagttattatgtactgtacataattgtatgtgctatacttttatatgacttgcagcatagtaggtttgtttacactagcatcaccaccagcatgatgcattgtgctatgacgttatgatgtgtatgatgttatgatgactatgatattatgatggctatgatgtcactttgtgatagaaatttttcagttgcattgtaatcttataggaccaccattatatatgcactttgtcattgaccacaatgtcattaagtggttgtatgactgtatatacaaacattacactgtagttcagaactgttgcttttgcattaattttattttgtagaaaacaaccaataaatacaatgttttctatgaatcatgtgtcttttcttcaccaaaataattacaatcaagaatatttacgatacaataattaggttatgtccattgcttcctagtgtcattgtccagttttctatttaaagttgctgaggtttgctttttgatataacttaaaatatcagtttgtgatattcttttaacatgccagtaatagcattgactctttttgactcccagtgatacaaatttctttaaatctttacatgttgtatgcagcacttagcatacaaagtcagctattctcttttaatttgtagatacagtaaattatattttaaaattagctaaattcagaaattggtaattttaatatacatatttatgactataaaactaagatggtaataaaagtcataacaaagattcaatatggtaaacttcaaaatgaattatataacacaatttaaaaatacacaagaaatgcatttataaagaaatacaagaacactttcaaaaggatacttagcattctgaaaatttatattatataagcacaaaataatgtatatattataaggatcttgacaagtcaatatattttactgagcttccctaattgatatataaaatacttaaagtagtgcctgtgctcacttaacattacatttctctaaatttaagataagccaataaaaagattatttgtaatcttgaaataaattatgctattatttaaaaagtaccttcatcattaaaacaacagttaatcttgagttccatctttactggaagtaaatacttttacaagattccatatatattccattgagcttttagaataaccttatgacctaaatattttttttattttccaatggtttaggaaagtaaaaatagagaaataatttcacttgcttatagtcacactctagcaaactgtagaacctgtttttgaataatgtatttaattccaatggtcattgatatggtttgcatctgcttccccatccaaatatcatcttgaattgtaatcctcacatgtagagggaaggacctgtaattcccatgtgtcgagggaggggagtgattggatcatggcggcagttcctcctatcctggtcttgtgatagtgagttctcatgagatctgatggttttataaatgcttgacagttcttccttcacactttctctctcttgcctgccacttgtaagacgtgccttcttccccttccaccatgattataagtttcctgaggcctctctacccatgtgaaactgtgagttaattaaacatcttttatttataaattacccagtcttgggtagtattctttataccagtgtgaaaatggactaatacattaatgttcttaactattatgaattttttagaataattcttgttatttgtaaagtattttgaaaatataaaaggaaaaagcaataaaaatggtagcaaagttaaatatgaactagaattaaaagtaaatttggaagtagaattatgtaattgaaattacccaatttataataatattgtctgtatgtacatttaaagtcaaagcacttctgtttatctgtctactctagagaacagaataatatgctattgtgactttttgatagttttccttggggtaactctaagatccttgagtgcagaggcctagtgtttttctcaacattgttgaagtctgacataatggtgcctcacaacaaggtgtgtcaaagttagcaaactaattttagtctaaaatttaaatatgaattcatttattcattcaaaaagcatagaaactttctatatgacaggcattatgctaggtgtcaataaaaatgtgaccagttaagtgaaataaattatatgctctctaggaattcccaatctagtggtgcagagagacaagcaaaaaactaagggtagtataataatgcaatacacatatctttattatggtaaggaagtataagaacaggagaatttatcttgaattaggtttcagggataatagtccaggatggggttgaatgggaatataagcttccagaaagtatttataaaataaagctaatacacacatttaggagtcaggagtatctaactttaagtaacttcaggggtaatattcaaggaggggtgataaggaaaacaacttccaaaatgtacttacaaagtaaaccaagcacacacactcaaaataatgataattctgtgtaagtgaatgtgtccagccccaccctactcccaatctcctcattctctgctaaagccatttcatctacttccatggcttcctctacccagtaaccagatgtctcccacattaacatctactactcaggcagacctctttcctgagagccaaacctgtgtttccagctgtctaatcaatctgttcaaaactgaacttaatatattgttttccaaacggctccttctccatattcatctctccttcactagaaatattaaagataaacctgacctttcctcttttgcctcttataatattcagcaactttataaattcttttgaattatatttattatacctattaaatatgttttactttctcttttattagctcacatccttgccaactctagtgtgatctatggaccataccataccactgaaaccactgtttcagtagctgctttattgggctctttctaaccacctggactgtactcagtgtattaaatactttatatcaagaacttgccaagtcatttacatacttccaatttctttcccctccagatgatacctgaaacatagagttattttagctaggtacaagtgaaatacacttgtatgcctaaacctgagaatcataaaagcatttatgtgattttaaggaggttgcactaaatcagaataccagcaatgactatatgacactaagtaaaacattcttcttcttaatttgtaataaaattcatcacctatttactaatcatggttttgtattaggcaatctgcttgatgtctgtgaattaacaatgagaataaggatgcagcacctgccctcatataatatacagcctagctaacttgtattaggtagagacttctgcaaatggaagagttataacttcctatctggagccccaaaggctactcattgatttctatggttgctatcactgatatacagaacattcttaaaaaaacaaaggtgtgtatttatgacagatgttttccttgagttgccctttatatctttcagtgcaatttcaggatataagtttattggaaatttgattataataaatatgtatttgcaactaggaaaatactatcagtaacgactacatgagggggtgtagttaaataaaagccttaaatttaaaaatccagtgaggcaatgttttcaagttatggagacaaatttctgtaaatgtctgccctaataggtaaacagtattggaaattacatagtttagaatacttttgttgctgcatgtaataattaacagtttaggcagcagaatataatggaaagagcatggatttttgtgttttatagctctggattcagaaaaactatattactccctctttgcgttattaaatgctgatttgggtacctttatggaccttcattttttcatctctaagtgggaaatcatgacaactcatctgcattttttttaaaagctactgaattgttccctctgttctcgtccaaatcccaaccaaggaaatatccagtattctaacagcaaatccaagctttttttcactcctcactgaaaattcttaaacccaaatccaaggtcttagggattacagttaaagctatctttgtattttggaggttgcatactttatttttagccatttcctgtctctaggttatgttccagttattttaaacatctcttgtattatctctgccattcataagcatgaatgcatataattgggtgacagagcaaaatactgattctctctcttggctgggaaactctgcctatattactgggtaatcttgcagctaagaggtattttgtatcatctgtatattgttactttgtcttcattaattttatttgaacacataacacatgccaagcattctgagaggtatttccagatggatttaaaatttatctaccataagaagttatatggtcctccaaataatagaaaaataatggcagactcttaggtagcaacaaaatgacagaatgtagaaaatcttgttctttgatgaaaagccagaattacctcaacctcatttgattacagagatatgatgctatccatatactaattaccattagtatcttttttctttttcttttttattttctttccaattttatttatctatttatttatttttgaaacagggtgatagggtttggctgtgtccccacccaaatctcaccttgaattttaactctctcaatttccatgtgttgtgggaggaacccggtgggaggtgattgaattatgggggtgggtctttcctgtgctgttctcatgatagtgaatgagtctcacgagatctgatggttttaaaaatgggagtttccctgcccaagctctctctctttgcctgccaccatctatttaagatgtcatttgctcttccttgcctccgccatgactgtaaggcctcctcagccatgtggagctgttaagtcctttaaacatctttttcttcccagtcttgggtatgtctttatcagcagtgtgaaaacggactaatacagtaaattggtaccaggagtggggtattgctgaaaagataattgaaaatgtggaggcaactttggaactggataactggcagaggttggaacagtttggagggctcagaagaagacaggaaaatgtgggacaatttggaacttcctagagacttattgaatgactttgaccaaaatgctgataatgatatggacaataaaatccaggctgaggtggtctcagatggagatgaggatctctttgggaactggagcaaaggtgacccttgttatgttttagcaaagagactggtggcattttgcccttgccctaaagatttgtggaactttgaacttgagagagatgatttaggatatctggcagaagaaatttcaaagcagcaaaacattcaagaggtgacttgggtgttgttaaaggcacttagttttaaaagggaaacagagcacaaaagttttgaaaatgtgcagcctgacaatgctatagaaaagaaaaacccattttctgaggagaaattcaagccggctgcaggaatttgcataagtaacaagaagctgaatgttaatccccaagacaatagtgaaaatgtctccagggcatgtcagagacctttgtggcagcccctctcatcgcaggcccagaggtagaggaggaaaaagtgttttcatgggccgggcccagggtccttctgctatgtacagtctagggacttggtgccctacgtcccagctacaccagctgtgattaaaaggggccaaagttcagctcaggttgttgcttcagagggtggaagcctgaagccttggcagcttccacatgctgttgagcctgtgggtgcacagaagtcaagaattgaggtttgggaccttctgcctagatttcacaggatgtatggaaatgcctggatgcccaggcagaagttttctgcaggggtggggtcctcatggagaacctctgctatggcagtgcagaaaaaaatgtggggtcaatctctactggggaaccaccattgcttgcctccagaccccagaatggtagatccactgacaccttgcactgtacacctggaaaagccacaggcactcaacactggcccatgaaagcagccaggaaggaggctgtacctgtaaagccataggggtggaattgcccatgaccatgggaacccacctcttgtatcagcatgaatggatgtgagacatgaagtcaaaggagatcattttggagctttaagatttgactgccctgctggatttcagacttgcatggggcctgtagtccttttgttttggccaatttctcctgtttggaatggctgtattaacccaatgcctgtgcccccatggtatttaggaagtatgcaacttgctgttgattttacaggctcataggcagaagaaacttgccttgtctcaggtaagactttggactgtggacttttgagttaatgctgaaatgagttaagattttgggggactgttgggaaggcatgattggttttaaaatgtgagaacaagacatttgggatgggtctgggatggaaaaatatggtttgattctgtccccatccaaatctcatctttaattgtaactcccacacttcctacatgttgtggaaggaacccagtggggtgtggttgaattatggtggtgggtctttcctttattattctcatgatagtgaatgagtctcatgagatctgacggttttaaaaagaagagcacaagctctctctttgcctactgccatccacttaagacatgacttgctcctctttgccttccaccgtgattgtgaggcctcctcagtcacagggaactgtaagtctactaaacctctttttcttcccagtcttgggtatatctttatcagcagcatgaaaacgaactaatacacagggtatcactctgtcacccaggttggaattcactggtgcgatcttggctcactgcaacctctgcatcccaggctcaagtgatcctccgacctcagtctcccaagtagctttgaccacaggtgtgtaccaccatgcccagctaatttttttgtatttttgatagagacggggtttctctgtgttgcctaagctggtcttgaactcctgagctcaggagttccacttgccttggccttgcaaagtgctgagaacacaggcatgagccaccatgcccagctaagtatctttttgaataaaatttcttcatgcaattgagattttcagtttacatatcagtctcctatttcaggtgctaatcctatctgccaagtatgagactatatacaataaaaatttaaagttctcttggtaaaataagaaaaaccccaattaataaaaatggtaaagaggtattaaaaatcctcaaaaaggctttggctagctaccatagaaatattaaaaaacaataaaattaaaaaatttccttggtcactcatgtatctgttacatatttttaataatcttactttgtgtggtacacaagcaaatttacatttatacatctttagatactatccctattaataaatagttacgtctcactaactgcctatatagttaaaagaaaaataattagttgcttactgtgttaaattttaataggtaaatcatttatttttgaaatatattttccaccttacacacataatattggtctccatgtatgaggaacacagcttaataaaatggtcttggggattataacgaagcataaaatttgttttggtagcagtatgaacaaataaagaggattttttacaaaaggcatttaatacagtgtgcaggaatgggtgaaggcttcacagaggaggtagcatgtgagataagtctttaagaaaaattttccagtgggcactttgagtgaagaggcaaagacaatcacacagaagagcatgcaaacaacttttttaggaaagaaagtagagtgtgtcccatatcaggaaggtcttttttatgccaagctgggaagataatttctgtcatttaaggcagtgatcccaactggtggtacctgtccatggcctgttaggaactaggctgcagaacagaaggtgagcagtgggcaagtgagcaaagcttcatctgtatttacagctgctccccattactcacattaccgcctgagctctgcctcctgtcagatcagtggtggcattagatgctcataggagtgtgaaccctatcgtgaactgtgcttgtgagggatctatgttgcacctgccttacagaaatctcatgcctgatgatctaagatggaacatcttagatcccttccctgaaaccatcccttcccgtccccctctcaagttcatggaaaaattgtcttccagaaaaccagtgtctggtgccagaatggttggagaagagaagtattttaagcacggaagcaggaggttactatgtttccaaacctatagtaaagtttctttctcttgttttcagtaggtatgaagagttagccacttctatacatagttctgacagataatgttattaatgctaggattcaatggctaaacaaataaataaatatatcttaaacagaaataattcttctatgggcccaggagataaaatgccttctatcagaaattattcctttggtttgaagaaatgggttgcgaacttcgttttgttttgtatgtgatagtaacacactgttgttatttatgaaagtttccacagagaactcataaataaaaaatgtaaatgtagaatagagaaacttggtgagcctcaaaagaatgtttcgtagcctggtggggtggctcactcctgtaatcccagcactttgggaggccagtgttggaggattgcttgagcccaggagttcaagaccctggaaaatatagtgagacttccatctatacagaacattaaaaaagtaactgggtgtggtggtgtgtgcctatagtcccagctacttgtggggctaaggtgggaggatcgcttgagcctgggaggctgaggctgcagtgagcttttattgggccactgcactccagcctgggcaacagagcgagatgctgtctaaaaataaaaataaaataaaataaaaatattttccctgctgttgctagcaactactgacaaactcccatgaaagtttaggactgtgcagatatggtttgaaaacagctgagtgaaggtatttaatttcgaggaaatgaggggagccatggtggtggccaggatatctgggaggaggaacacattaagtcatgattaaccactcagtagggttagtagagcaaatagatggtgttatttacaaagataaagctatgaaagaacaaatgtagaatcatgttgagacatcatttttatggacataaaggtaacaaaattcactgtgtttatatatatatatatatactttaaacaaacatatatatatatgtttgttttaaagtaggttttccatttgtatatatttgagtcctacaaattgacacttctaatgcataagaatactgcaaatattattttcctctagtagctcttaattttaacttttgtcaattaaagggcattttagaaactacattctagaacttgacttttgatgagaagtcattcattagacatacagtgcaaattgagtgctggcatcatccagggtccaggcacctctgagtagaaaactgcaggcacaagtatattcacagtaatataaaactgatgattcacacataagggaattagcttaaattgagtgttacatattctattaaaaaaggcatatgtgtttgcacagaagtatgaatgtgtttgtctaaattaaagatgcaatgaagagcaaggtcttgtactaagaatatccttcaacttcttatttgttgccttttcacctttgaactgcttaggtcaaatacattctaaatcttactcttaaaatgtgatagcataccatgtcagaaaaaaatgacaggatagtttggatgtttaacgagaatatggagctaaaacacagtattattcatgctaagctctcttaaatatatttgcatatgttaactcctgtgctagaattattttaaggaagtaagcattaaaatcccaactccttgatgcagaatcattttagaagtacatttgcaccatttcataatgacaaccatttttgaaaatttaatcattttctcaagatacagtttttgacaaatggtctgttactttacagcatctcatttgtttttatagcatttcaaccaaagaaaatatgctgcctcaatatgggttaatgtatataggtaagaaaatcatttaattctttataatcaatatataattctaataatcattcagtataattgtaataatcatttaattctttcttttggaaaaaaaaaagccaagagttgactattatataccttaatctttgtgctttaaaaatcttctttctctctttcttccaccaaaggcaaaaacaaatgacaatagcaacaaaaagataaacatcaaaacttaaacacatattgtctgttatagacctcaggatcaaatattttaggaaattaaaaatgtagaagaacagagtttatgtttggtaaaatttatatcttatcttaattcctacggtttttacaagaatatgttattatcgacaaaaagggggtagttaaaaatcgttgcagtgtgttttcaaagaaagtcacctgccaagaaaggtgtcagtaagatctttactgaaagaattgtaaaaagcctctgtcatgaccgagcatatggaatgaactgacccttaaactttaagagactgaagtagaatacctaatgtcaaatgctacccaaagagccagctgcaggatattgtaagaggtgttcatatctcagtgtacagaggagaaaaaaaagtaataattctgtacagcagccccagggcacttgcattttgaatcactgccacaataagcagatcaccagtaggaagagaatatattttgtaaaaccacagacttgcactatcagtagacatcagtgtaaaacagaagaggcaacagaattaaaaatagaagtatagaaaggggagagagaaagagtaattatatctactgcctacagtttgcaaaggcaagagacttataattcagatgtgcatttatttagagatcccttcaaaaaattctgaccacctttattatattaattctctaggccgttatacttattttttccaagtatggtataattatacagccagaataattaaatgtcaggctgtctatatttccataatgtataatatacagggaaaagaatatcaagttcctttttcatgtaacgatgatatgactgaattacaaagtaaaccttaggaatgaaaggcacaatttgaagataaaaagaagatagaatctgatctagtttagacttagccattttctagactgatggctgatttattcacaggcaattgaaatacatttagtaggtaacagctttctaactcatatttatattataaatcattttgacttttcgataacacagaaaatcttccatcttaatgagtttctactctatttcaaattggaaagcatactaaacttggttcttaaacctcctgtattgtttattgtctttatgttatacacataagaaaattaaataatgggaattatgttaaactgtgtatatgaaatgcaaaatatttttctaagccaagaggacttagtttgcaaagttcataaaatgtgttttaatcttactctttctgcgacgcacaaggaaagtaactctacaatgtttaccatattataaccataaataacaatatcaggagacacaacacatctcataaaccttcaaggatgacactgtagcagatttaaaaattcctgtggaaaattgtgttcactatttttttttttaattcacagagactcctaatgccatcctatacccacagtttaaagtagattaaactgacatgcacattattcattccatacattttcttcaatacttccaacctttttaagtctttcttcctttatatagcactttgttaaaagtttgacaatacattaacttactaagtagtgaagccatttaaagcacacttacttgaaaagtgtaaaaccgggtcccattaggaggatgcactttaggggagccagaaacggtgttcatatccgagaaaatcatttctgatcactgagacaatataatccacaaggagctacagatgcagagcagagagcttagcgtacagataaatccgtgcatgcattgagggagactagagggtaaaatgaaatctgccccatccttcttacatacacagtgatagcattttgaattgttcttctacatttgaaatcttagctgaaagatcatcagccaccgaccttttgtgaagctagttctctagaacatacaatgttttttaaaaaattaaaaacacagaaggaaaaaagcaagaaccaacgataaatggagcttgtgcagaatctggcagtgctgtggacctgcccatctgttctcagtgataatcacctccctccaccacagtctagcagagtgattatgctaaatatcctggttaaccaataacatacagtttcatttcagggaagcatgcacagtgtattcagaggacctcttctgactaacctgaagcatgtttcatatactgtttaaagctctacttagtaacaaattgctgttttatcactcttatttctgtatctttctaaatcttttagtcactcccagacttttcaacaagatgtgattttttttttacaaagcctttttttttttaaagggagttcttttataatttatagatcaaagtatattacagctgttacagctggcccggatattgagaggcaattgcatacaattcagtaagactgtatatactaggagtactatcaaataaaatgtaccaaatattttccacttttctgaactgctatagaatgtcatgaatacgaatgaaattattattatctcatttccccatcttagctaaaaaatcattatgtttgacaatcagtgcttcaaaaagtaccacatatttgttttaaataatcacaaccttatttcatatacatatatacacacaagaattaataaaaatatttaatacacatgaagattttcaactcaaaaatccaaaaatattgaatgcaaacatgtaggttttgttgcaaaatatgttctttttgtatatctttaacaaattcttcaatttgtacaaaagatcatattcagatgacttgacaacttttagaggtaaaaataaatgttccatttacacatcgttcaaatgtggagacttcagtaggataggaaacagaataagccaaaagtggtgtctttgtgaatgtatctaagatgacatagtcatacataataaaaaccacctactttaaacctgaaggctgtaaaggatgatgatttacacatacaacctaaattattattcattagtatttctgattctccaattatgcatgaagtttataacatcaatggaaaggatgcagaaaagtgatcctcaattctttagatgggactcctacattctgataaattaagtgtgtaggtaattatttaactagcaaactgctaaataaaccagaaaattattttaataaaatcttaatttgggaataatttctgatttatagaaaatctgcaaagaaagtacagagaattcctgtatgtccttcattcagtttttctaactgttatcttacattaactatgggacacttgtcaaaactaagaaactgatgttagtgtattattattaactaaactcaatactttacttggattttactagtattgacattaatgtgctctttgtattttaggttcaaattcaggataccatatttacttagttgtcatgtctctccagtttcttttggtgtgtgacagcttttctttgtttctcatgaccttgatggtctggagaggaactggccaaatgtaccatagaatatcccctaatcccatgaaatcatacatgtttgcctgttttcatcctgattacactgggctatgaatggataagcataccacaaaggtgaagtgtcctcaatcacatcatattagtggtacatgacatccagataacattattaatgatgtcaacctttgtcatttgacaaacaaagtttttgcctggtttctctactataaagttactattttccctttcccatactctattatttggaaagtagtacaccctcaacagggttggtaagaaatggcggaaattaagcttggccccttggaagacagagtacctacatatattaaatagatttcttctgtaatggctggcctcttttccttcaattatttactttttcagttatttacttacaacagtatagactcatgtatacttactttacactctggtttgaaatttaatattacataatttaatatgtttttcatattgtcccagctttaatcattggtagctcctttatttcaggttgtctcctgtgtcccttgacatgctcccatccttttgtttttagagcactcaatgattatttttttaaaatggttttctcttgcataaatcgcttatgatttgctgaaactatttatttccttaactataactctaattattattgtgagtaaacttgaaaatttatgttttattttccagtaatttttaagcagctatattattcaattttttcaaattaatatttttcccttctgatatcttagtccacatgggatttattcaaatgataatcaaattttttaaatgactaaatagatttactagctgtggaaataagttatatatgtgaaatattctagatacgtgttaggatcttacttcctcttatggttagcgaggccatgtaactcatgttccccacagagttgtgagtagaaataatccctcaaacagaaacctcaaggtttaagagcgaagttttaagaaaaaagaatgtttgtcaaatagatttttaccatgcaaatataaactccatgtacttttatgtttgcctgtaaactgggtctaacacaattgagatcagaaaattcaccagatcccttgttattgtagaggaactcataaatcaaatgtttttggtaaaatatcacatattcttaatataatctcatgtatttgctgcatttgcatcagccagaaaactattttattttagctgggaattatgaatctttccagccaataagaatacactttctttttcatatttctttggtgggggaggagatgaaaatagtatagattaatgttaaaagaggcaggagggagaaatagtactactaatatataattattttaagtacaatgctttattctaaatgttactgaaattgccaaagtatacaatttttccagaacattttttcctatgattattttgataataatgttatctcgtaattctgaatgtctatttggaaacaactcaattttctcttctgcctggtagcaataggaaaggtgttgtccaggtctaaaaattgccaagatttagaattattcattgtccattgtggttgaggccaaagcttatatatcaaggtacggtcccatcattctcattctgaaaagccatgagagttggagttgctggaggatggaaaagtttctgtctcactaaaaaacacatccctttaactcatgttaactgcctaaaggaaataataagtattaaatttagtcagggacatttgacactttttttttttctgtagggaagccccattcagtcaggcccaagaagtcctaatgggcaggaactgaacagtcttggagcaggctcagagttgtgctaagttccatgcccaacatttcatctagtactgtactttccaaacctggtttgtttgtacccttaggtacatacagtttgaaaaactatgaagcctctctttgtcaaaatttaaatattttaagagatttaaattacagtacctcataggtattgacagatgatactcatttaaatgaatcaaatggaataaagatgatctagcaatttaatgcccatcttctattaaaaacctcaagagctcttaaaaattgaaattttataccatcccttttattccttcaacttttttccttttctcctgcacataattttattttactatattgtactatctttctatattgtgtgccttaaagtattttatcagtaatattatattttgttgctgcaaaaatatataatatacacttaaaatatttttctttttaaattttaaatgactatatggttgtaagtgttaaaacttgtctcttgaaatgagcagcattcacaaatattattaccacacaatgtaccagaacagaataaatatattaaaatgctgataaacagagaaaatacaatattatgtctggataacacaaaaaatgtatgtttgtataatacaactgcagttttatcttttttaaactagcttatgtttcaattcaaacatcctattagaattagacagagtcctaattttcagttttgtagatttattgttgagaaactctgttcccagaagtaagtagatggaaaagaaaaaaggttgtgttgttgttatggtttttatcagcaatattactcaaattttctgatttcttctgcatatatactagaataaagatatattttataataatcattaaataccttgattaaatcaacctccgattttgttgaaagctaacaaccagaaaacatctggctttcaaaaaggatttcttatgtagctattaaagtcattcactttcctaacacctaaatctataatttgagtggtttcttattttggtccttgaagttttgagaccctggagtaatgcgacacagttaagattcatgagaaacatacactctgaaagagaagattgatttaaatgcagacagaactccttaattgcggcactgttctcagaataataaattttagaaaagggtacatatagaagaagaaaatgaatcccttgcaaatatccatgtccttgtatttcttggacagtcttcataccttaattttaaataactatcaaacatctatccctgcaatcaaatacgtttccggtggttgataaatgttgactcaatgaatgtgctgcttacacaatatggctaagtaattgctttaaacatcatttctaatcaatataatcaaaaattaaaaatcagcctggtcatagtcttattagaaattcaaaacttcagcatatgctcagaatgtagaggaaaaaattcagtgaccacgctgagttcattgttccttaataagcctcaatctcctcacttatgaaatggggagaatattgcctcactcaaagtcttctgtaacatttaaataaaattaagatagtaagaccctaatttgtctccattctctgcaatgtcttgcattaattgcaatgtctcattaattgcatatagtagataatttatagtgtaactggcacatatttgaggggaaaagaagaacgatcaatcattatttcagacaatagacacgaagactgttcttggtaaaccagaacttggtcttgtgtttaccatggcctttgtactcatggtaaacacaaaagtatgtttacatttgaggagcttttattatattggaggaaaaaaaaacagatacactttttgaaaaattactttaagagcattatatatatcaaatccattctaaagaatataaacaaatgtggacattaatttaggcttattaattagggtgacttcatgggctacattacctgaaaatctagaaaggaagaaagaactaacattcagtacttgtgtgtcagacatggacacatggcatttaatttgagccatacactgtcatttggcctgggtaatatattgattttacatatgagaacattgatatttaagaaagtagaatacctttttcaaggacagaatcactattctgactaaaaaaaaaaaaaaaaaaaaagccctgtccattacacctgtcccttactgttttcctttctcttccacatttattcgtttatttatttattcaactatgcattaatcaaagactaattaccaaatgccttaaatttgcctggtattgtttccaggctttggggacaggattatcagatacaatatcagtgctttaggaactttaaattttgtgggagagataccagctaaggagaggtagttaagtagcaaaacaactgcaatgtagtttgacaaatgctaaccattgacttgatgtaatgtatactgagttcatctggaaatcactgatttccagtgggtgatttccagtgggtgaccatggcaaaagcaggaggttaaaggatttccaaaaagagaatcaatgtttgaaacaaaatgaaatggcatggaaatggttgggaaaatatggctgaaagcatttcaggacataagaggtaactgtgctaggtgtgtatttgtatttacaaacagttttttcaagtaaaattagtaaagacacttaatctggtcatcatccttttcctataaaatcaaataaaattagaacattcctgtttggaaaaaaaaaagatatgaaatgttgagtcacattttcacacttttggttagtatattttaacatctttctttagtttgccaaatagctttccaagattatttttggttgtgaagaaacttcattcttagtttgattgctttcaatttatcataaaactatttcaatcgaaaattatatatatatattacaatatcacacctcaaataaaatttaatgtgcttatgttatcaatcattggttttcaggcaatggctaccactttacgtgaagggtaaataacatacccattttaatcgctacagacagaccactaccaaaaatttcttaagatgtatcttttccaagagaggtaaattatgaagttgagcttcaggaaatttaatattagctatcacaaccacctcaatttttacagaaaggaattgaaaatgaaacagtaaaagtatgactaaactatacttaacttaaaacggagtaaattaaaaatcctgaagccagacatttgctcttaatagaattaagagaagaccccaagaaattatctaatacacccttgtgcccttaggaacaattactcctatgccatctgaaatgcatgttatcagcttggtgttaatcaatgttccaaaaatacttagagcctatgcttttatatcaggaaattcaactcacatatttttataatcctggaaaataattttgttttaagaaatagttgtgagatatattctgttttaagaccagcaatttgacatagcctttctttcattcatttgtgggtaaagctcaaaattttgctaaaatgataagaatttggggatttaaatacactgaaaaggctgcttattttatgttaatttttgataaatggtcaggggaaaatggtcatactgaaagaacaatggggtgaagaaggaagagaagaacatagtggtgaaagagagagacagatgaaagtaggtaaatgggaaagatgaaggtgagagagaaaagggagaggagagaggaggcgaggggaggaaacagatattacactttgcatggtagcattacacgataacaaagcattttccaagcaaacattcagttaaaattcatgccatatggaatgaaatttgcagcccagatggacaatacatcctagtaaatttatatggataacatatgaacgctagttaagtatgtaatatcactagcctgtctgtctatccatccatccatccagctatctatctatctatctatctatctatctatctatctatctaatctgtctataatttctctatctctatttaatctatcttcatatttatccacttctaacagtatccatacccttagctttatatcatgagttctacaatatgtagcaaaaatgaccctttacagatagccaaaatcctgagtttactctatgatttattttctcaacttttattcagattcagggggtacatgtgcagatttgttacataagtgtattgcacccaggtagtgagcataatagccaataagtagtttttcaacccacgctacactccatcccttcccaccatagtagtctacagtgtcaattgctcctatgttgacgtccctctgtactcaatgcttagcttccacttgtaagtgagaaaatgcagtatttggttttctgtttgtgtgctaattcacttaagattatggcctccagctccatctatgtttctgcaaaggacaagattaattatttttatatggctgcatagtattctacagtgtatatggagcacattttcgctatccagtccaccattgatgggcacccaggttgattccatgtctttgccattgtgaatagaatgacactgaacatatgagtccatgtaactttttggtataatgattgattttcctttgagtatatacccagtaatgggatggctaggttgaattgtagctctgttttaagttatttgaaatatctccaaactgctttttacagtggctgaactcatttacattcccaccaatagtgtataagtgttctctttatccacagcatcaccagcatctattgtttcctggctttgtagtaatagcgattttgcctggtgtgagatagtatctcattgtggttttcatttgcaattctctgatgcttagtgatgttcagtattttttatgtttgctggccacttgaatgtcttcctttgaaaagtatctgttcatttcctttgcccatttttaatgaggttatttgttttttgcttgttgatttaagttccttaaagattctgtatattagacctctgtcagacacatagttcacaaatatttcctcccattctgtaggtcatctgtttactttgttgatagtttatttcactgtgcagaagctctttagtttaattaggtaccatttgtccatttttgcttttgttgtagttgcttttggggacttggcaaaaaaatatttgccaatgccgatgttgagaatggtatttcttcagttttattttaggatttctatagtttgatgtcttacatttaaacctttaatccatctctagttaatttttatataaggtgggaggtaggggcccagtttcaatcttctacatgtggctagcccgttatcccagcaccattaattgaatagggagtcacctcctcatggcttgctattgtcagcctcatcgaagatctgatggttgtaggtggtatctttatttctgagttttctattctgttctattggtttatgtgtccctgtaccaataccatgctgttttggttactggaggcttatagtttgaagtagagcagtgtgatgcctccaactttgttcttttgcttaggattgctttggctatttgggctcttttttggttccatatgaattttagaatagttttctctaattctgtgaagaatgacattgttagtttgatagaagtagttgaatctgtaaattgcttcaggtgtatggacattttaatgatattggtcctacaatccatgagaatggaatgttttttccatttatttgtgtcatctctgatttatttcagcagttttgcagttcctcttgtacagaactttcaactctgtggttagctgaattcctacatatttcattttctttgtggctactgtaaatggaattgtgttctgaattgacttttagcctaaacattattgatgtatagaattgctactgattttttaacattgattttgtatcctgaaactgtgttaaagtcacttatcatttctagtagccttttggcagagtctttagagttttctaagtacagaaccatatcatcagtgaagagagatattttgactttttttcatatttggatgccttttatttctttctcttatttgaatgctctggctaagacttctcgtattatgtcaaataggcgtggtgagaatggacatctttgtctggttccatttctcaagggggacggttctagtttttgctcattcagtatgatgttggttgtgtgtttgttaaagatggctcttcttattttgaggtatattcctttgatgcctagtctgttgggggtttttatcatgaagagatgttgaattttatcacaagttttttctgtgtctattgagatgatcacattgtttttgcttttaattctgcttatgtgatgaatcacatttactcatttacatattttgaaccaaccttgcatcccaggaatcaagcccacttgattgtggtgaattagttttttgatgtgctgttgaattctgttttatagtattctgttgaggatttttgcaactatgatcataagggatactggcctgtagttttatttctttgttgtgtctctgtcagattttggtattaggctgattctggcttcatagaatgagttagggaggagtccctccacttcaattttttggaatagtttcagtaggattggtaccagttcttctttatagatctggtaaaattcagctgtgaatccatctggtccagggcttttttgattggtaggtttcttattactgattgaacttcagaacttgttatgggtcttttcagggtttcaatctctgcctgattcaatcttgggaaattgtatgtttccaagcatttatctatttcttctagattttaaaatttgtgtgcatagagttgcttgtaatactctccgagaatcctttgtgtttctgtgggatcagttgtaatgtcatctttatcatttctgactgtacttatttggatcttctattttttttctttgctaatatagctagtagtatgtcaaccttgcttattttttcaaaaaacaagtcttggtttcatcaatttttaaaatatatttttgcatgtcaattttattgttctctaattttagttatttctttatgtctgctagttttggggttggtttcttctttttatttttcctaggtcctttcagtgcaaagttagagtgctaatttgaactctttctaactttttaatgaaggtatttagggctatagacttccctcttaacattgcttcagttgtatcctagagatttggataagttttatacctattttcattaatttcaaagaattttttttattttaatgttcacccagggattattcaggagtaaattgtttaattttcatgtatttgtatactatagattttttttgctatcaatttctatttttattgcactgtgatccaagaatgtagttggtatgattttaatttttttaatttattgagatttctgttatgagtaagcatgtcatcaatcttaaaatatgttctgtgtgcagatgagaataatgtatattctgtggttgttgggtggagtgttctatagatgtctactaggaccaattggtcaaatgttgagtttaagtccacagtttctttgttgttttgctgctttgacaatctaaggctgtcagtggggcgttgaagtctcccatcattactgtgtgattgtctaagtcttctcataggccaagaagaacttgttttattaaactgggtgctccaatgttgggtatgtatacatttagaatggttaagtctccttgttcaactgtactcattaatattatgcaatgcccttcattgtccttcttaatttttattggtgaaaagtctgtttcatctgatatagaaatagggacgctttctcttttttgttttccatttgcatggtagatctttccttattcttttactttgaacctgtgggtgttgttacatgtgaaatgggtccctggaagaaagcagaaggttgaatcttgtattttacacagtttgccactctgtgtcctttcagtggaacatttaccccatttacattcaaggttaatattgatatgtgtgatttttgatcctgtcattatgttgctagctggttgctatgtagatttgattttacagttgctttatagtacctgagggctatgcacttaaatgtgtttttgtggtagcaggttttgttcttttgattctaagtttagcactcctttatggatcccttgtaaaactagtctagttgaaaacaaatccctcaatatttgcttgtctgagaaggattttatttctccttcaattatgaagcttagtttggtgggatttaaaattcttggttgattttttaaggacactgataacagtctccctatctcttccggcaagtaggatttctgctaagaggtcttttgctagtctgataaagttacttttgtacctgacttgacctttatctctagctgcctttaagatttttttgttaaaaaaatctacatgccttggggacgatcaacttatctagctggggttatctgtatctcttagattttcatgtcaacctctctagtgagattaggagaattttcatggactacatttgcaaatatattttccaaattgtttattttctttctttctctgtcaggatgccaatgaatcatagatttattctctttacataatcccatatttcatagaggttttgttcatttttcccaattcctttttgacttagttgcttcaaaaactggtctttaagctctgagattctttcctcagcttggtctgttctgctgttaatacttcaaattatactatgaaattcttgtagtgagttttccagctttagaagttcagtttggttctttcttaaaatggctatttcatatttcaaatcttggatcattttactagattccctggattttttggatgggtttactttatcctgaatcttgatgagattcttgccgtccagattctgaattctatgtttgtcatttcagtcatttcagactggctaagaaccattgctgaggagctagtggacttgttagaaggggatactgtctttttgaattgtcaagagttccggaactgattctttctcatcagagagttttgatgttcctttaactgtagtataagttgagtatagtcagttgctttgtttctggatgctttcagagcaccagggctttgtgcaggatttttgttgtgggtgaattcttgggcttgttttcacaggtgtatatattaataggataattgttgatgctgtagtttggactgtgatcctgtagatggcacttaagagtaatggctggcagctaggctgatacctagtccctgactcttctacttcctagcattcgcggggaggaataaagatggctcgctcaccatgtctgctctcgggccttgtggggagccctctacagtcaccagcgctgtgcctcggtttcttttggtaggggttccaggccacgagcctctcttgggcaaaggttgtgacagggagatatgccgcaccgtttatgaaccagctcttcagagggaggcatactccactcctacctggggcccgggacccagcaactggcccctctcagtgttctgagctggggtttcctctcctgcaaggggggttcctcccctgcctgagtgctggccgcagcactgagctcttcactgcagccctggggaaccaggacatccgtggttcatggttgggttctagctgtgccagggtgtctgttgtgttcctgtgctgtctggaaagtactcatatacagcaacacattcagcagggccgtggaggctgtggggtgcacccactcctgcagggcagctaggcacaggccctgcgggggtcaggggacagcatgtggaagggtttgcagaacagatgtgccccggtcacatctgttgcaaagaaagttcagctctcttctggctcagaagtcagctggggccaatgcctctgggggagtggggaggcgggcccaagtgatgggcgtttatggctgcttttcactagagctgccagcacacaaaaactcctgggctccatgccgtctcaaggcctgtctctgcctattccctggagagatctcctgacatctcacatgtccataggggatgcagggtcccctgtcactaagttcccagaggtccatggggagactgaaccaaatctcatttccctcactcacccctctcccacgagccattagtggctgggaactggccctagtgatcaggtaccctaagtagggctgccagcttcctttctattcagcctcagtttcagagtcacatctccatccactatcagctttttctctcccaatatctgctcaaattatggtggctgacttaataatttggtctctcttggtgggagcagtgctttctggctgcatctagtcagccatcttgtcctcctgagtttactcatacatcctacttctgggccttctacttcctgggcttttacttccagacaatccacagctggctatgcataggatcgtagtgctcattctttcactcactcacttgtagtgctcattctttcactcactcacttgttcaacaaatcattattgaggagctatgatgtgccagataacagctacagttagagcagaaatgattctgcaggtgaactgggagacaaactctgcattttttggcacccaaatgagaaactccattcagcaagtgttgtcaattttagcagttagatattggattagaggatcccaagaaaaagaaaaaaaaacttcgaatacctcagtctttcttccaagatcaagaaatttattttagctaactcaccattcattgaggatgtcacacaaatgaagacattttttagactccactggggtaacaggatatacaggcaagtgaacaaaaaggcatgtcaaaattgaaatttaaaacttctgtttataataagacaaaattagtaaatctggttaaactcacattttgatgatgttttatttttacataatttcataaaatatgtatatgaatgtacatagatgtgtcatatatatgtgtgtatgtatatgtgtgaacattatctacataaatacacgtgcacaaacatacacacacacaaatttaaaatggtgttttctttccgtattttatttcttcttatttgttaactgtttttctctgtgcttaaaccaaatttttcacaaatttttacatgtattatcatggtgatagcccataatgacctttatgcttaaattataatgttaaatcatataaaatacaggattaagagttttgtttttgttggtcctttgacagacatgttagttgattagaagaactctaatattataacagaatcattttattatatgctgttaggtttatttcatgttttgaaatatatgtcatcaactagttttatagaaattacattaaagctctagagcggaatgttatttcttcacctatcactctggataccagatgcctacatagttccagagtttaaaataatacctggaggatttttaaaaccatgacttttataaacacaaaaagagttacctgagcaatttggggcccactctatgacatgagaaccacatacagattattagatgttgaacttcaacttgcacacgccctccatgctcatctatgtattatgtagtgcacttttgttgttaaatttcaaccactttttgttagcaactgttaaaattcttagacattcctgactcaataaaatatttcttctctggataaatttaaattatccactttatttactgttcagcgtccatgtaggttctatgatacactgtgcagtaatcattaaatcaagatacaaagaattctcagtctctcatacataatttggattttttaaatctacaagcataattcctagccacagtttaagagataataagtttccttagtgtgcaaaagttatggaatctatggaacttctagtgtatcactgctaaggactagaataatgcatagcatggagttggtattcaataactatttaggaaatgttaaagacatcttcctctggctgttttgcttctctgtgagtgtgagttgcattttaatattaattatctcattagacttgctgaatagtcttgagaattagaaaatacttattctaagattattacagttagtatgtggtacatctaacacttaaactttgggctgaatgcactacttggtacttaacaggctagattttggtgactgaatgaacaagcaaaaccatgaccaaatcaagatattctaaccaccaaactatattatttctatgaattcgtactgtctagtaggttagattgttttaaaaaaagatttttatggattgtttttaaatatagggacatgcccctttgcattcctacatacatccacttgcctaaatgcacacacagtatgctaatccccctgcacatattcacagagtattgggggaaatatgacattaatgaaaagaaatatgtggtctaaaaaacagaaagcagatgttttcgtgctcttcaatgtatgctttagcatacattttatttataacatctcagaagaaacagatgtaaatgataagatgagaagaaaagaagaatcaggataataaccaattacatgcaaggactttaggataatatttacatgggtagcatggaatcatagaacaaaattttaaaacccagtaatttatatgaatggacattacattcaaaatcccatgtttaagatgagaaagattattggttttacaggaacaagacaatattaggcaaaactgtggagtagactaacacaatgtttaggccaccttatttcttactcatcaagatctctactgccactcttaccttgctagcaaatacagtattttctcctaaattttactttttccaagaattttatttaaagacaaagccaatcactctcttgttttatttctactaagagcaataacaatgaccccatagttaccatttattgaatactgtatgccaaatatgaggttgccctttataaaatattctagtaaatcttctagaatagtaataataatgataataatgataaaccttctatttattcctcaattatgcataaggagtcttagataaattacgcaacttgtctaatatcacgtaactaataagttggaaagtcacatcctttgaaattagatctacctgattacaaagccacagtataaattaaaattacatcttggtactgctttgtgtgacacggattttaaatctgtgcagaatatgaaaaaataattgatttcatacataaaacaatttttaggtgactggctatctgattaagtctttaattttatgtaattgttcagatttttctgagggagcaaatggattgggaaagatagaaaggtattaaagacagctgcaagggctttggtctgagcagctgctcccgtttttggcctatgcaatgcaaggataaaataactgagatggggaaggctgcaggagtagtaggtttaggaaaaattcaagtgctcactcttgcacatgttgagtttgaggtttctattagtcatctaaatagagatgtcacatagccaggtggatatacaaatctggacaccacattagcatatagactgaaatttaaaagaccgaaatgaggtcatcaagaaagtgaatgcaaatagagaaatggtccaagctggaggccctagtggattccaacaattagagccctgggagaccagcaaagaaaaatctgtaggagcaattgctaacattggaggaagaccaaaagagcagtgtgaactaaattgctcacgttaatccagtaattaacctgaatatttctcagaggtcaactaagatgaggactgagaactgaccatcagattcaacaatgtaatctggctttattggagggttaagaaaaaaagcctgattgaactaaatttaaaaataaatgggaggagagaaattggaatccatattcttatgcaacacttttttagcacattgtttcaaagggaagcaaagaaatgggcagcccctggcaaagaaaggaggaataggaataagagcatgttgtgctgagggagaggctccaggagaggatgaaaaactgatgatgtaggatgaaaagtggataatcactagagccatgtccttgagtagatgagaagagaaagaatctacaagagaagagactggatttggtgaagaatggtactatctttaataacagatggaaaggcagagcatgtgggtttacatgctggtaattgtggtgatgggagtctgtgcacatttttggaaaatcaagaagccaggatatcagctgagagtattgttgggggagagaattttggatgtttaagaagtgaaggattcaattcaaggcttcagcatccttctctgtctatatcagtatattgtagaaataacatgattttctatctgtatcatgatgtgagcaagattgaaaaattgatctagtagaacgttatccacaaaatctgctaactaatatttccttttgagaggtcattttacctttttctccgtcaaattctatgattttatgctgatggtctcttctaattccaggccatgtgaccagttttatattattaggcaagtctaacaagtatattattaattaaaatgactaggtaagaaataaaggggttaaacatcacttagagagagaatgatcccagcaaaacttcatttttacatattgacactgaattattaagaacgtcatggatcacaaccacttaactggaaatgtaaacacctaaaatactatgatcaaatcacaattttgcagcttgctgattaggaggccatgtagatacagaattaaatttattacatcatggtaaattatgggcatacattaatttctttaatttgtctttctctacttgacattcaccacacatttacttaaaggaaagaaccataaatattaatatttcataataaattcagaaattcttattacaaatgctttcctttaatatcaaaagggcacacattcagtaacatgattacagtgctttagacagcattatacacactggcagtcacagtcatgcaaaattaatattaatttgattgaactgattaggtgcaaagagtcagatatttctctgaatgctgattgcattattattcactcaacaacccagtataacagtttaaagcatgggctctagtgtcaaagagattcaaattcaaattgccactcttctgctttctagatgaacaaaactttgagttagcttctctgagcctcagttttgttctctaaaaagtgggaattaaagtaggtttttaacttactagggcatttgcaaaaattaaaggaaataatgtatgtaaagcactttatgtcattgccaccctagtcactcaaaagaaaagaaaaaacttcatctttctaaatttatttttgcccagtagattgtgttgaatttgtccctttcttaattgtttttctcttgtccaaaattatcttttcacatttatccaagatccagctccagtgtcgcctctgtcatgtcatcccttcagtctagaggaatggttctttttattttcccaccactagtctgtagatcttttgtatcccttttaaggtctgcagtaggcaagttattcacatgttattgtgcctgccccttcaacttggagctcctagagaatttgaattgtgtttctcctgtttccacttgttttccacacagtagcctatgatacctgtaaacatgtagatcaggccactccatttgcctaatcccaatcctccaatagtttcctgtcacatttctgagaaaatccaaagtcttatccacagcctataagctgtacaatatatggccctggtcctctctctgtcctcactttatttcacactatctccttacacactatcctcaggcaacatgggtgtcgttgcagttcacaaagcataatgtcattgatacataaaagacctattaagtaccagctataagttgcacactattctaggcatttaggatacattagtgaacaaaatagacaaatattcttctgtgtagagtttccactgtagtggggagaagtgcagaaaaacatgtaaaaagtaaatgaaactgtatgtgacagtggggaaaggaaaatgagaagaagtagaggtggtgtggagggacaagaactagagcaaaggataaagggattcgtgagttgtgattttaaatcctccattaagtatgttttctcagggcatttgcagttgctgattttttttgccttgctttctctccagtccacccaatggttccctccaccagttaagtgtctgtgcaaacagaaacatctgtcaacacttctgagaggcccagtctaaacagtgtaaaaaggcatgcctccactcccacattacagctctctactttcttaatcagctttattttcttcattgcatttttactatgtgtaaatctgtgtgtgtgtgtgtgtgtgtgtgtgtgtattcgatgaggaaatatatttttttctgttttattaactgtttcattcctagtatgtaggaacagtttggcatagagttgtcaataaatatttattaaataaattaatgtaggtaatagttagctttagctaatgattattaaatttaaaaggtagagaaaactgaaatttactcattaatgtattatttctgaataattaaaagaactttcattttaaaacctgcttttgatacccatggcacttttttttttttttttttttgagatggagtgtcgctctgtcgcccaggctggagtgcagtggcgcgacctcggctcactgcaagctccgcctcccaggttcacgccattctcctgcctcagcctcccaagtggctgggactacaggcaccagccaccacgcccagctaatttttttttgtattttttagtagagaaagggtttcaccatgttagccacgatggtctccatctcctgacctcgtgatccacccgcctcggcctcccaaagtgctgggattacaggcgtgagccaccgcgcccggcccatggcacttctattcattcattaattcaacaattatttgttgagtgatattattcattcattaattcaacaattattagtcgagtacctataatagtctaggctttatattaagcattggaatacaattcaaaggacaaacagttattttttaaagtcattcttaattattaaaatgctctatctacattattataaaaataaaacacaaaaattgcttgtgaagatcaccacactgtctttgggttaaatcatcattcagtaacggccttagaaacttgattttttttgtcctatatgttacttactacattcttctctttggactacaagcgaagtaaaacatccgtctctggtaatgggttgggaacatgtgaattggcaaatgtgccttttattcttaggagctctggtcctgagtccaatgacactcaagtgattagtgaaatagatctataaagtgtggttaatcatacacgttagatatgtaacttttcaattcaagttgtcatacaacccagcaaaagcagtccacttaaatgccataagatgtaagtatcgttttttcttctctaaatttctacctggacatgacctgatttcaaaaatgtgcccattcaagagtgagtaggactagtttatatcttcacttggtatcaatttactgcaagatagtaaaaaaatctgttacttcctacttgggaatataaataaataatttttctggaacaataaatttaagtaagatcttcattatttttgcaaacaaaatgctaaatacatttttctggaacaataaatttaagtaagatcttcattatttttgcaaacaaaatgctaaatacatttttctggaaattttagagtttctcccagttagataaaatgcaaacacattggaaaatgtaagctttagctactcagctgttaaggtttaatattcctgatactcagctgcaaaggtttaatattcacgatactaaatattcacaatatttccttgtggtcacaaacaaaataaatctgaccatttaagaagaaaggcaggccaggcgcggtggctcacgcctgtaatcccagcactttgggaggccgaggcgggcggatcacgaggtcaggaggtcgagaccatcctggctaaggcagtgaaaccccgtctctactgaaaatacaaaaaaattatccgggcgtgatggcgggtgcctgtagtcccagctacttgggaggctgaggcaggagaacggcgtgaacctgggaggcggagcttgcagtgagccgagatcgcgccactgcactccagcctgggccacagagtgacactccttctcaaaaaaaaaaaaaaaaaaaaaaagaagaaaggcaattctagtagagataagttgactggataaataaaaaataatttaaaaaattaagactggcttattgaaaaacaataaaaacagatgtatcaaaagtaaaatatgctacagctaaatcataatttacagttttaaggaaaaaagtttattccaggaaaactccaaacaataatgattcacatcgttcaaaattttcctctggatccagaagggatgttataatggatgttttaatgcatctttttttttgtattttggtaattaaactataactaaaacccagaaccataaagatataaacaaatgtccaaagcttaaggtgagagacagccagaaaggcatattctggggccagagaatgcctaacgaaccgtatgaacttagatatctactactgattttaaactgatgatgtaatatcttgtgctgtcctaaaattagcagtgaaaatctgccttagtgacacattggggaagaaatgcaatgggatgcatttgtgcaaacattaaagaggctcagcagaggacagaatctggtaggagtggggctgagattatctaaggtaatcagaattgagcttgaagtatgaatctgaagtaaaaggtttcaggcaaatgtaaacattcctctgacatcttctaaaatattaaggtcactgagatacccatgtaaaatcaatacactgtttagacattaaagggaaaaataaaatgatgttccaaaagtcatggattcatttaccaaatattttactgagtttctaaagctatatgaattggtgtggaatgaaatgtgagcaaaacgggaaaaaaattgtcttcataaagtttatcttgcaatagaataaataaccaatttatatatcatggtagaagaaatcagggagaaaatcagagagaaggagtaggggagttgaaaaaatatcttataggtaattagggaacccctcaatgagaatttaacatttgaacagatatgaggtgagaaagggagtcatagagggctcaaagagcataacaggcagagaataagatgcaaatccaaaggtgctaggtaggcagtatagctagggtgtgactgaagaagaaagaggggtttatccaaactgagtaagtgagcaagggagtagtaggtggtgaaagcagagatataacaagaatccacattgtgttggttcttgcatggcattaattggacattgatttttattctaagtaagatcagcaagcaggctgaatgaaactttggaaggatctgagcagtgggatgccataactgaataaatgaccaagattttgaaaggatcattttagcttttggattgagaacagtggatgcagagggttagttagaggggaagaagctagttggccatgtagatgaaagctaattgtggtttatacagggtggcagtggtgaaggtaatgtgaggcatatctggactccaaaaatattttgaaggtagatttggatatgagggaaataggagtcaaagataactccaataattttcctaaagaaatgaaagaatcaggttgtcatcagctgagatggagaaaactacagaagtatcaggtttggagggaagatccagaactcaattgtcaacatgttgagtttgagatatcctttagacatatacatggagatgtcaagtgggtagctgtacatattacctaggatttcagtggagagtactggctatagatataaatttgggaatcctcagtatatagacttaagggagtaagtatagggaaagaaaagaagaggtccaatagctgagccctgtaacatcccaatatgaaagaccagaaaaataaggaagtagcaaaaaatcatattaaaaggaggggccagtaagcattagacaaggacttggtgtttcaccagtgaagcagccctcttttaggctcctgactgaagcacattcctccactatctggataatttggacagcaatccagatggaatgagaaagaaggtgatgtttcccaggccaacccaattgggtatatcaacttgggtgaccaatgaagtgacaaattaccacataataatgttcatattctgactttaagcataataataaacaacatgtgcttgcaatttgatacagggctcaatagcaataccccaaatcatttggagtgctggatgtcagtaataaggaaaatgatatagcttcctagagtaaaattttgacataagcctgtgcccagtaactttcaggtttttttcctcagcataagaatgaattttcaattaaatttatatgtagaagctcaagatataaggcatataacagtggaatgtgtttgtttgaggcagaggtaaaggaaaaaatcagaaaacagcctgctcagagttcccactggagctatccttgaagcatctggacatatccctagagcctgggtaaagcttatgaacatagctttaaaactaccaaaatcctaaaaagaaaagagttcagagatgaaaataactgatattggaagtactcagagaaggtttacatagtattcagggaaaacctgaacccaacagaatagaatgtgccctggctttcatttttatgttcctccttctgcccctacccctcagattaaatattggttgaaatacctctaaaactacacatatcatcatattggtgataaccagagtcctttagcaacaatttgaagtagattttgtttaaagaaaggtaggaaagttatagtccagaagaaaattaaactgatgtgagtaagaatatacacatacagcaaggtttacccattataggaaaacattaactgtatgataagggggaaaatgtgtttacatgtttttggttttgcttttcagaaagagaaacaagatagtgactattctcttccataactatcttggggaaagaagaagttgaaacaaaaagcaggcataataatgaatctacaatgatatctgatatgtatctattttaatcaaatggaagattagccttccagatagcattaaatagaagtgtgactaggaaaataatcttgtacggtccctcaagaggaatatgccagtttatttagagatgtgagcctttcaagaggcatccaaaatagtgaaaagagagatgctaaaaatgtataaaatcaattaaaaagagagaatacaaataagtgtcatgagaaatacaaactggtattaatagtgctcattaaaatgatgaatatcttaggcaattttcatgacctaaaatgatgtatcattggcctcatccatctactacctagaattgggacacatttgtataagactgaaagatgtatcactagtttacaaatataagcagttaagtgatctccccaaaatgttggggtaacttacatttagagtgtaggactgtcaccgcttccttttttcaaagcacatttgtaatatattcatgattgtatccttatagttgtgtgggtaaagttccttaaaccagacacttgaaagatgaacaaattattacgtgttagctaaggatattatgtttttgagttttgagtttattttgaatagtaaagtattagcactcaattttccacctaagatatagtgaaagtaagagcatgatactggggtcaaaaagggcaaattttacttagtattcttttatctcctataaacaaggcagctacattttgggtactacttaaatagctgcaaaaaaacaaacaccctacaacaaaaaataattttcattattttttgatcagaaaattatgccaacaatcctttatagtaaattacctgttatattattttgtactaaacgttttttgcaattaatctgtctttcccttgccagaagaaaagatcccatgtgaaatggtgaataggaaagcacaggtgcaatgcaaggaagaggtgttttgaaaagtgggtctttacatctataagcacttaatgtcaaaagatgctcttcttagagtagttggcatctatgtatatatatgtataaaaccttgtatatataatccagatgcttgctttatgttacttatatgtcaacttgtaaattgagaaaatatagagtagattcatacagttaatctctatatactccattccttaattattaacttcttaggttcaggaccagtccaatcctataatctgtatgttactctagcattaaccagtcccaggtcactataaaatatatatactgattttatatttcactataaaatatatatacttattatatacatatattatatgtataattatagtgacctgggcatatatatatatatcatacattaatgatactatatattattatatgtataatacatattacatatgtataacacatatataacaaaatatatattttatagtgacctggacaaatatatatatatcatatattaatgataatatataattatatatataatatatattatatatgtataacatatatataacaaaataatggttttgaagcaacttggatggagctggaagccattattctaagtgaagtaacacaagagtggaaaaccaaaaactgtaggttctcccttataagtgggagataagctttgagtatgcaaagccatacagtgatataatggacttcagagactcagaagggggagggtggagggtgaccagggataaaaaactacacattaggtacagtgtacactactcggggaacaggcacactaaaatcccagaattcaccactatgtaattcatccatgtaacaaaaatccacttgcaccccaaaaactattgaaataacaaaacaaaaataaatcaatacatacattgctaaaaatgtatggcagtatgggaaatgtcactacgatccctaaataaactgattttattatataaagactatattatacacacacaatatgtttgtatgaatagatataaattatacatatgtgtgtatacatatatacacacatatatatatctgtatgactacataagtatgctgtatataaagaacagcatggatgtcagaaatgtatcttttcagctcatgagaatcatgaggttcctagttgctaaaactatgtacttacacactttaaatggggtcatgatcagggcctaaacatattaatctctgtaagtcaaatatgtcgaggttgtctataatgtgtttgatttgcatggacatgtcctaagcacttggaaagagttgtgaaggaggaattttcacaagacaaaaatcaaaccacatataataaatagtatgatatatatgtgatgacctgactaggaatttgatggcatgagttgaatcctggctctgatacattgtgtagttgaatcctggctctgatacattgtgtagtatctattatgtgtcactaggtaagatacttaacttttgaaatcatgatttctaaggctgttaatgaattttaatgacacaaacctgaaagaaaagattcttgcaaccattatatttggacatctaatttaaggataattagtattgtaggtattaaaataaaatattgattgatttcatttatatattacctctgctaccctccaacatttttctaaacattattataatttcctgatttatttgcccttccttctacttttacttcctgtagctattttatatattattaaatatattataaatatagtatattatagtatattatttatacataagatatagtatatagcctttggtgtttgtcaaagagagagaaatgatgcctaagtcacagaaagagaaagggataattctcaataacaaaaattgtcacatttccttaaaaaacctcaaccacagggctctactaagttgacagaaatgtccagtttcaaaagcaaaatatataaagctcatatttgttattccttttctaaatttgattcataggtcttcaagttatcaattcatgctgttatttacaagattgtagattaactttacgtatatttcctaattaaaggaacatcaaactacgtagaggattcatactaggttaaaaaaaagggggtgggatgggggctctaaagctatctaaaataataactttctgtaagttggaaaataaactattttcaagctttttatgttgttcatcaaaggaatattttcttctaaagtggcctattccaacttataaaaccccaaattttaaggctacattatatgatctgaggcatcatccaaatataattgcatgatatatttgatccaatattattaaaaccttattaaatttaacaaatggcataatcttgaaaattaaggcatgtaaccaaataaacacaatgttgggatatgaatagaatttatctcttgtgctgtttgagtcaccctgcagtatgtctggtaggatgggcaaagtactgcaaacaatgacaaaattaataaaactggaattgtgtgctgcacattatgttcttggcaggaaataaggtgatgctattataaaggacacctgcttccagaaattcaattagaggactctactgcattattttcctaggaacaaaagttaaagtacattttggacgatgtgtattattttggggattgttggggtgagatgttagggtgagcaaggatttttgaggtactcagtatgccaaatcattctttattctctagacactttttcatcttgatgtaaaatttaatcattttatactacactaccttgaatcatagagaaatacacaaattagtaattgatctattttacctatcaaaactattttaatccataaaggatacttttttgcctcaggtctcatttgatgtgcttgaaagcaggtaatggtattatcaatgattatgcaaggtctcaaaatccatgactatctttaaaaagcaagagtcattttgatagttgaaagaagaatgatggttatcagaggctgacaagggtaatgggatggggagggacaaaaaggggctgataaatggatacaaattaaaatgagcatctatttataatagataataggaataaaatccaaagtttggtagtacaatagggtaactgtggttaacaataagttattgaatatttcaacataactagaggagtgggcctaaaatgtttgtaacacaaataaatgataaatgtttgaggttatggatttcccagttagcctgattttatcattatacattttatacttataacaaaatatctcatgtaccccataaatatgtgcaactattatgtacccattaaattaaaattgttttaaaaaacaaagaatgtcactctcctaggaaagtactgacagtctgttgcaactgtttttccaagacatcattactagaaagatgtcatctgattcccgtgtcacacatgggatatatctattacataactctcaataccacaatctaaagggcaatgtagacattaatttgtctcagttgattttccagtttgaaaaaaattgaaatggaactcttttatacattctgacaataatgctaagttcatgatccaagttacctaagacgcacatattaaacgttgcagaggtttttccttggaatttcaattactttcataggttgccctcttgtggccatctgtaaagctactaacaacaaaatgaaaacattgtatgtctttttttccatctagtaaatgcttcgagggtttgttaacacatggtatcttaaaattgacttaataatatgtcaggacaaaattgaaatgaaaaatcttaaatatgaattatagacaaaatcttgattgctgaaaattcagtattggctacaataaaattattcaataaatacaatacctaagtatatgagagtttgctatgattatttattaatttttaaaccatgggcattcattgattcatgaagttgatataaggctttcatttcctaaaataaagttccaatgttatacttcatataatttcaggagaaaggatattttaagatatcataagatgatttaaaaaattctttttttgaactgacatatttaatcaaccgagcacctctatcatcaaagatggattaagtaacaacatgaatacaatcaggcatttaaggtattaagcatcaattgatcccaagctacctatttaagctttccttatttgtaaaagaagtttgagccacatgatctcgactaaatccacaatccactttcttttacctttttttttttttttttttttgatatggctcactctgtcacccaggctggagtgcagtggcgtgatcttggctcactacaacctccaactcccaggtttaagggattctcctgtctcagcctcctaagtagctgggactactggcatgcaccaccatgtctggctgattgctttgtatttttaacggagacggggtttcaccatgttggccagcctggtttcgaactcctgacctcaagtgttccatttgtcttggcctcccaaagtgctgggattacaggtgtgagacaccacgtccagtcataacatctactttctatgtgtcctacttctagttagcaagaactgattagcaatcaatagctcctttctcttttttcttttttcacttcctccaactgatttctagaatgcaagtcaaaatatctattgagtcctctttgtttgaagctgctgtttcctggtcacatttgcaggtttcagaagccattctttttagagcaaagggatccaattgcacataaggcctatagcctcctgttgttttcagtgctcaaatactcaggagtggcccagagccaatacaatggaggaaaaggaccacaggcagagagatgctgagcacactgccctgggtaatctaaattagttgacctttctacctcttccagaagggatatgtgccaaaagataaggtaaaaccagctcagtatgcaccatcacaatgagaaatgaacataaatgagatcatacgagctttgaaaatgtttatgtaacaaggattcaggttatttatatataatatgaattttttaattgtataatataatcaattactataaaaaatttagattccattgaatgagcttcaatattatattctaactaggtagaaatttaaaatgtaggaatcatttaaaatacatttttggtacgaaaagcctttaagattaaaaataactgattaatgaccactacattttttcagtaaatcaataattagtctttttaacagttagaaactctcttttaattttttggggttgggggagggctggatctttcatcttcaaacatcacctctctcatccattcattaccatctatactcaatgccctctcttccacagattcaggtttgtgattaatcagtaaggaacttatggaaggagtgcttaataggtcacagagctacccaaaacctgagaaacctggcttggaaaatagaaacaaggatgaaacgcttaggagtaacctggatcacactaaacattaacctttcattccagcacccatcaagtgaggacacttgtcacagaacactaaatgtcactgattttccaacttccactgcaccctacatggtcccactaggccctaggtcactgttgcctttaagaaatgaacactgctgttgttggtgagccactacacaggatttctgtgatgggcagaattacggcttctcaaagaggtccacatcctaatccctgaagcctgtatgtgttactttatatggccaaaaaagtttacagatgtgattaagttaatgatcttgagattgaaagattatctgggattattcagtggtcccaatgcaatcacaaagtttcttataagagagaggcaggagttcaagggtgagagagtgatttgaagatgcttatcctgctggtttgtggctgaagggaccataaaccaaggaatgcagggagactcttgcagttggaaaaggcaaacaagtagattcttccttagagtctccagtggaacacagcctggctaacgctatgattttagcccagtaagaccaatttcaagtttctgacctccagataaataagataataaagttatgtagttttaaactataaaattatagtaatttgttgtaggtgcaagaggaaacatgtacaattgcccaatgcagatgcttctttgatcatcagctttcaactccagtccttattgggtgcatcagacttgccaggcccaaaagatgcagctactccctaactacaagaaaggctggaaaaagccagtatttttgtagcttctatagaacatacaggttacacttcccctaagaagtatatgatgaagaattccctgaggatacggaaggtattgagaagcccctcaaaaggacaaatatctcctattatcacactttcttattatcattattctttggactctgatataatcagcttttggaagcctaatagtcttgtcctgatgactctgataaactatttccattccttcccagattaataccttcaacagctcaaagcaagaccaaaaaacttcagaaactaagacttttgatttagctctcagagataaaggctaatttctacggtagctcaacctagatctatttcaaacataatataaaaagaaaaataaattttttctatataattgcgtaatgctttctttaaaaagaattgtgcttccaggccctgtaacatttttatgtaaagatgtctatggaaaggctatatatatatatatatattttttttttttttccagacagagtctagctctgttggccaggctggagggcagtggcacaatctcagctcactacaacctctgcctcccagtctcaccatcctcctcccacagcctcccaagtagctgggactacaggcgctcgctaccatgccaggctcatttttgtatttttttgtagagatagagttttgccatgttgcccaggctgatctcaaactcctgggctcaagcgagccacctgcctcagtttcccaaagtgctggaattacacgcatgagccatagtgcttggctggaaagtctatcaaattttttaacctgattcttattattagatattgattttaatgctactagcaatgttatcctaacagaacatttccagttattacagtgaatataaaatttggattatggaattgaatttgttggtgttgtctgatgaaaaaaaatactgctcaagagtcaggatctaaattctggaacattgaatgaatgaatggccttgtgaaaattaatttttttgagcccagttcttcttaatcctctgtcttacctaaccccaagatccgatgatatactaaaaggaagggaaaacaatttaaaaggttgtataaaattataaattcttatatagaaatacagagaaaaaaggaaagttcaaagtatacgtttttcattctattaaaacatttcttctgttgatacatggggatctaactcaagaattctagaaccttgaaattggaagataccatttcaactaagttgcaacataatttccacagtgtctactattcagtgttcatgcttctgtaagcgagttcatcatttgcaaatatatccaagagcaagactggctctgacctattggacttacagtcgccaaacacctcgcctcaagtataaagtgatagtaatcatcatattttcctcatgggttagtaatgtgtgatgtagtggcatgacataatgcctttagtgacttggcatggcatctggcacacaataactatttagtacatcttagctattaatatcaataataaggacaaattaaatatgtattaagtgtatagcatttgtatcagttcttggggaaatatactatgttcacttattccatatattttacttttataaaccattaacatatacaaagggcaggtatttttaaatatacttcttatcaaaatacaactttagaaaatattcattaacagaaaatgcagaagtgagaacttggtttgtgttttataattttaagtattttgtagaccatgaaatactctcaatataaaaggaaggtaaagaaatcaacagtgtcataaactacagttgtattttttttattatagtaatcacagacatcaccccaaatcattctgtaaatatttggcaatgctagttttgttactccatcagatgaaattattcaatttcccttaaaaatcatccttacataatttgaaaaacatataatgaataccactatatatatatgtaaatatatatatgttgtagatattgagagacacaaaatatcatctcttatctagaaattttcaagtgtacattgcattaaaattcttaaaatgcaaaagtagtttgcaaagagatcaagtccatatatacatgtaatagtttgaatgaaggaaaaactctatattgagctgaaattctttgctccttcattcttgccctctttgcctttccaattctcttgctgtatcattacctttctttaactcctggtaggaattacacaatatgtttaatttctcacctctgtcaggaataagaaaggaaatatgcaagctacaaatgcagtagctgttttagtgtctgagccaaaaaagcaaatcaggatgtgtataaggggtcccgttttaactggcaaaagcaatctgtgtcctgaggggatttacaaggccatggatactctgagctgctgtactcttctgttcccagccctgtggaccctggcattctgatagggctctagtgtagttctccatatactgattttcagtggcattggagcccatactgcaatctcagcttagtttctgcctgactaggaaaagtaatgattactgtcgttgaatcactctgcgttatatccacttggattatcacattgaatattcatgcccacccttttgatgtagtaaaaacttgatcataatcacgtctagtaaatgatgaatgtggcatttgtgctcaggcttctgtctgacttcaaaatctgtgagtgtggctatttttattacaatgtccttccaccttaatggagctataggaaaaggaaatattttacaatctcatacactttgaatacatctgggatttctctttcttatccaaaagatacaagagtagcctgcagagaggcttagggatgactagacagaaagagtattgaaatatttaatgaaccacatgctggagtcatgtgctaggtacagggttgggtactggagatttggtgataaatttttcattgtccccaccatttagttgctggcaatgttcttgagaggcagacatgcagacaatgtgatacaacatattctgaagttcacctggggacccaggcaagacaactgcactataatcatggctaggttaggcaggacagcaaaaaaaaaatacccaaagaggcaacttctaaattggtcctttaaagttaaagaggagcttgccaggcagagaaaggaaagttagatataggaatagaacatttcaggcaggagaaattttatgagcaaaggaaacaaactaaggatcgcatttatatagtgaaaattggataattaagtagataatgagattaaatggagaatattagacaagataggagagtataaaattagccataattccttattaggatggtatttaaggtaattttgtttttgttttgtgtttggagcaggggggagaggaaggtgggtaatagagaggttgcttatgtttatattaggagctcaagaaaatatgtgccaaaactgagaagaccaggtacttaaaactctgtcagacaatgctttggcaatgcttggaggtgaacagctattcaaaagcactctcttgtgttaaactggtgttaactttgtaatggcttaaaatataagttaaaatgttacattaattttttccagtaatgcattttttgtttgcctcacccaatatagatccaaataagagaacttcttgcatttccagaaatgtctgtaacattgcaatagcaggttttgttctcatgggctgctctgtataattggttagtttgaaggttggcatctttttgtagcttgcaatatgaattttggagctaagggtttaaaaatgtggataaggcaagacgtcccctccattctttctcgaaatgttcctgcttcaagtgactaatcctatttttgtaatgaaacgagaatgatttctgtaagtttattttgtggaatgaaaaaaaatgtttgagctgtttcattttgtattctttaaagcacagagcacgtttctggcctttggttgaactgatgaagcatcccaatccagctgtaactttgctatactgcagagttggaaaatctgtcaatatcttcctgcaagtgagctgttttcatgtcttaaacatgaattttgtgtggttaaaatcagttcatcacaccagaggcttctgtattgacctcttgtgaaaagtggaataatttttcttgaaggaacaatgctgcatattataatacaagtttcagaggcattatttgaattatcataattagttttgagaaccacatgaggcactgtgatcatttttgcttcaaccattaaacataattctgaaaattccagaggtaaagagaagtctatattatttacccacattttcacccttgcttgtttttttcttcttttctggtgttccaaatttccttcttttgttatttcccaatagtatgggtaatgtgtcctttaaaattttccctaaatattgtctttatcaaagaacactacataatagctctaacttccaacatatcttcattgtcattaataggtactaggagacattattttaaaacatcttgcttgcttctcagtatgtgatacaaaattaggattttattgctgcatgattggctcagattttctgatgtgagacaatgggagcaacgatgaaagtgtttgcattttattctaataaatttcaaatggaaaatctattgaaatgtcccctttccttctagaatctctactgcttatctgtcaaatataaatcaaggtgggcatactttagagtaagaatctcctgaaccttggtgactttctttataactctctttgcattttaggcagtataattattaaatttgttgctttgacttcaaaaataaataagagctgtcactcatcaatacacacattattctattaaaggaatatatacacacactcactgtttcacttactataattgtataaaaatatgtgacagaaaataataattttattaggtttatggattctttgggtcaagaattttgaaagatcacagtagtgatggcttacccttgtgcaagaatgtctgtagcctcaaccaggaaatcatgaaatgacctcacacctggggtctacagcctcaaccaggaagacatgaaatgacctcagacctggcagctgaaatcacctggaggtgtctttattcagatgtgtggtggctggtgctggctttcattggggactccagccctgctgttagctggaacagcaccacacctgacatgtccatgcggcctctttgtatgtattagtttgagctccctcacagaaaaaaaagccaagtggaagctagattgcctataacctagccttggaagtctcctaacataatttctgccgaagtcacaaactctctcagatcaagttggaaggagtatcaaagtcacactttaagaagaacatgtggaataagagatactactgtggccattttgggaaaatgcaatctctctctctcacacacacacacacacacacacacgtgaaatgtttgaattttagaaacaaagatatcttgtattagtatttatttatgcaaaacattttaccattaatctctacacctacttagatttctatgttttttaatctttttttctgtttctgccaaaagtaacactcactgttaaatgtgaaagaatatggaaatatgttacaaaataatctttttctcagtcttcaataatagcttttgatcctatctcatacctctgttctatccctctagacattaatctctattggcgccagttaatagtcctcaaacgtaaatctgattgtatcaatcataactctctgattttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgctaccacgcccggctaattttttgtatttttagtagagacggggtttcactgtgttagccaggatggtctcgatctcctgacctcgtgatccgcccgcctcggcctcccaaagtgctgggattacaggcgtgagccaccgcgcccggccaactctctgatattaaaaaaaaaaaaagtaaaggaaaagagacagctcacaagattattttccaaatccttagaatgaaattttggtttgttttgttttttgttttgagacagagtcttgttctgtagctcaggctggagtacagtggcgcaagctcagctcgctgcaacctctgcctcccaggttcaagtgattcttgtgcctcagcctcctgagtagctgggattacaggcatgtaccaccacgcccaagtaaattttgtacttttagtagagatagggtttcactatgtgggccaggctggtctcaaactcctgacctcaagtgatcctcctgccttggcctcccaaagtgctgggtagaatgaaatttattaagacacttcaaaattgtcaaactacctttgttccatttttcttaaaatggaattttctccctctaaccattcattgttgtataacttacttcctaagaacacatcttataatttaattactctatatcttttttttttctttttgtgagacggagtttcactcttgttgcccaggctggagtgcaatggtgtgatctcggctcactgcaacctctgtctcctgggttcaagcgattctcctgcctcagcctcccaagtagctgggattacaggcatgcgctaccacgccaggctaatttttttttttttttttttttttttttttttttttttttttttttttagtagagatggggtttctctatgttggtcaggctggtcccgaactcccaacctcaggtgttccgcccgcctcggcctcccaaactgctgagattacaggcatgagccaccgtgcccagccaacaatttccttttttctagattggtcttccttttcctaaactgtatttccctttatctacctgtcaaatatttggattcttccatacctaactcaaggtatggccatctctacccctacctcccctcacatggaatcatttcatacaaataatctttcagaacttacagcattgtagcatttgcttacctgcctgattcctctgttacactatgagccttctaagggtaggaatcaagcactagataataacatttgttcatccatttatactgagtatttatatgccatgaaagatgattagccatggcaactgatggcaattggttccagtcacctcaaagcttgtaggctaatgtggaaaagagacaacagtagacatattttttctttgtcctgcacatgtatcatgtgccatataccatggtctactcttccacaaaaaagcacagtttcaaattatctggttttattgaaaacaaagaaaaaggacatacatatctttaaaaggtataggtatagattttaaacgagatataataataaaatacttactccctttccacgagctatacgctatcttttgctcagtcacagaagaagaaaacttgtattctttttccccattacccgactatttttcctagttattgcttcaaatgtcctctgctttgaaatttatacatcactatttattcctcattattcttccttcttcttgtcatctcatccttttcccattcctccctagtcacttatgtcatttaatattgactttaactcttgaataacttccttatttcagcatcaattcttatcaccaccctgtatgacttgaaaatctactcaagatcatctgactgcatggcagaactatttactaaaatatagaatgtaggagaaaaataagggtagtaatgaatttgtacttcaaggtcttatgtgccatccaagtaaagtggatctagagctcagaaaaaaacctaaggaataaataatataaatatttatagataaagagataagtttatcttcctaggaattgataattattatagctacaaagagagccataagttagatgatttttatgaagagagaaaagtaaagagttgaggatgaatcttaaagcaatgtttctttgatcaatataagatgaatgcaagatgatcgctttataaatttgggatatgtacataaggatttcttagggttctgtacctagtatggtaaaatagagactgtaatttcagattttcttgttttgtcataaattttctttttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctgttttgtcataaattttctttcccactttaatatacttcagaaatgtctttccatatttcttctctagtgtcctgtcacttttcttttccttcctttgaaggaagtacttgttattaagggaattgtccaaagtctttagtttgtcaaatatgaaagccagtaatcttgttcatcactcagtatctctctcatgaagaaacaaaataaaactggaaaagcaataacaactaccagatgagtagtgtaggagtatgcttaactagcatcaatttccccctgcttttttttcttttaaaacatgttgctctagatcaaatttccaaataccatctgcaagaaaaacaacatttagcacatctctgacaaaagaaaatagaaactacaatagaacattcactcccaagcctagaaatatccccaacatatcaaaatactacccacagcctagaaaaataaaacacaaccacccacatttcttcccacctccagcatgactcaaacacacacattctttttaaccacaattacaattacaaagaacatctactcggtaaaaaaaatatatatatatatagtattcctaaagtcagcaataaaatataatgtattatgcagttacaacaggtgaaatgtttttagatttaaataaagaaagctgagatatatgtgtttttcataaaagttataaatgttttcttaattgataaacaatatcatctttcacataatatatgctaaatcaatgtcttttgaataggactgaaaataacgatataatatttcactgtagaatttgcattgatatcgcaatactaaattatatacgtgaggacaaggttgttgataatctagacaacctctgccctatggtgagccatacaggaaagaatctccatttaagaagcaaaacacatcaccctaataaaatgaatataagtttgcttttgaaggcagcagaagatgccaaaatttcttatataaattgaaattattatttatacctgctagtgctacgtgtatactcacttatgaggaaggagtgttagtttttgaaatatttgaagtttcggaaaacttagctgtatttaatgaccctcaaatatgagtatgattatacataaacatgtgtgtatatgtatctaaatttaatgtctgtgtaacatttgaaggactatcataaaattttggagtgatttatattatgaatcctgcatcttattgttattcagtgaaaatactccctgaagagttctttacctatacgatacattgcaatgtgataatcaaacacagaaagcaggagatacaaaagaagtctgtagaggaataagattctaacagttggtgatgataggagtgactagaaacaggatgagccaaaactcagaacgacaaacaacaacaaaatatcgtcttatcctacgtatctaatcacacttgccaaataatcataatttaattttcaaaattcctcaatatttagttttggctgcttgctcttttccttgcacagacttttgctccatattttctttattcacaacttttcaactatcttcttgatatggggatctttatctatgacttctatctaaaactccagtttaaattttctagtgccccatcatccatttccattgacagtacaattaaactttgtcgaaaacagaattaatttcaagcgagtttttccttctgagatgtgcttttgttataaccaggatactattcacaatactaccaagaaaatataaatcctaaaaataataaactcatgccattttgagcccctagaacattaagtacatagttatttattttgcttgcattatttcataatgctcctaatcacccaatgagctagcaaccatcatttacagtttttttttgcaaatgaagaaacacatgagaccttaaaaaaaattaagttgtttgcataagcctagtttttagggaagggaattggtgataaaatgaaatcgattctttattgatacataattgcacatatttataggatacatgtggtatttttatacatgtacataatgtgtaatgctcaaatcagggcaattaaggatatccataacctcaaacgcttttcatttctttgtgttgggaacatttcaaatcttctcttccagctattttgaaatatataacaggtgttaaatatagtctggaatgggttttaatcaaggtcaacttcaccgcaagtatttaaccacataaattttattatttctcattaactaagtcacctagttaaaataatttaactaggcttttctccctttgtcacttatttcatagattccaaatctcattgattattatctcaccatatgtagcatttccacttccatggccacaattcagattacagcaaattacaaaagtgaccacagttctttactgatctgcccattgccaaggtacgcacaccttgaatctaacctgtccggtgattgactgtggcccaaagaatgccccagaagtgaggctgtatgagttctgaatctgtgtctcaatagattttcatgccactgctctcagtctggagccacgggccactgctgcctattgaagacacctggtccagcctgttgggggatgaaggaccccacaatatgatgagtcgtctcagctgaaccattttagaacagccaggttccttgatctgacaactgaccacagtcatataaacaagcccagccaagttcacctgagccttgcccacatcagcagaactgccctgtagagccaacctcaaattcccaccccatagaatcataggtgaaatgaatatttactattttaaaacactaagtgtctaaggagaactaagtgtcagggtgtcttattatgcatcaaagtgtagcttatccattcaggaaaactctgctctagtcaaactgaacttcttactattctcccacttttgtacttgcatactatattttaacactttcatattcttgcattcatgtgttactgattaaattcattgaatattttatcctatcatatgacacaattctagttatccaaggcttgcagtatcaaataatggagatgatttcaatgatttatatcattgttatatatatgtagatatatacatgtatagataggtgatagataaatgtattgatatttcaactatatgatttcaattatatatattttatctcaaagactctgttataataagacttatacacatatatacacacaaaagcttacatatctgaaagttaaagaggtaaaacaaaaaagtaggaaaaatagcagattagctccagttatagaacaacttctatgcagagttatgtaagattttatgcagttattttatctctctggccttagcttttacatctgtcagaaaacttatcaccctcctatgttcctatttgtaacaaaagaattttcttggaatgttaataataatgttaataaaaactgaaaatatatgcagttccttccatgttgcaactattgtactaaagaatgctgtgtaatgtccttagtacagtgttacaataagggacaatggatataaaacaagcattgccccttattataaaagtataataatatatgtaatatatatatacacacacataatagatactatatatctattatatacatacatgtatgtatctattatatacatacatgtatgtatctattatatacatacatgtatatgtatgtatgtattatatacatacatgtatatgtatgtatgtattatatacatacatgtatatgtatgtatgtattatatacatacatgtatatgtatgtatgtattacatacatgtatatgtatgtatgtattacatacatatataacatgtattacatatgtgttgtaagaatgaaatgaacatatttatgttatatacacacaaatgtaaaaaatgtgtatatataacatatgtaataatatatgtaatatacacacatatataaattatatatctcttatgtgtatataatatatattttatatagtgtatatatctatgacatttattattacatgttatatatacacgtatatattttacatatatgttatatgtgtatatatatttcataaatatattcattttattcttaaaacatatatatccaaattacttaaaatatcattataaaaataaaatatactatcattcaacactcaattcagttggttaaaagtcaaagggattatgatttgaaactcattcagaataactgtcacatatctctctgaaggataggttttcaatagacatcaagaaactgaaaaataaacaccaaagacccctcaaccactaaaatacttttgcagacaccttccctataatttctattaattatcctgcataatgatttctagtaattacacaaagtccaataagtctacagcttctagttctttagactctggaatactttcattagatgcaacaaattatgaatgaaaataagtcgaagtagaatgtttacttgaattacatttggtaataagaatagagagataaatattgttataaccaatcaatcctggtgggcaggattatttgagttatggatcttgggaaaaaataacgatatacaggttggatgatgtgacagtgagatggtttcttatcagactgagtaactgaatttggagtcacctgaaggtaggttatcaaaatcaggtggggaaaatctggctcaacaaaatcccatgtttaaaacaatatataatttcattataaaatattttattattctgcgattttgtcgtagaagagtgatatgacttgaggtcttcaagtagtaaggtaatttggcattctaaagcatagagtgattttaaaagagataaaatcaatgttccttttctgtttggggaagggctgttttccagttctgagcttcccattaaaagaggaatagcaacaaacttttccccaattttcgaaagcaaactgagatgaattgatgtcaaatgggaaacatttaaaagaaccagcaccttgaccaacaaaaatgtcaagtttttttgaattaaattccataaaatgttatgtgcattaaacatatgctgttaaaaatacagataatacaccacagaaagattctataaaaataatcatttttaaggatacagtagtgtgttgtattataccttttacattatgataaaatttacttttgctagataatctatacctcagtatgggtaaatgatgcattactatattctattgtctgaaaatccatcaagactcactcaggcaaatagaaatgatgtttacatgaatatagctatcacatcgctggttatatgtaagttggtgaacacactaaatatatccccttaagtttggattccttatttttaaaataaagcttttctagattaggtcatattcatagttcctgatagctctgttattttaagctaaatcttagttctaagataattaatacttataaaaaagtaatcattagcaagtacaatattgcagacttgtattgagtcataacatgaaaaactgacaaaattttcaaattctattttctacctttttagttttttcttcagaagtagtatggtgctttctttctatactaatttaaaataaataaactgtcagtaatttaaaacattattattctgttaatatttgttttccattttctgtaacatggttaagcatgtgttcccacaaggtggtgctctttatttaaaaattacaacaggaagcagttttgttctatgtaagcatagtgctcaatgatgatacagattgagcatgattttaagtcgctaaatgagcagtgaaaatgcatttattactgaaaacttattttcatttgatttttattttttaaatgctaaaagtataaaacattttggtagcaatttcagttattaagaatttagaggttttaaaagttcagaaaatgcatagtagccataaacaaaaacacaaagggaggaatagtaaaaataaaattttggctggaacagaaattcttctctggaaataaagaaaagctagaatataacatagaaatactatatttaaaccttctaatattaaactaagtacagaggagtcatatactaagcacacttttttaacctgaatttaggtattcagaaggaaaaggaaataaagaaagagagataaagggaaagagagaaggaaggaaggaaggaaggagaagaaagagaaagaaggaacttttaaaaagaaattgaatagtggtattaattttactcatcatatttttcaaatattatatttcctgactgtctggtccctcagttccttcaagactcatacagttttacatctcaccctgctgaggcccaacttaatgttcaatattttacatgatttgcttacaccacccctcagcataaaccaaattatttttctggtaaccacctaaaggaagaataatatgcaccaatactgaaaaaaaatagataagagttttatttctacttcggatgtaaaaagtgtgaagggaatattgatcccaggctaaaaatgagaaagaggtaggtaattctgaaaagtattatttttttcttaaacattcagaaagctgagtacttaagacgtccctctgagatgaacaaaattccaaaggttgacaagttcctttgaggaaagacaggacacacaaactgtttaattatcagcagaacatggagccaagtgaaagcagccataaaagtgggtagtagggaggcaagtaacattttaaaaattcttaagacctagcgtgggctatcatgagaagtcagaattcctgagggcaccattccaagggaagtctgcacctgcttggacaccagctcttttacaagaggggttcagctactcctggagacaggtaggaaaagagaacaagacaatctgctgctagaggaagggcaagatcctgtctagcatccaacatttagtcctgctttgataaccaaagccatctgcccatgggagagagacaggaaacccttccataagacgcaggcaaagattggctgcactggcaaagagacaggagacactcttaccccttcctcctaggccaaggtcagctgccatgaagaaaggtatagaagtcttactcctccaaccagccctttacagtaggaaaagccatctgctactgagggaggagtaagacaccaacttaattccagaattctacaatgatatagtatattgctacaggggaaaggcaggaaatcagcctgtagaaacacccaatcattcaaggcagaggtcagctgtcttgaaggagggctagaaaacttgattgcaccctagaccctctagagaacaggaagggaaatgaagaaagacccagtgctgaggtttggtgcagagagccagcataagactggggctggaggagaactatgaagttccaatctcccctttcctttgctcctaccatgagactggcagtaagtaggaagccacaatagtctattgctagggaaggcacaggaatgcaaagagaaagccctcactcctctttcaacacagtcatgcaaagtcttctgaaagttaaaaatggaagaggaacattttgacaaaccctctgacattgcaatactcatacaaattataacataggcgcagtccataaaaggaagaattttaagcctgtgtttcactgaatgtgtccatagtgacactaaagcccaaatcaagctcaactactttctgctaactcaaactccaagttactggcctgtgagataaaggggagtggacattcaggaatacaaatatttacctcagtgtcttctgtgttttttaaccaatgcaatgtttggtatggaaggaaggagggaaggaatgaaagaaggaagggaaggagatgaaggtggggggagggaagcagggagaaaaggaggaaggaaaaaaagttctagtgtaaagcaacaaaatagtccatagaaccagaaacatagaaattcaggatgatgacactttcaggcagagatatgaaattaaaaattatggataatttgaaggaactggttaaaaaaaaagggggggggagcgtgtataaacaaatggggaatttcaacacaaatttggaaactataaataaaagaatcaaatacaaataccagaaattaaaaattaattatcagagatttaaacattcccttaattgggcttagtagcagaccagacatagtagaggaaagatcagtgaacttgaaaatgggttaataggagttatccacactgaagcatattgagaaacaaaatggaaaaacagaaaacagaacatctaaaagctgtaagacagtatcaaatggtcttatatgcaaatatattttccaaaaataatgaaaaaagaacaaatcatacattcaaaaagttcagagaattctaagaatgataagaggaaaagcgtaaccagaaaaatcgtagtaaaattattaaaaaccaaatatggctgggtgcggtggctcacgcctgtaatcccagcactttgggaggtcgaggtgagcagatcacgaggtcaggagatcgagaccatcctggctaacatggtgaaaccctgtctctactaaaagtacaaaaaattagccgggcgtggtggcgggtgcttgtagtcccagctactcaggaggctgaggcaggagaatggcgtgaaccggggtggtggagcttgcagtgagccaagatcgtgccactacactccagcctggtcaacagagcaagactctgtctcaaatatatatatatatataatatacatataatataatatatattatatatactataaaatatatagtatatataatatataatataatatataacatatataatataatatatattatatatatataaaatcttgaagacatcatcaagagaaaaagaggaactatgattaaaaattaaaggaggcttcttgtcagaagcattgaaagctagaagacaagggagcaacacttaaccaaaaggaaaaaaaaaactcaatctagaactctataaatatagaatataattttatccagaattacagaaaaagtataatatctcatgacccattatgttttagtaaaggagtaaggttagttcaacaactgaaatcaatgtatacaattcactggaaaagaaaaatcacattattttctcaatcaataaaaagcaagaaagacaaattaataaaattaaaatcaattcatacatacaaaaaaacttttagaaaactaggaatagaaaagaacttgctcagtttaaaaggggaaaattattaaaatgaaatgaaacacaacaaagtataaaatttcacagctgacattcatctatgtaaaaaaagctattagaactaatagtgtatacagtaagattgcatgatacaaagttaatataaaaaatcaatagtaagttgatacactatcaacaaaaaatggaaattaaaatattaaaacaattttgagaaaattttaaaagacctaaataaatgagaggatattccatattcatggatcaggagattaaatatgggtaagatatcaattctccttaaattgatttatatatcctatgtaatctcggtgactctcatgcagggttttttctttttttgtttatgtagaaattgacaagctgattctaaaatttactcagaacgtgaaggcctttattaagtaaaacaataaggaaaaataagaacaaaattgtagctctttcaaggattagtataaaattgcagtaataatgactctattattggcaaaaagatagacttacagatcaatggaaaagaagagagtccaaaacagaccaaaacatatatggtcacttgattttggcaaaatactatggtaatttaaggaagaaatcatagtttttttttaaagaaatataactagaacaattggctagccatatgagaaaaaatatttacatgccatacacaaaaattaatcattcacagatcataagtctaaatgtgagagctaaattcatagattctaaaagaaaaagcaggacaaaatctttgtcacctttatttagagaaaaatttctatataggcctcaaaaacaaggaaaaaaataaattggacttaatcaaaattaaaattgctctttgaaaggcactgttagaataaataaaaaggcatgcaacagattcagataaaatatttataaaacacatatctgataatggctttgtccactcactacataaaagaactctgaaacctccataacaagaagattaaaaagtaactttaatgggcatatagacagccaataaatgcatgaccacatgttcaatgtcattacttaacaagaaatggaaagtgcaaactgaataagatatgacatatccactaaaatgactaaaattaggagtgacaataccaagtgctgctgaggttgtggatcaatttagaattctcatacattattgttgatgatgccaaatgacatttcattttggcaaatgtatgccattttcttacaaagttaaatatgcactcattggaaaacatagaaattctacttgtaggtatctgctcaagaggttttaatatatatttgaatatttagagcagatttgttcataatatctgaaaattagaaatggccttaatatctatcaaatggcaactggataaacaaactgcggtatatgtatataacagaaaactattcaacaataaagaggaactattttacactactgataccgcaaaaccatagaagaatcttaaaagcattgtgctaagtgaaataagtcatattgtgtgattcctttgatataaaattccagaattgtcaaaactatcatgacaaaaagtagatcaatggttgatatggtattagtgtcagtatagtctgactcaaaaggggcccagggaaatttttagggccatgggaatgttccatatattgattgtcatggtgattaaagaactacatacatttttcaaaactaatcaaattatgtttttgtttttgttttttttttttcctgagacggagtcttgctctgttgcccaggctggagtgcagtggtgcgatcttggctcactgcaagctccgccttccagattcacgccattctcctgcctcagcctccccagtagctgggactacaggcgcccgccactgcacccagctaattttttgtatttttagtagagacggggcttcaccgggttagccaggatggtctcgatctcctgacctcgtgatctgcccacctcggcctcccaaagtgctgggattacaggcgtgagccaccgagcccagcaaaattgtgtatttttaaaaatgtggattgtactctttctctattgtacctgagtaaaaaaattaaatataccggataacttgtactattagtctttaacatgccttctttctaaaggattttcaaaaataatttgagtatttttcatttttttcttaaggctttcaaataaaatccctaatgcataagagcaaatctaccatgtatagacttatatcctataggaaataagagaaagagaatgttctggagcaagggaatgaaattaaatgtataatttagggaggtaaaactagattagtttagggaggtaaaactagattgctgaggttgcagggtaggcacgggttgaagtttagaaacctatgcaatatttctcaaataatcaattttttcctctttaattccaagtggaagattaagaatcaaaagaaatatttggcctgaagccagagattttagatttagctacctgcagtggaagctatgattgttcttgaccaccgtaaaaatgtaggtaggaacgaagagaaacatatggccaaagactgaatttcaagacaagctcactgaatacagtgggagaaaggagtctccaggcagaaatagaacagttttaaattctacggagagggcaagagaagtgaagaatgaaattaggtcactggattcaattattacagatacagatataattttcaagcattctgttttagatggaggttaaaaatcttttcacataaaatggagggaatcatagttgagagactgtagtaggagatataatgtactaatttgaggaatctggctatatagtaaagctgtagaccccaactgggaggatattatagtttcataaaaggatcttcagcataggggacattccaaagcagagaaaagtgagttaatggaaaggaagagactgctggagggaaaaggaatatctgaaggtttaagttcccccaaggagctgggagataaatgagagcagtaacatgggtaaaaaccaagagagatggaaaaactgttctaatctattaagatgtaaaacagagatttattcttcctgcaggcagaaacattaacaaaactttttttttcaaaaaaatttgagtaaatagttgaaagtcaatgtatctgtattgtattacacttacatgaccaaaacttaaacatgctattttctttttgtcttttcttttcttactactctctctttccctctacttgactctttccctcaaggtcagcttctgatgtaatgattcaaaattgtgttacttcagtggtgttatgactgaatgctacaagagtcttaaagtcttcattatagttaccaaaagattatcacaaatcctcacataacagtgaaatgcaagtttattcttacagatgagaaaactgatgctctgtgagaataagtggcttgtctaaaatcaaagagctcataagtgataaaattggaattaaactcttgggtcatttcttaggacttcattcctatctcacataaccacaatattcaagaaatattatctgttttgttctttcctttggtattattggcttttgaagatagcatccccttgtgattaattacaaagaggagtttccacagttgacagttttgaccagccaaaagaaaactagtgatcttaattccatttctgccaataacaagatgcgaccgtaggcaggttatttgctctttctgaacgttgatttctttatttgtaaagtaaggtatacagttatacagtctgtaagatcttttctagttctacatttctatgagtctaaaagtaggatgactgtgaaagaccagttctaccttggagatgagccaaatttgaaattggctatttgtttatagccttcttcactcttcacttggattttacatataaatgctatttttaaaaagtcatactagataaactggctgcaaaatttaaaacagaataccattgaggttttcggctcatgaagctataaaaagcagtgtgaactataattgtggccttacaaagttatcattggcgatttgcttcagaatttcatttccatctcatcttacatagtaaaaaaaacaacacaaagactaaagacccagaaatctcagagagctactcagaatgtattgctgaggaaaattttccctaagatattaattaggtagaaagtcctgaatgcagtcatttgactaattaatcctcatttacataaaaataaatcagttatatcaattactgtggggcaatagaatgtggttccccacctccccgtctttccttctgtaatataagattcatacattttcttcctgacagctagttatttagtgtcctttactgcacatttttcctctaatttgcttcattgttggtttggtcttagatttctttcctcccatctttctacttgctctttgtagatggtctcactattcccatatcattatatattatttacatactgttatccctgaaatttacatctcaatccatatgaagaattcacctacgccaaactaaagaacattgcccttttcttcccactcccaaccccacccaaatctttcttatgttctctgttttggtaaatgtcatgagcatctatccagtagttccccagacttaggagccatctttaattttcctcaatatacgaatccaacccatcagcaagtccccaattctaacttcataatatatctcaacccaattcacttccctactgctatgaccctaaaccaaactcccaccacttacctgaactcctgtattagcctagccctttaccagattctttttggttcagtccttgttctatttcacttaattttaagagcaaccagcataatatttttaaaacataaatcttgtcatgtaattccatagtacttccacttccatcattttccatagtacttggaataaaatccagactcctacaggacctagcatgattagctgttgcctctcactccaataccattttatgccactttgcctttagctcactacatttctgtcacagttagatcctttgttccttgtcttagtatcttagtggtgctgtagcaaattaccacaaatggatcccagacatccaaaaccaagttgtcagtagatttgtttccttctaaaagctccaaaagaggatctcttccatgcctccctcccagattctggtggttgttagcaatccttggcattccatagattgtagaggtatcactccaatctctgtctccatttcagatggcattctcctgcaccagtcattagatttagggcccaacctaaatccaggttgatttcaagatctttaactaatggcatctataaaaatcatattaccaaataaggtcacattctgaggttctaggtggatataaattttgaggggacaatatttaacccactgcatttcttctgctatttcatctccctgatcttcagatggtccatcttctgaaaatcacttcctcagagaagtcttccttgatttccttcctttcttcatcatagctccctgctgtttccttcacaatgccagccaaacaagtatcatttcagtggcatagtttgtatataatatatgtatatgtgaatacatactaaatatagatatgagtaaacatataaatatagtaatatgtgcgtataagtgtatatactttgtgttatcagctaagaatatgggaacatttcttaatttaactgtcatggcatatactcaaaaaaagccagtaaacaactggagtattcaaggaatggaaaaaaattaaaaaaaaatcatctgtagaatgaaaagtactagcgaagaagaaaaaaatttaaaaaatctgtggatttaaaaaataataataaaatgagaaaataatgtaaatgtaaagaaaagatacagagtgataacaccttgtattatataagatgttgaaaaaaacatctattttatactgattttttttcttaggctgagagatagtaagtcccaatattaacaaatgtaaaataaacaaaacataattgtaagtaaaaactgcgagacacttgatcactattttaaaagcctactaacataaaatcctaactaattactatcaacgatgtatggatcttggtgatttgtttatagaattaaatttctgcacagaagaacaaaacaaaaagaattgcttcataagtcttcctcctagcatgtttttctggctatataatgagtatatagacctagcatttatggaataaacccaactatctcctgaggtcatattctgtgtattgcttcatttaattaactaattataaaataaacatgagctccaaaggagaccgtaagctccagatcagaaagcagccacaccagcaccttaattgcagtccattaaacactaagcagaggattcatctaagatgttcccagacttctgactcccagaaactgagattgttattttaagtcattaaggttgcgtcaatttgttacgcagcaatagaaaatgaatacacctaataaaacaacttgggaagcgcttcttctttttaactgtctgttagagcttttaataggtggtataattccttccttaaatgattgtagaattcactggtgaagccatttggtcctgaagttttctttgtgagaggagatttttaattgaagattttttcttttatgtgaagtatcacctgaattttttatttcttgaattaacttggttgaagtgtgtttttctaggaatttgtccatttcatccacaattttagattcatcagtataaattctgttgaaaatatcgtcttatctttgattgtctgtaggacctatagtgatatactcttactgagttctgctattgtttatctgcaccttctcacttgtttatttgatgaacccgccagagagttgtcaatgttaattttcccccaaaaatcaacttttgcctttatcctctatattaaatattccaatatattttattaatttctgctactaacaccattatttttttctatatattttaggttttatttacttgtttttccctaggttcttagattaaatgtttatataattgatttttagcctttatttttctaatacatatttttaaaaatatattataaatttctctctaagttgggttttaactgccttccacatgtgtcaatatgtagtatctcaaaatgaatcaaaaaaattcttatttgtacttgaattattttttggccaatgggttaattagaagtgtctatcttgttttccaaaaattttagcactttttagttattatttttaaaattttcatgtttagtgttaactactagctgaactctgctgttaaaagaaaatgtattctatatgatttcaattctttgacaattaatgtgtttatctgtatatggccttcatttggtcaatttggggaaataaagtaagcgctctatatatgtcaccaaggccaagcttatttatcacattgctcagattattatctttacagactttatattctagtccaatcagatctgcggagaagtaaaataaaatgttctaccatgattgaggcttttctattctccttttgattctgttaatttttgtatgtatattttaaatatatgttattagatgtataaacattaaaaatttttctacctacctggtacaccaacttcaatattgaaagctctctttttaaatctattattttttgaaagaccatggttattgacattaatgtagttatgtaggctttttagttagtattttatggtataccttttctatcactttagtttcaacctttatttaattatcatatttgttctctcttatctgttattgtctgtaggatctagctgctcttctcgaggagtatctttgtggcgtattttagaatttttttgtaaatacatggtttcaaaaacattcttgaattttatcttgaattgaccatttttctacttatatttaatgcaatttcttacatgcttttgtttaaaagttagaatgatgatgttggttgtaatcagtttttatttaaattcttgacctgttagagaatggtgatttaaattaggtgaaatctagtgtttctgaataggtgtatgcggaagatttctccagacttcgccatgcacaatatgtccatgtaacaaagctgcatttgtaccccctaaatctataactcaagaaaataaataaaaataattttgcagaaggagttgtcaatagaagaaaaatagtcattcatgtagattagccattgtaatctgtgataaaggaaagaaaaatttttaaaaataggattttctataaaagttctcaccatgcttcaatcaaaatataaattatgtctatgagtaaaatataagaatatccagagaatttattatataaatgatttagttactttcagagaactttggtgaactcttttggtaaaatattaaatattaaatatatataattttaactcctcttcctataatacttataaatcttctaaatgtactttaatagattaaaatacctctttgaaaaataatttaatagccgatcataaaatctttagggcatattcctattatgtggtattctggaatcaacatagattttaattgtaagtaataattctgcagaatctcaactttaatttattatgaatatacaatcagatccatttttaaagtgcctgtagtggttataattaatgttaagtgaaaaaaatgcataaatttcacgttttgctgattaatgtttccctgactgtaagcacttgaaaagactgtctagttacagaagaaaagctagaacaagttattttccttccagatgagtgctccttaacacagagacatagctcccctgggaaggttaatgctgccgccaatcttctggagacccagagaggggaaagggaagaatcccaagccaaagaggtttgcaatttcctacaaagccaaagtttaatgaatactaatgacagaacagggatggatccttggaaaactagctcatttcttatcttgccaaaagagatagaatgcagtaccaacttactggggtccatggagaagcaacagaagctaccttggacctgtacacgtcctgttgcctcgggctatcctggagattggccttcagactcaccttcttagagagccatcttcattctttctggaatgactaagcaagtatcaaccctaatctaactgagattgaacaggctattaggctacacagtcacagggaggatgtttagggttccctagaaaaagtaaataattttgaaaaagatttctaagaatcaatttcaattttattttctaaataaatttggcaattaaatgcaaactgatgtaccttaaacagttgcagtagctagcttttgtaattgctaaagtctgtagaattgaaatacctttggaccaagaaaagaaagatccttgatttattcccatacataatgaagatcttaatgtaatgcaaattagttatttaagacctggttcaacatctacctctcaaaacaagtcttccaaaaaaataaaaataacccccccaacccaaattaccatgattatttccatataatgcaaaattaatcatttatttatgtactcatttttacacttgttaatcatgtgttaaaaagaaatgattgctggctgggtgtggtggcttacacctgtaatcccagggagtgggaggccgaggcgtgtgggtaacctgaggtcaggagtttgagaccagcctgaccaacaaggagaaatcccatctctactaaaaatacaaaattagctgggcattgtgtcatatgcctgtagtcacagctacttgggaggctgaggcaggagaatcacttgaacccaggaggcagaggttgtggtgagcccagatcgtgccattgcactccagcctgggcaacaagagcaaaactccatctcaaaaaaaaaaaaaaaagaaaagaaaagaaaaaaaaaaatgattgctaaccaattagagtgcaaaaatttaaagtaaagggtcaatattttttattttttataaagtgctaagaatagtactaagtgtacaacagacattactaatatgctttctctataagcctttatctttacttcatatttttcacattttaatgagtaattatatgtataaagctgtattcatccatctgttttttccagaaaaacatctatctttgataaaaagtaaaaatcgtttaactttattgtgttagatgagaacagtctaattagaaaccagtctcttgttaagaatttaaaagatcaagaaacctgttctatttgctgtagaagaatatacgtatatatgtgtgtgtatatgtgcatacatatacatatatgatatataaaaatatgttacatatgttttatatatgtttaagggttgtatataaatgccttccaacttacatgcaaagaaacaaatgtatgtctaataaacataaatagaaaaggaagggagaaaaaaagaacaaaatacaaacatttgcaatttctatggttaaaatgatatttccatttttgacaaaactatggaattctagggagcaaaaacacttgaagtaaaataatttatattgcactttaaataatttaaccaggaagttgaatatatattaatatttattttgcatattttgccctatttcattaacactgattttccttcacaagcctttctttaaatacctttttcctttagattagttataaattaacagtacaacggagggcggttccaagatggccaaataggaacagctccagtctacagctcccagcatgagcaatgcagaagacggatgatttctgcatttccaactgaggtactgggttcatctcactggggattgtcagacagtgggtgcaggacagtggtacagtgcaccaagtgtgagccgaagcagggcgaggcatcacctcacccgggaagcgcaaggggtcaaggaattccctttcctagccaaggaaaggggtgacagacagcacctggaaaatcaggtcactcccaccctaatactgcactttcttagcaaacggcacacccagagattatatccttcacctggctcgaagggttctacgcccatggagccttgctcattgctagcacagcagtctgagatcaaactgcaaagtggcaatgaggctgggagaggggcgcccgccattgctgaggcttgaagaggtaaacaaagcagcggggaagctagaactgggtggagcccactgcagctcaaggaggccctgcctgcctctgtagactccacctctgggggcaaggaatagccaaacaaaaggcagcagaaacctctgcagactttaatgtccctgtctgacagcttggaagacagtactggttctcccagcatgcagcttgagatctgagaacggacagactgcctcctcaagtgagtccctgacccctgagtagcctaactgggaggcaccccctagtacgggcagactgacacctcacacggccgggtacccctctgagacaaaacttccagaggaatgatcaggcagcaatatttgctgttcaccaatattcgatattctgcagcctccacgctccaggcaaacagggttggagggaactctggcaaattccaacagacctgcagctgagggtcctgactgttagaaggaaaactaacaaacagaaaggacacccacaccaaaaccccatctgtacatcaccatcatcaaagaccaaaggtatataaaaccacaaagatggggaaaaaagcagagcagaaaaactgaaaattctaaaaatcagagctcctttcctcctccaaaggaacgcagctcctcaccagcaacggaacaaagatggatggagaatgactttgacgagttgagagaagaaggcttcagatgatcaaacttcccgaggtaaaggaggaagttcgaacccatggcaaaaaagttaaaaaccttgaaaaaagattagatgaatggctaactagaataaccaatgcagagaaatccttaaaggacctgatggacctgaaaaccttggcacgagaactacgtgacaaatgcacaagcttcagtagctgattcgatcaactggaagaaagggtatcagcgatggaagatgaaatgaatgaaatgaagtgagaagagaagttcagagaaaaaagaataaaaagaaaataacaaagcctccaagaaatatgggactatgtgaaaagaccaaatctacgtcccattggtgtacctgaaagtgatggggagaaaggaaccaagttggaaaacactctgcaggatattatccaggagaacttccccaatctagcaaggcaggccaacattcaaattcaggaaatacagagaacgccacaaagatactcctcgagaagagcaactccaagacacataatcgtcagattcaccaaagttgaaatgaaagaaaaaatgttaagtgcagccagagagaaaggtcgggttacccacaaagggaatcccatcagactaacagtggatctctcggcagaaactctacaagccagatgagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgcactaaaagagctcctgaaggaagcactaaacatggaaaggaacaaccagtaacagccactgcaaaaacatgccaaattgtaaagaccatcgaggctaggaagaaactgcatcaactaacgagcaaaataaccagctaacatcataatgacaggatcaaattcacacgttaacaatattgaccttaaatgtaaatgagctaaatgctccaattaaaagacacagactggcaaactggataaagagtcaagacccatctgtgtactgtattcaggaaacccatctcacgtgcagagacacacataggctcaaaataaagggatggaggaagatctaccaagcaaatggaaaacagaaaaaggcagggtttgcaatcctagtctctggtaaaacagactttaaaccaacaaagatcaaaagagacaaagaaggccattacataatggtaaagggatcaattcaacaagaagagctaactatcctagatatatatgcgcccaatacaggaacacccagattcataaagcaagtccttagagacctacaaagagacttagactcccacacaataattatgggagactttaacaccccactgtcaacattagacagatcaatgagacagaaagttaacaaggatatccaggaattgaactcagctctgcaccaagcagacctaatagacatctacagaactctccaccccaaataaacagtttatacattcttctcagcaccacaccgcacttgttccaaaattgaccacatagttggaagtaaagctctcctcagcaaatctaaaagaacagaaattataacaaactgtctctcagaccacagtgcaatcaaactagaattcaggattaagaaactcattcaaaaccactcaactacatggaaactgaacaacctgctcctgaatgactactgggtatataacgaaatgaaggcacaaataaagatgttcttcgaaaccaacgagaacaaagacacaacataccagaatctctgggacacatttaaagcaatgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaagataagagcagaactgaaggagatagagacataaaaaaacccttcaaaaaatcaatgaatccaggagctggtttttggaagagatcaacaaagtcgatagaccactagcaagactaataaagaagaaaagagagaagaatcaaatagacgcaataaacaatgataaaggggatattaccaccaatcccacggaaatacaaactaccatcagagaatactataaacacctctatgcaaacaaactagaaaatctagaagaaatggataaattcctcgacacatacaccctcccaagactaaaccaggaagaagttgaatctctgaatagaccaataacaggctctgaaattgaggctataattaatagcttaccaaccaaaaaaagtccaggaccagatggattcacagccgaattctaccagaggtacaaggaggagctggtaccattccatctgaaactattccaatcaattgaaaaagaagtaatcctccctaactcattttatgaggccagcatcatcctgataccaaagcctggcagagacacaacaaaaaaaagagaattttcaaccaatatccctgatgaatctcaatgcaaaaatcctcagtaaaatactggccaactgaatccagcaacatatcaaaaagcttatccaccatgatcaagtgggcttcatccctgggatgcaaggctggttcaacatatgcaaatcaataaatgtaatccagcatataaacagaaccaacaacaaaaaccacatgattatctcaatagatgcagaaaaggcctttgacaaaattcaacagcccttcatgctaaaaactctcaataaattaggtattgatgggacatatctcaaaataataagagctatttatgacaaacccacagccaatatcatactggaaggcattccctttgaaaactggcacaagacagggagtccctctctcgccactcctattcaacacagtgtgggaagttctggccagggcaatcaggcaggaggaggaaataaagggtattcaattaggaaaagaggaagtcaaattgtccctgtttgcagatgacatgattgtatatctagaaaaccccatcgtctcagcccaaaacctccttaagctgataagcaacttcagcaaagtctcaggatacaaaatcaatctgcaaaaatcacaaacattcttatacaccaataacagacaaacagagagccaaatcatgagtgaactcccattcacaattgcttcaaagataataaaatacctaggaatccaacttacaatggatggaaggacctcttcaaggagaactacaaaccactgctcaacgaaataaaagaggatacaaacaaatggaagaacattccatgctcatggataggaagaatcaatatcatgaaaatggccatactgcccaagggaatttatagattcaatgccattcccatcaagctaccaatgactttcttcacagaattggaaaaaaccactttaaagttcatatggaaccaaaaaagagcccacattgccaagtcaatcctaagccaaaagaacaaagctggaggcatcacactacctgacttcaaactatactacaaggctacagtaaccaaaacagcatggtactggtaccaaaacagagatatagaccaatggaacagaatagagccctcagaaataatgccacacatctacaaccatctgatgtttgacaaacctgacaaaaacaagaaatggggaaaggattccctatttaataaatggtgctgggaaagctgactaaccatacttagaaagctgaaactggatcccttccttacaccttatacaaaaataaattcaacatggattaaagacttaaatgttagacctaaaaccataaaaaccctagaagaaaacctaggcaataccattcaggacacaggcatgggcaaggacttcatgtctaaaacaccaaaagcaatggcaaaagaagccaaaattggcaaatgggatctaattaaactaaagagcttctgcacagcaaaagaaactaccatcagagtgaacaggcaacctacagaatgggagaaaatttttgcaatctactcatctgacaaagggctaatatccagaatctacaaagaactcaaacaaatttacaagaaaaaaacaaaaaaccccatcaaaaagtgggcaaaggatatgaacagacacttctcaaaagaagacatttatgcagccaaaagacacatgaaaaaatgctcatcactggccatcagagaaatgcaaatcaaaaccacaataagataccatctcacaccagttagaatggtgatcattaaaaagtcaggaaacaacaggtgctggagaggatgtggagaaataggaacacttttacactgttggtgggactgtaaactagttcaaccattgtggaagtcactgtggcgattcctcagggatctagaactagaaatactgtttgacccagccatcccattactgggtacatacccaaaggattataaatcatgctgctataaagacacatgcacatgcatgtttattgcagcactattcacaatagcaaagacttggaaccaacccgaatgtccaacaatgatagactggattaagaaaatgtggcacatatacaccatggaatactatgcagccataaaaaaggatgagttaatgtcctttgtagggacatggatgaagctggaaaccatcattctcagcaaactatcacaaggacaaaaaaccaaacaccacatgttctcactcataggtgggaattgaacaatgagaacacatggacacaggaaggggaacatcacacaccggggcctgttgtcgggtgggggcaggggggagggatagcattaggagatatacctaatgtaaatgatgagttaatgggtacagcacaccaacatggcacatgtatacatatgtaacaaacctgcacgttgtgcacatgtaccctaaaacttcaagtgtaataaaaataaacgtgaaaaaaatttacggtacatcaaaaggaagactctttttctaacccagagttgtttcattactcagagcttctcaaataatttgacagatacagcaaaaaattatttctaaaatgttttctatcacattaatcatcagaatgattaaacaatatgttaagatatttccaaaatgcttcccacatttgtaacacgtaacactcagtgttagcataaacttaacttttaggtctttcaggtgttagtctgaaagttcctatttctttgctcacttctatatttaacataatttaaatttttgattatggaaaactacatttgcatgtgccctctaagtagtttgattgtgttgaaatatagatgcttaagtagttctatatcatagcagttacagtggtaaacatttagagaggacttgcgtttgccaggcaggtttggagcactctacattgctggctcattaaatagaaccatcttgtaaaagatcctgttttcatcataatcacatggtttaagaaatagaggcagaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaaagaactcaaacaaatttacaagaaaaaaacaaccccatcaacaagtgggcgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttctacactgttggtgggactgtaaactagttcaaccattgtggaattcagtgtggcgattcctcaaggatctagaactagaaatactgtttgacccagccatcccattattgggtatatacccaaaggattataaatcatgctgctataaagacacatgcacatgcatgtttattgcagcactattcacaatagcaaagacttggaaccaacccaaatatccaacaatgatagactggattaagaaaatgtggcacatatacaccatggaatattatgcagccataaaaaatgatgagttcatgtcctttgtagggacacggatgaagctggaaaccatcattctcagcaaactatcacaaggacaaaaaaccaaacaccacatgttctcactcataggtgggaattgaataatgagaacacatggacacaggaaggggaacatcacacaccggggcctgttgtggggtggagagagtggggagggatagcatttggagatatacctaatgttaattgacgagttactgggtgcagcacaccagcatggcacatgtatacatatgtaactaacctgcacgttgtgcacacgtaccctaaaacttaaagtataataaaaaataaaaaaaagaaaaagaaatagaggcacaaagaagaaagtaaatttgctcaaggttacaaacagctatcaagaggttgagtcaaaaatcaaattgaggctgactttccagagtccacactctacaccactacatcttatgctattttgcaaggattacaagaaattgaaatcaaaggtttatataaaatatggtttgcacacaatattgtatactttctataattttattaacttttaataaattgtagtctgaactgactctatgtgtacacttgacactaattattttggaaactttcctagcagttaccctttatcatctttggggcatatacaaaatgttaaccattctacatcaccaagcttctccagcatgtttatcctagtgttctgtgctttttctcttttacctactttccactatatcttcccctcagacttttcactgtgcctttgaaacctctattttacataaaacaatctttcctattttatcactttgttgaaggagcccatcatcactttacctcaacgaaaatagatttaaatggcttcataggttgcaccaataggatgcttttccaaattcctcagctcacttaacttcagaaagcagtgttagcacctttcttgaaaaccattagaatttccaacccattactcctccattctaaagtagaaccatctctactttggtgctcacaccatctgactattcctcctgttactcctccccatcattaataactaaaaatggcatggtctttttaacatgtaaatgaagttagttaatgaaatgacttcaattcaaacaagcaactacaatcaagtaacagatcccaaataaataataccttcatctttcatcaatcttgttattaaacaggctttgtcatatattccctctacatgtctggacttcagcttgagcagattcataactttccagtcacttagagttacaggaataaatctcattgtggatatccagaccattttcaagttcagaatatccagtacagcccaccaccaaaatttaagttacttatttaacagagaacttttctgatcaccccaccttgaactactagaaaagaggaagatgatccactttttcacctgcattctatctgcttcataggtctttcttctaggttggggcagggatatgaaagtgggttacaggaaaaaaagcaaagttttataagactggtgacttctatgttccaggtgccaaaatactggacttctaaattgggactcattagaggattctttggaggtcctcccatggggacatcccatgctacacagatcattgacataggcaattgctatttgctttctgactaaccatttgcctcctgccaccacctcacatttcagtttatattcttggcaaaacagctgacatcctattaattcttaatactggatcccattgccctagcaggcagtcatcatataaagggttctattatccttctacttcatcagtctggcccatgggaagctcatgtacctttgacacaccaaattcttgttgtaaagaccactcttactgctattctttctcactggcctaatttaggttagcttaaccagacttctacctcccaaatttactggagaagaaacaaacatctgattcagtggtcttgcatgtccgcaaactccaaggaatgcacattaatttatttcttctcttaccttacatctaacccatggaagtacttgatatattgctgaaaaaatatcaaaatacgaaaataccactgcttctttctatgagtcattgctttgggtccaccctcatttggctaaggagaagcacacacttccctccacagagtaaaaaccctgcagtactccctaccagctgacagctctctgctaatgagtcatctggtcttctctaagagagaataatagtggtgattcatagtggcaggactgatgctgccattattacaagtctgtggtgaatatgtctaacacttctccaaagaatgtggggatacttatcatcaatggcactatgttttggggttttaaagataactatgattcaacaatggaaacctcatttcacattttttaactcctgcattttttgaagttttcaattactggttcacactattacaatctgagacctgttatcatcatcattcttgtttaatttatgtttattaaatacttattgaaggcatactatgtgccagcgttggtggtccagcattaaaccagacagaaatttctgctctcataaggtttctattccaatgatgttaaacaatgtaactaagacatacggcattctaaatttgtccctttgattttctctactgttatttcttccagtggtcaacatttaaaggtttccctgggtcctatttctttccctaccataaaattctattaatactgattttgtaagttttttttcatttgctattgtcatttttactaccactactatagtctgaagttcacctttgtaattttattccagaattattataataccctcaatctcctttttccatgcagtatgctgctagagttatcattgtgagcacacaaatatgtccatgtaaatcgtgtgctcattaacatctgttctaattcattcattcaaccaatagttattgaggaactcatatgccaagtattataaatctttattctataatagtgaaagaaagagacaaggcttgtaactatgtaaagtttatattctagtagaaaaatataaacaatcatcctataggatcagaaaaaataatattgagtgttcacggaaaactctgttaaagtgacaataaaacaaagacctaaagaaagtgaggcagtaagccatgaggatatctgaggggacagcatggcacaaagaaggaaaaatgacaagcgtattgtcccttaccagtaataaacttgtctgggtaaaggggacagcaatggctagtgcagcctaagtggataagctatggagaaaaaggtagaaggtgagttcctagaatcatcgtaagggaaggaagtaatgaagagtctcagaaaccactccatgagctttgggaattttattgtgatgggaagctaacatagctttaaggctaaatgtaacatattgcaatttacatttcataaaacctgtccttggttcatagagactggacagatgagaaagaatggtggctttaaacacagtggtagttttggaggattctaaataaattgtgaagacaaagccgaattatgactttaagtgtttggcttttgagaagggtagcatgaagtagcccttaactgagaggggaaaatagcaggaggtttgtaagagtgatagagggaatcagaagttcaatttttaacttgttatgttttaaattcctatcagatatacaagtggacatgtcaaatgtttagtcatatacacaaatctgaagttcaagggagtgatctaacctggaaatataaatttttcagttattattatttaagtagaacttatgctgtgaaatagattgggccatcaagggcctgaatgtagatagaaaacattgcagggcccacaaaaatgattcatccaacactgtggcctcccggttccttaatatcatcaattccaattagcctcagtccctctttatttcatcacccatgtctatgaccacaatctggaatttactagtacctggaaatattttggttctgaaatgcttaaaccaagcacacaggtaatgacaaaacacactcaaatcttatctccttaaaataattgtgcctcaatcccatctcctctattggctattgcttcctctgacttcctgcataaccaagctcttaaaatagttctctacagtcactgaatacagttgttagtcttccatttaatctctcaggcccctggaaacttgattttacctaaattactctactacaattactctcaccaagataatttcttcttgttaaatacaatgaacatagtttgtgaactctcaacatcatgaaactgctaataaccctcttgccatcctctctttaacttggcattaatgattctcacatttctggtatcccatccttggacccatctctgttttgtcttttttgaggcacattcttcctctgacctttacttaagtgcttttctttctcaggctttattctgaactctctcatcttataactctatatacatgttttttgggaggatgatgtcatcaactccaatagctttaattaagtcttctacatgtccaaataaatagctttaaatgagacctcacctttaaatttccaaatcattcatatattcccaactcagctcaacttaacatgtctaaaactgaatccctcatttcccccttgaaaatgctctatctcgttggtttcttgtcacgatgaatggtaccttcatccactcaattgccaaaccagaaagttccaatatcagccttgacttctcaataggcctcagtctgcttccaaacaaccacctattcttgtatgttcaccatgttctcagtatctcatgagtcaatccattcttctccattcttgttgtcaccttacaggcttttattaaccatctaatttttttaaaaaataatgtcaagtttctcctgtgatattgccctcagttattgttataatctagggagacagacaaaaaaaaagtcaccatgatcattttcatcactatcctttggaagaaagactgcaagtcttttcataggtctctttgctttagtcttttctctaattcgctctccaactggtaacaagaaaatgtttctaaagggaagatctcgttgactcttctgtttaaagacttcaatgcttccctttggtctttagtataaagtacaaattccttccatgtaatttatcatattcttgcccaggcttaactttctagccttctatctcacctttatctgccatgcccaggttattttatactttactacatgacgttattttctcattttttacttatgcagatgctgtttcctctgctgaatataccatggtccccccatcacttggcgaacttcaattcattctacaattggcaagaaataaattattattttctatttgccttgcttgtttctccagcccctttctattcccatcaattgcattatgtgatactcttacttgctttcatctcatcttgtgcttacatgatattataattggtttttgccaaactgttcattcaagtatattgtaagattctgaaatgagtaactgtgtattgattatcagtgtctccaaaacctaaccaaatgctatagtacagcctagcacatagtgtacactcaaatatatattgaatttgaaataaacaaataggaaaatgaaaggaaataatataacaatataaggttgaaatacaacaatataaggttgaaataatttaaattaggacacgattcagattaatattattttattatcttatctgttgaagtaaatgagtagaacattgtcacttttgaataatcaaattaaaatcagttttgtagatttttaaactctaagaccatttacaatttaaaatatatataatttggtctaaacagcacactcagaaaattgaaattgttttaaattctgtggtgtgtttatctaaattgctaaggaccatcaggaagacaattaaaatgagaacagaaagtacaattctgtttcctcagtggggaaaaaaaacctaatagagcttaagaatgttcaggacagtgtgcatatcaagcccaaggatatgaattagatgggtaatcacttattcatcacactctagaaataaagagaaccattagcatttaggaaaaaaactaaacttagaacatttaaaagtattaagttctatagggagcaaaatgtatagatcttattattccaaagaaataaatagaaagaaaacaaggaagaaactgaataccttcagtggtattcttgctataattactatatgaggcaatgaagtagatttaatttaaatcctgataataacattttgtaacatacaatgaaacatcttcacatttgaccaatgtatgttacaacgaaacatgctctggaatgtctcatgtagtctctttattagatttttgtcaatatcagcccttaaaaaacatcagaaataataagaaagtaaatagctacataacaatcaaaatattttcctaaaccaaattgcaaagagaaacacctttcattgtgtatatacagactctgcttgagtctgttatcactaaacttaactcgtatggccaagctgatccactaaatcctacctgttgacttacacctagtccacagtctacagacaattctggcaccagggcaggggttgtcttaaaaattacacctctctcctactggctcatgggttcaacacaagaagggatccttcacactgctggttacacactgacctgcacaactacagctctccagatagcaggttcatgctttacagatacataacagagttcatgcattgcaccccagtacttcagtattcaaagtcctcttggccataggtaccagacatggatatactttaccctggccttgccaggggttggctgacaatgtggggcactttgattctttacagttcccaagttttttacattttaatattgctcatatttaaaacataaaacactatgacaaagtggtatatttacaaagcactatttaatttaataacgaattttgcactttcaattttgattatctagtttcttttcctttgtacttctatgtaaatataaattctatgctcttatgctggaggttaatctgtgatcaaatttttatgaatggaaacatatgccaaatatagaatatcttttgatataattttcaaagacagctttaagttaatatttaacagatactatttttttctccaatgataaaagcatttattttctaaaataattatgtgatttggaaaaatctgcaagttgtgtttgctgctacaattaatttacagtttctgaattaaaatccttttcagaaacaggccatttgtaaaattttgaatcacccttgaaaatcatgaatgagtgattttctttttctttattaacattaaaactgagaattttcaataaaatctattgaattttcaataaaatctatttaacacttattgttaaaaatattaatacaaaattctcctagagttctcaaatttattcttaccagatatgcaaatttacttataatgacatttgcaaatttgacacaaccttctatatatgccttaccatttgaaataacaaacttcactcttttttctaatgcttcagaaataacatttatgtgtacccacagcaaaatttgcaattttaaacataccattaacatttcaatatacctctgagatttctattacactggcaaagaaattacttgacagctatgcatccttatgagagatcattcactcaatacttgatgtattctgttcaataaatgaaaaaatataagactttgaatttcttaccaatgaaaacatcatcatagaatggtttctagaaaaagcatagcttttgaagtagacaatagtattttgatgatctattaaaatgacattttttagagaaaggaaaaaatacactttgggaggccaaggcaggcagatcacttgaagtcaggagttcaagaccagcctgaccaacacggtgaaaccctgtatctactagaaatacaaaaattagttgggcatgctggcgcatgcctgtgatctcagctactcgctaggctgaagcaggagaaccctttgaacccaaaaggcagaggctgcagtgagatcaggctactgcactcccatctgggtgacagacagaacaagactccgtctcaaaaaaatttttttttaattttaaaaaggagaaaattattttaaaaacttgaaattgatttagattatgtataatttaatctgactttcagttttctaacttggaggcaaaaacaatagcttcattcattgctttattcttaaataatggaagtaaccctagatactattgggctaaatacctagataccttagatacttagggctaaagaaaatgactgttacatagctcccggcagtatgttctagatagctccttaacaatgggagacactaaattaatgtgtactactgaacccctagattagctaagcccttatgcactctgaaatgttcataatgttttccactctacaaaatgttataaaataagcacaatcattgaaacttcagaaaacgtaagtataaaataaccatcatggtatagcacagccaagaaagaactatcctcttcacaatattataagttgttttaaaagaaaaaaatctatctatctaagtatacatatatagattgatatactatacacacatacacacacacacacacacacacatatatatatagagagagagagataaagttgtataactcatgcctattcacttttatttattgggaatgacattgatgtcgtttgccttcaggataccatttttcctttctgtgacctttattttctccctgcaaaaggattttttcaacaactaggccacatacccattcaatctttcatgtttagaaacatgctttcttagagggtatgacaaactaacttattttaacatgtaaataatggataagatctttatcagtacttagcagaagacagatattttattttgctttgaacaagagacaaatcctttgaaaccaactaatctctaactgtagaattcttccaggaatcagtgaacagttgagggaagtattttgaaggtagtagatctacttttctgatgtaagttgaattctatgggcaagcactgtgcaaggcagaagggtaaaattacatcacataagcactcacctgaaatacttaggtaaaagactggccattaatcctgtcaatatactttctgggttgacttacatttcatcttgccttacattgtaatgtaataggtctaggggataaatacaagcagctgtctgcagccaatacatttttccacataaatacttatgataaaaataaaaagaaggaaaagaactataatacattttttagccatactttaggagcaacttgatgaaaattagataacaccgtgagacatatctgagtgagaaagagctagaacagaaagttatctctctaacaactcactggtgttttaatggagttaaagtacttcacctacatgcctatgtgaagaacagctaaaaagtgataacactgagttctgtatgttccacattaaatttcattttgctaaacaaaaagcaagtaatgacaaaaatgtatgcattgactatttgttgatataagttgaatctgtcttattactttagatatactttgaatttattttggatctcaagcatgaagtcatagggatgtcatctctatcagtgttttctgaaatctgacatcacagaaaggactaagatgttccaataatagaacatcaagcttttgttgctgcttgtaaattataattcatagaaactttagaacactttataaactttaatttcctggaagcttcctgaattaagtagaaaagaacaatgtccagagtcaatactatttatcacatggacataatttttctcagtaactagaaaatatattgcaacccaaatactatactcatatttagaaaaacaaactctccagttagtagaacataaattactgagatattctaataaagattttattcctatttttaaagccaataaattgagataaatttttatgagttgttaaaactttttaataaaaacaccagcccacacctcaaagcaatttcatacttctgttattagtttctataatagctgtatttataaaaagtacctgcatatgacaaataatatacaagcaatcaactgataatctggtgtgtacacaattcaattcatcaatagttaaatttaatgaagaatctaacttaccggtggatcagcccccttagaaccagccagccctcctgttagggattcgatatcctgaaaaggggagaggtgttgattgtaaagtgctactcaacagcatgaagaatcccccagtcccacagtgtaataatttatttagctgcaaagttagggcatgtcagctattttattatttttttgcaatcttggacactgtagtactatacaaatagtctacatctaaacatctagatattctctccaactctggaagtctataaaaagaaaaacatgtaaacagatttttttaaatatgcagaagtttcatctttgaagagctgaagtgagagcagaaaaaagaaaatttaagaaaacttcagtttaacgtactattttgaaaaatattaaacccatggaaaatgtttaacctaaaaatatttaatttttttttattttttatgaatacataatagttgtacatatttatgacatatgatattttgatgtaagtatttgatgtgtaataatcaaatttaagtccatcacctcaaacatttatcatttcattgttttggaaacgttccaaatatgctcttctggctatcatgaaatatacagtaaattattgttaacaacagtcgccctattgtgctactgaacattatatcttattcattttatctaactgtagataaaaatattaaccaaatcttcttttttcaccacctcccaactagccttcccagtctgtggtaaccaccattctattcactacctccatgagatcatttttttttatagctcttacatatgagtaagaacaggtgacatttatctttttgtgcctggctgattttacctaatattctccaggatcatccatgctgttgcaaattttaaaaattataactatggtctactctatttctacacatagagtataaaaatataaagagatcgatttttaacctttaataggtaaccacagaaggtcatgcttgagtaatgactatagttgttaaatttataaatggggaaataggaaatggtgtgataagctgtagaggctgtgacctgtttatagggacaactacaactcagccctatcagttctaaggctttggttccagggttactaatgattatatgacttattcaaaagaagttgcaattctaggttttaaagtaaaatcacccaggtttttagtgtttgcaactgatttaagttgtaaaccgtccctcatccctcccaaatgaaaaaaacacaactctctgctaaaaggctgctggaaaggagttttgggttaaatcgaatggttacacttcttggctaaaaatgttctttcttatgactctgatcacctcttatctgtttgcatctagttggaaagacagggatgaagaggggggaatatagttgcattaagaaagcaaaaaagaaggataattaagtcccaattgaagtaatggaaatttaaatgcctatgatgaggaaaaaggccaatattttgatataattaagaggacttatgctactaattcacttaggacttaatcagatgattttccccttatattgaaaaagggaggactcttaataatacattatggggctgggatgagcatgtgatggaaacgttcaaggaaggggacagggaaggatggtgttataactgtttctatctgaaatgctaactgtgaaaaggaacataatgggtaatgaatttattcatgcatagtctattaaaggtcacaaatgacaaggagtacttaccaagaaaattattaaatggtctcctttctaatggaaatgtatatatattttttctctacccagaatccttttgagaaactactccttcccctctcccattctagctacaaaagaggctaacaaaaattgcttcaaatattgtagggacctgccagagaattaaggcaatatagaatctgaaaaacataatggtagagtttaagtccttgattgtatcatttgaggaatgtttgaaatgagatgttctctctgcctgcaattcagcttaaaatagatttctggctctgaaaagtaaaaatatcctaattatatcggcattttttgggtctgtttgtaaaaggcccaccctctccatcctgttcaaatgctttattccaacatcatgcccaacataaaaaaaatcaactcatctaaattatctgatcttacatgttctttagcattcttattgtcacttaagtaaattttgtctttgtataattaaaacaaagcatcaaacacatgtataaattgacaaggaatattaatatccttatcaaatccaaagataaaacataacttaaaattgtcttaaaatctcatggaatgaacaacattaggtagtaaaatgactaaaatattagatttacagaaaataaaacacacagcttgcactgtttgataatattctgctatgaccatactgaaaagtttctgttcatgtaaaatgttatttccaattatacttaaaatgaaaaaaagataccaagtgcatttggagttaatacatgtctttctttgtagaaaggcatataagttatattaatgatataaattttaatgaagctatcagagggataatagagaaactgatgtggataacaagtattttagcaatttagtcaatgcattttctcatattttgtaaagtttgatcattaagatttcttatctaagtaagttgtgccaagtttcagatttttaaaattttaagctctttgtgattatcatgtcttgagaaaaaatgagaaagaagaatgtagaagatgaatgaaaagggcaataaattttgtagtttttaacacattgaattcaaaatcaattacgaattcatggctctaaatagtatacagatgtatattcttatctctaaatgggtaagttgtaaattgaatgtaaatcattcaattgtaaaaaaatgtttgagttcatgttctattttgagtgtaagttgaaaaggagtgtcctacttggagagaggtccaagttaaacacggcttatcagttcatgcaaaaggaattttctcaggtgtgcataatgaacataagtgtgcatggatacatttatgttgtaaaataatagataaaacaaatacttgaggaactctggacatatgattactacatagctttcaaatgataactaaaagtgagtcaatatttttgatggttgttgaatattttatctgcaaagtataagtaaaatctttggcaaatgtgtctattttcttatttcaatatattttatatagataacaacaaaaggggacatcaaatagtataaacattgacttcctagaaagttttttgacttactattgtaaaaatattatttgtttaattaaaacactcaaaacatcattttatttttaactaggctacagaatttatttaaccatattgcataccatattgaggtcatcatttgtatctaatagataataaaatagctactactcagtgaacagttgctatgtgccaggtacttttataagtgctttgtagacattaatgccataataaacttatgttagttaattattttctcacttaaaaggttagatagtttacatgactcatacagtatcatagagctattaagaaatgggttataaaacatatacataggactccaaacctgtatttttttaattaccagtcctagtgaacagtttcaccctggtaccctggtgacactgcacatatctatgttggcgatgcaggtaaggctaaaccacaggctggtaaatcttgatggaatatcccgtgactctcccagaacatgacaaaggaggcagtcttatgaggagcttttacatagctatttcttatttgcctccctcacactagtgaggcatgggacttcccacacctcacacctccctacaccaggtccatcttcaggatatcaaactacttaggtgcagtatggaattggctcctacctaacaatacagcccacttctcttgttgcctatcatttgacccatccagttcagtgttgtccagtggaaattgggaccagggtcagaattagagcaggtaagtgaggtgcctatagtgcaaaatttaagtaggtgctggttcttagggtcatacaactgctgacctgcacttgtataatcttgatagtgagcaccttattaaattttgtgccctaagcacctcacttgtctcatctgaatcctggcctttctagggacctgaggagctgaaacaatggtagccttctttatgctgactgtgtaagtaacaaacataaaaccatttggattcatcgtctccttatcactcgaatctgtagaagtgtagcaagcacctacgccatgtggttgctcagggactgcatgctgcttcacactggtatcctcaatcatatgaatttttatcatcaatgctgaatgaaataaactagtatgtattaattatataagaaacttcatttcttaaacatcatttcagataatgaaagcttcattttcctctccaaggtgtgaaaaacctaagtggggttattagccagtccttaacacagctgtgcagattcagtttttcaacactggaaagttctgttcctggcatgaaaacccagtaaaccaaggatggccagtgaatcagaagtcttaaagcttgggaaggttgagctccaggaagagtgaggtgatcagtgtcagagctctaagtagagtgagacttagggcattctcagacttgaggagtctacattgcactgcatttgtaatagtggttgttcgcctgcacctttgctccctggcctcctgcttcaagaattggcatatttttcccttgacaaacactttgaatgatggagctatagggattaataatgtggctctcagtgtaagccatcaagttcagatactgtaagtcttgcttcctttgtgtgcaagtgaaaaaaaaaaaggatattaggatttcaggtctttctcagagctgttgctggattcttatttttatccctgaagagcaggatcagccaattatgttaaagaaaaatatgataaaataatttggctatcgaatacagtaagaatgaacaaataaaattctaaagagttagttgactctcgcatcgcatatcccacaagacccaagagatcttcaaacctgagagttatatttaaagttaatatcaggttttaagctttcacttgttcaaaaagtcacttaatgtaatatgaaaatacttaaaacattataataattgtcaattatgggcattttaaaatttcagatttatgcattgttatgggttaaattatgttccctgaaaattcagatgttgaaatcttaaccctcagtacctaagaatgtaactgtgtttgaatgtaaggtctttaatgaggtgattaagaagattgatccaatatgactggttgtccttataagaagcggaagagatagcagggatgtgtgcacactgagcaaaggccatatgagaacacaagaagaaggcagcaatttctaagccatggagagcaccctcagaagaaataaaatctgcaaacaccttcatcttggaattctagccccagaactgtgagaaaatacatttatattgtttaagtcactcagtctgtggtattttgttacaggagccctagaaaactaatgcatgcatatttgtaatttgggactagtttttagattctttgggaaaagttaacatatttcaatatagagtacataagagttcattaagcagtctataaaaaaagtcagtatcagtggaatcaatgtgaaatagtaaaatgaccatttctgtcaaatggttatatttaaaattatttcaagtctttaaaatatttaatgaagtattatgtatatgttaaaacttgacaaaatttattgtattcaaaatattgaaattaagcatttctctcatctcctttatagaaaaatttctcaaaattcccctctcccactactttctgttgacatgccctattgtgcccaccacatcactgcaactcctcttatcaaggttgccaatgacatcctatcgttcaaatttaatttttcatgttctgtcatcatatttcttgatcgctaagcttcagtcgacacagctgactactccatctttattgaaatacttttcccttttggctttcatttattttcacccgctacatgattttatttagtactgtggctctaaatataatgcatgttgataaattttgaatttctatcttcagcttcaacttatcctctgagatccatactgctacttcaatctccacttagatgtattatagccatgtaaaatgcaataatgcaaaattaaactcttgattccatcacaactcttcccttaaattaggttcccatcccagtgattgccatcttattaaatgacatcaccattcacccagttgctcaggtccaaatccatcagcaaaccccactaagtctattgtaaaaatactacttgaatttgactacatctcattaccttcattcctgtcatcctaatcccttgtactatatcaataatatctatcacataaactgaaaaaaataatatatatatatatatagctttctaactgttgtccatgaatttgttatctccctctcccctatatattctccacatagtagcccaactatccatttaaattttaagttagatcacattgctgtcttgaccaaaaccctaaatggtttcccagcaatcttaaaacaaaacacaaacttattgctatgctctgccatgccctgtatgatttggctcttggctatctctctgactatatcttttgccgttctccctctgtcctgccttctcagacacaatggcgtccttattattccaaaaaatattcaaaatttggcttgtatctcaaggcctttgcccatgcttttcctgcttcttagggtgcttatttctagatgtcctcatccattttgtgttgctataaaggatgacctgaggctcggtaataaaaattaaataaagaaaaaaaaggtttatttggtgcagaattctgaggccagaaagttcaagattggacttctgcatctgagcagggccttaggctgcccccacctatggcagaaggccaaggggagccagctgtgtgaaagagtgaggaggtgccaggctctttgtaacaaccagctctcatgggaactaataaagagagaacccactcacccccaagggagggcattaatctattcatgagggatctgtcccatgacccaaacacctcatagtaggtaccatttccaacattaggtgtcaaatttcaacatgaggtttgaaggggacaaacattaaaaccatagcagtagatatcctcctatttaactcacccacttcattcaggtcttagcataccaaaattctgaatcaccttccaaaactaattatctaaatcagtcaaggttccacctgaacaaactgacaaactcggagactatacagaagaacatttaataaaggtatgatttatagaggtatggatagtttacagggtccagagaaatggtggtacatggggactagcaacagctagacattgcaaccacccttaaacctaaagaaggtgcaagaacaatgtagtcaagagtccagcaagaggtgaatacctatcatcagcctatagaacagcttgccacacagtggagactcaataactacttattgaataatacaattattgaatgaatgatgtgatactatttttacatatataaaaagctgaatctcagagtacatatggtgaagtgtgtcttatttttgtataactgtatcactttgaaagcatggctgaaagcaataatgtttgcacaataaatctttataaaatgcctgagtgaataaactaataaatgacttgccccaaatcacacagctggtgaatgcttgaaagaagctttgaaatcccaagtgttataactccaagcccagcatattttctgttccatcatatatcactaatgagacatcctcctgaaagaaaaactcctcaactctgtattttctcatctcttgaggtactaagtttctatatattacatggtttctagtgcatcagaaggaaaaatgcaaaattatttaatagtcaataaacaatacattaaattcatcctctggttaaatactgccaatgcttccaattaaaggtctgacaccttaatcattgtacaatcaataaatcaatgcttgaaaatttgacctaacatgtatgtctggcattaataaatggttcaaatatgttaaactaaaaatcaataatgtttatttttatgtaacatctcatagtgtgttggttcacagcactgggaataagtaatagaagataaaatttattttaaacaaatcattcactttttcacacaaggcttaatggaaacaacctttcatcaccgaataccagctccttaaggcaagcatccaaataatgaagctgagtttgttaatgaggcatcttcctcctcaaccagacttaagcagttagtgtttccttgacaacattatagggtaaatttcctgggaggcatagaataagcaggaaacatacagaccaattttataaatttttcctatgtaagccaaaaggtgtcctttttaattattctttaaaacaaaaaaaggggaaatatctctttctttactttgagtataggccagcctgaatctgaattttccttaagccacacaattaattccttcaaaaaagagcagttgagcaaattttgtggctgaggcactgtactcttcatgggaggacacaatgaggagtaaatcaaggtcacaggtttcatagtattcagagtcatgacatgctctctgactttaaggatttttcagtccaaaagcacataaatctgcagaacaacatgaggaagaattttgagaaatgtggtgttaaaattataacagacaggggttgtggtgttaaattttatagtgtgacaattagtttgggtatttcatattgccagattgtactttatttttgaatgcatattgggtaagtgtctccaggaactggttgagtaacataataattaacatttattaagcatttactgaaacacacaccatgctaagagctctactgccgcattaggtaacatcgtaactctcttagccattattatttccaccatttcaagatgatgaaactgggtctttcagagtttaaatgacttaacaaaggtcacacagccaataagtattcaaaccaaagaggctgattccagaggcaatgatttttaacaatgatgctctcttgaatgaattgaggtatgagaaaagagtagggagaacttcttggcatgcatatggtgacttggaaaaaaacataaatacttattcactatctgaagaagaaatgcaacaaattgcaggcagaataattctgaggtggctgatatcctctgatgggaggatgattatccttgattgacctgtaaatgtaagagctgagaacatcagatttagccaaaaagtaaaattcccaaaatcttggctatatatttctaatttcaaagtcttctacctgaattcaaacctaactaggaaatataatgtgtatcaaaggcacaagtgtttcaatagtgcataagaatagggctttctgaagaaagtgccagagattcaggttctacattttccacttcataaattttgtgtgtcgctttttcttgtccattcctttccatatggctgaggcgataaagggaatgttttgctaattcctgactcagtctcaatcaatttctgttttccaacttttccacactgatgcatccttgctatctcaaactcactatatccaaataagacatcatcttctttatcagccattgccatggccaaccgccaatttcctattcctgttgatgttttcaataagcagttagttatccagtctaggtttatggatgttaatagagttttcccttactctggtatgcatattccaatccagtctagttttccttgtaaatatctgcttagttgattgccttctttcatttaccattgcatttaccagcttagttcaaaacctcattttattttcccctgacccctggctttttccaaaacagtgtctttgttgagttcctttttccactctcactttcatatcatcttttcttccaaccagttcccaaagtgtggcctgaggaccaccaccagcagcagcagcaacatcacctaggaactcataagacatgcaatttcttgggccctacctgaattcggctgcatctgaaactgtttaacacaccctccaagtgagtctgatgcaggctaaggttggagaaccactaccccagagtgatgtattttaaatgcaaatatagacaggttacttctgtactcaaaatacttaagtaaggtccccattcccaggaaggaaagataatcaaacctctgtacatgtggttttccattgtcatcatacatttctgaactacttttttcacttcaccttttaccactttccaaaaaagaaaccctgcactcttatcataatgaatcctgcacttccttattgtgacaagtgttttcttttatgtttctgcaccacggattcttatgtctagaaagccacccctaccttgtgggtgaatgtaattcatcctttgaaactcagtctaggcaccatctcctctggggaggctttcctgagtccctcagaccgaagggagggttctactctagcacaacagaggtactgtcccaagaaactttgcctgaggggtagtcaacagctctccaattttacttcaagcctgcaaaatgtaagacacatgcaaaaatagacagcttagtgatccagagaacaggttcaagcctggctttactacctactatctgtgtgaccttaggctaattgctttatgttctttacagaaaataaatcaatctatgtcctagtacacaaattagaaaggtttggaatatttattataataattaatattaattttaataattcatggaaagctacctattgataacttacagtaaacaatattaattattattattcatgtaataatacataggtacagtctagttacacatgtgtaaaataaagataggctatggatacagattacataaagatatatgttaaaacagataagcattagaatacatgtaaataagacccaaatatagactaatcttaggtataaatctccattagatttctagagattattttgcctgaaagggaaggaaacctaagattcattttatttccccacatagtcttacaacttttatgcatttctatggctttggttattaaacatttttcaccagtcatattaaagcatattattttcattcttcctaataaaaaaatgagtaatctttttgctgtacattaaaaactatgtattgggtaacatgtataccataaacccatacaaatttattcctctttaaatgtgttatttgatatcacaggtttatataccatgatgtgggaagctttaagtaggttagaaatgtgctatagccactgagaagaagaattcaacatttaaatgagaatatcaatattataatcctagatacacataatttatgggagactcacttttgtttgatggatcggaggctcaattactgtaattctaatttataattaagtcttcaattacatgatgcttagatcttctcctatctgacacaaaatgcaaacaaataactagaaaaatataataccacataatttaattttaaaaatcaggttttattttcaactcagtaaatagtagcctaaaatactggcttaaaaaaaaaaaacttggagattagcctatcggaagtgatttttgtaagagggaagaataaaatactgtcttttccaactgttaataactgcagttcctctgactgtggtaccttaaggcaatttatcagtctgattcataaataaccacaaggcagaattttttgtgaactgaaagcaaaaacagggcaagtggtttattaaatatatatatatatatatatatctgcttttaaaatagatacttctaataatagatatttctaatacatatttatttaaccgtatctctcccttactggaatttaggtattaagccaattaatataaacagtttcaaggtaatcataataagctggcaagaaaacagatgatctatattcaaattcaagttcacacttctagaaaaaattggcataggattttcagctgaatattaagtattttatggtcatatattaattttggaagtaatagccttggaggaattagatagagctagggggagagatgagatcttaaatttaaaaaaaaacagcaattagcaacactatccaaaatcagatatgcaaaatttgtgaaaggaagtctaatttggaacctaagaaacatgcagaaaaattccctttgcattgctgttttctttgggaaagaaattcaccaagttctaaatcataataagttaatttcaaatttattttttattttttagttcagtttttgaaataagtgatgatcataatgttaacaagaaatagcaaaagaacatatgatttatctatttttcttctgggcagctccatttcaattgatgctaccaggattctattatgaataaatgtttataataccaaataatactattgaatggaaatgtaactgactgatatcagagcataaaatgcattgatgttatgttattcaagtaattgagactatagcataatgtaggagttgtagagcacagcatagagctggagatttagagtcgatcatagaacattctatagtcattaaatgttctacagacagtcttgttctccttttcatccactcaagctccccctccccaaaatacaactaaaataaagctttaaagtttataatattctttcatttactgggatcaatttagaatattttatatccttatctctcctttccttaatatttctaggacatatttttcattacttatacttcctcccaaatgtaactgacagcattcaaatgagccacaccaccaggtaagaatttcaaagtgcatacaatgctaagttccttggggttagtgcagtggcaaagtctggatatttcttttgtttgagagcaatcaaaacagacgatacagacagtccttacttggcacagtacagtgttaactgtctttaccttgcatggctccatgaaatcagttactataaagcagggacatggctcccctggttctggtatgtactggtttcagtaaacacagtacagtaccactcaaagcaagaatatagtggcattttaatggcagataaatcttcatccctttgcctccagcataccttaaactggattgtgaatcttgaatgcatagtgcagtggctatgtaacacaatattaaaattggaatctttctcaattttagctttggtccaaaggccaaaaataatgtggtgatgaccagtatttccatatccttaagcaaggagctacatcaagccatgtgaaaatattgtaaaacagattctgccagaattgataaacattgtctcttaatgagagcattattggcaaattaggcaggaaatttcttcatggaaagtatactgaatttgaatttcaggatttttcgcatctttacacttaggcaccaaagtctattcctgtctcactcctcaccctcccactcctcctcccccaacacacagaggtgactattcctgaggaccagatttgagctgcagagtgggcagtgcatcttaaagtgcttgacctaagaggactgctagaaaagtaaagcaacgtggcccatgggtaaactactaaattccattccatgtgaagagtatattaatttcctattgcttctgtaatgaatttccacaaattagtgacttaaaataacacaaatttattatttcacagatttgaaggttagaatctaaaaatcaaggtgttggcaggggctatgttccttctgcagacttcagaggagaatccatttccttgccttatccagcttttaaaggctgcatgcattttttggcttatggcctcttcctccatcttcaaagagcattatttcaatctctagttctatgttcacatctctttttctaacactaacccttttgcctccttcttataaggactcttacattggatgcacctagctaattcagaattctctctccatctcaagattcttaaccgacctaatgttctcacacccacaatgtcccaaaggtaacatagccacatgtcctgggatataagatgcagacattttgggggttccttatgcagcctaccacaaggggtaattaaaaatgtaagttagaacaggcttggcctgaatgtaagaataccttggattcaaaccaaattaaactttcttgaccagcccaggcaggagtgacctctccatccactgaacttccattatacttattttcatctatatattgcctgatattatcattctatgtgttttctttccacataaatcctaactctcttagcataggtttatccatacctctctatattctgtaatgtttcaataaatatgttgattcgagaaaaataaatggaaagacagtttcagtgggcagtttcctgtgtgtgggaggactctgccttaaagtatcctctttcagtacctgaaattccttttattatatactgctttctgttctgtggcattgaatgctcaggcacaatgacaagataacaccttattggaattagtcaccaatactaagtgaatcatttcaacagattttgcctgaacctccactgcaaactcattaggaggaagtatattaagttagtcattcttttattgtacagattgcatttgccaagtgtctttcacataagattaattcaacaaggacctattaatggataatagttagctaaaagcaaactttaattagctgtggaaaggagataagtaacttttgaccaggggaaacaccaagaaacagtatttagcaaggaagaaattgtccaaaagagaaagaagaaaaagataaattttattttataatattctttagaatgtctttggaaattgtgataggaagactctaaaatggttcctagtgatttctacctcctggtattcacacccttgtgtaatccccctctcttacatgtagatgtttaggcctagtaaaaatatggttaagtgttgggatgtcttcttgtctctcctgtgattaggttactatagactgactttctctcttcctctctctctctctctgacacacacacacatacacaaacacagacacacacacacacacacacacacaaaacctgtctgggggaagttgccacactgtacagcttatgggaagatcaaggtagcaagaaactgatgtctcatgccaaccactagccaggaaaggaagcttgccaagctcaggttaagtgaattcagaagttgctcctcccacagtttgagcctgagctgatgtcagccctagctgatactttgattgcagccttgtgagagatctggagtctgaggacccagctaaaccgtgccaaattcctacccacagatattatgaaataatataaattgttttaagccagtaagtgttcaggtaattatttacacaggaataaataactaattttagagtcaatattcatatatttctaatctgttattgagttttctatgttcaccatacaagtgctcattataaaataaaaatattttacaggttgaatctttttagaccaatgaatccataaaagaaataagcaattttcttcctctggattttatggtctggtattataattctaattacacttcgaaaagcaaagcgatgttagaaaaacaataataaatgatcattcaattgattgatgttgacaactatcaatatgaatcataaaattgtacacataacttgtactgtatctgcttccacacatattttcatagtattggtcaattttgaatgtataacaatcattaaatttctaagaaaaacatttttgtggtgataaattctaggtggagttttgataccctaaagccatataactatcaataaagatataaaattctatgacgaaaaagcagttatttttaattatttataaatagcttggcctagttgacaataatgtttaaaaagcaactaatttttagttgctgaatatatcatcacagtagatgatttatacttttttaaacctgaaatactttctaacataagtactccttagtcaatatctctgaccacataatgaaaatatctatccaactcatttttacctagtgttttggaataaatgaggcagtttaagtctcttttcaggaagcattataaagtgtataagagataatatgatatagtcttatatatcataaggttagatgtttgtccccacccaaatctcatgtcgaattttaatccccagtgttggaggtggggtctggtgggtggtgtttggatcatgggggcagatccctcataactcggtgatgtcttggtaatagtgagttctcatgagatctgctcatcaaagagtgtgtggaacctcccctctaactttcttttggttgctcctgctttcaccgtgtgatgtccctgttcccccttcacttcccaccatgactgaaagctctctgaggcttctccagaagccaagcagatgcccacaccatgctccttgtaaagcctgcagaactgtaagccaatttaaattacccagtctcatatatttctttgtagcaatgcaagaatggcctaatacagaaaattggtaccaggagtttggggcactgctataaaaatacctaaaaatgtggaagtgactgtgtaactgggtaacgggcagaggttggaagagtttggagggctcagaagaatacaaagagataagggaaagtttggaacttcttagagactggttaaatggctgtgactaaaatgctaatagtaatatggatggtaaggtccaggtgtcaaggtcttagatggaaatgaggaacttacaggaactggagcaaagtttacacatgttatgccttagcaaagatcttggctgcattctgttcctactatagggatctgtggaagtttaaactaaagagtgatgattagggtatttgatgaaagaaatttctaattaacaaagtgttcaagatgtggtctggctacttttaatagcctatgttcagatacaggggcaaaaaaaaatgacctaagattggaatttatgtttaaaaaaacaatgcataaagtttggaaaatccataccctggccatgtgatagagaaagaaaagagtttttatttttccaggagagaaattcaaggaggctgaagagcaaccacttgctagagaaatttgcataactaaaagggacccaagtgctgatagccaagacaatggaaaaaggcctcaaaagcatttcagaaaactgtgtggcagcccctcacatccatcacaggcctggagacctaggaagaaagaatggtttcatgggccagacctggggccaccactgtcctgtgcagccttcttggcatcctggttgctcctgctccagccttggatcaaagggttccagatactgctagtgctgccagatactgatagtgcaaaagccactgaaagccttggtggcttccatgtggtgttaagcctgtaggtgtacagagtacaggagtgaatgaggtttggtgctatctgcctagattgcagaggatgtattgaatagcctcagtgcccaggcaaaagcctgctgcaggggcagagtccccacagagagcctctcctagggaagctccaatgggaaaagttggattggagcccccacacaggttccccatgagggcactgcatagtgaagctatgagagagaggctaccaccctccagatcagagaactgtagatccaccagcagcttgcaacctgtgcctggagaagccacaggcattcaacaacctgtgagagcagcctggtgcttaactttgcaaagacacagaagtggagctttccaaggccttgggagtccaccccttgcaccagtttgccctggatatgggatacggaataaagattatttgggagctttaaaatttaatgactatcctctttggtttcataattgcatgaggtctacagcccctttcttttggctaatttctccttattggagtatgtttgcctaatgcctataactgcattgaatcttggaaataactaatttgttttttatttttcaggctcataggtggaagggaattgctttatctctgctgagactttgaacttttgagtttacactggaattagttaaaaatttgagggacttttgagaaggcatgattgtattttgcaatgtgagaaggacatgagatttgggaggggccagcagtaaaatgatatagtttgaatatttgtccccaccctacttttatgtggaattgtagtcccagtgctgaagatagggcctggtggaaggtgtctggatcataggagcatatccttcatggcttgatggtgtctttgtggtagtaagctcttgcgagatctggtcatttaaaatgtggcacctccctatcccctcttgcttgctcctacttttgccatgtgatatgcctgttcccccttcaccttctgccatgattgaaagctccctgaggcttcttcagaagccaagcaaatgccagcaccatgcttcctgtaaaacctacaaaactgtgagccaattaaactttttttctttgtaaattacccagccaggtatttctttgcagcaatgcaaaaatggcctaatacaagatactttttaaaaaaacaatataaattatttcccttttcataagcatttgcaaatgattcagccttactctgttcagaaaaacaccagccaaaaaataaaaatatagtttcattagcaaacttttctgctcaaatgatcatctctatacagcaattgtttttggcttcttctgaatgtttttgcactttatatttcccaactctggtttcctttggcaattccctgacctcatttcttaattctcagtgctatgttatataattgtctgaataagcagtatccccccaaaatgagacaaatttattgagaattttgcaatcagaaaatcagcaaaaaggctaatttaatattaacatattgtgatttttgtgtggtgtaattgagtgttggtattaatacaagagctttaggcctaggatgcctggatttgaatattggctctgacactgtacagatgtgtaaccttgggctagttacttaagagttttgtgttttaatttcccacatataaaacttacgtaacaatagtacctgcctctgatgattcttgggaaggtaaatgtgtacacacagcaaatgcaaataagggttaagtggcagtagcacaaatagcaatagtagcagcagtagtagacagtgaaatactgacttgatgtgctttgtttaaattttgatttgcacattggcaggaggataaatctggtcttgtcaattcctctactgggtctgtggctgcaggctcttaactctcatcatccagtcatgaagaatgtggtagcataatttcatcaggaagtattgggacccagtgaagggtgaggaaaaagactgacatattgcatatttgcatatttaaaccttgcatatttaatttacacacttatgaaggaacctagtcttgcttatgaagcaaagacataagccaagtttaacaaatctgacaatatttttacagatcgaatggggacctcattgaacagggtctcttatactcatcctgtgcataatggcctcagcgaaactttttctttattaaacatactgctatgttttcagttgttcatactttgcttttgattgagcagtttattaagatatgtgatgaattcttcacccagtaaaggaattaaagattatttgacacttccttggtgataggcagaaaataagttaacctattaaaatgcaatccaattagtcttgacctatatgatcccccgctactagatgaaaagatattctctgatccttaaaccttatgcacttgaaaagaaatagagtcctaccttttgaccttaatttcttttctcttgagaaataggtttttttgacatgtgaagttagagaatattaatcttaaactcaggtttgttatgagtctagaagcttctttgtcattgttgaaatgaatcatagacagacaatgcctaatgagagaaatggcaggattactagaaaatgtagatctccctgaatttctaaattttgcttaattaatatgtttaaaatgtataatgaattaagcataaaaagtaaaacatctttcccattctctttcaattgaaaggaattatcagaaagtgtatacactccaagtgacatatttctcagtaaatcttttttaggccctttaggctattctgattcattaaatgtcacacagtatgagaaattacataaattatgatacattatttaaaaacttatttagagactaaaattaagtattctatttataattcttttcctttgcaataactatcagctcagactggataagtatatctaattaatctgaggaaggaaaggggaaaaagccatggaaattaagtaagtcacatttaagattattaaagttttataagccacttcagctaaaaaatctatacaggaatatgtcaaactatttgatttagatttacattattcagagcaagacaattcaaattctttagtaataacattcgtccagaaactacaagatagcatagttttccttagtaaactgaaaatcaatcagtagaaaaacttttccaaaatgttacaaatgctcccatatgtctgtctccttcactatttagaacatttcctctagaccaagactttgctttgttcactggtctatttccaggcacctggatcaatcagtgtctgcatatgataggctctctctcaataagtagagttgaatgcctagatgaatatactatttcaattcaagtcaggctagaatgatcaatcaaggaaatatccaacattaatttttaagaaaacaaactagatatcatgtttggaacctgaatgcagtaatactatagccaatgtgataagaataatcctatacagacacatttgttgagcaatatttttaaagaagccacttaaaatgtagtaatataaatgtcaccatggatataagtattcaagaacagaaacattaaggtgacaaaagtaaagattccaagacttactctgagaatttctgattcgataggccaggagttgaaaaactttgtttctaagaaagaagatttattcatgtagaattgctatgagttgaatgtcccctccaaaactcatgttgaaatgtaattaccattgtgatggtgttaagaggtgggacccttatgaggtagtaaaaccatgagggttttgtcctcataaatgaattagtgctgttattgcagaagcaagtttctgataaaagtgagtttagccccctcatgctctcactcttaaacatgctttcttgcccttctaccttccaccatgagatgacacagcaagaaggccctagccagatgaggaccccttgactttggatttcctagcctccagaactgtaaaaaataaatttcccttatttataaattagcctgtgttatgctgttatcacagcacaaaatgaacttaagagaagaatggttgtgaataaagagccagaggaaagaacatgaagaattagaagtgtcaggaaataaatattttgtttatcatttgaagtaaaccctttgttgcaaatgagtttgcatatattttggccattccctatgcctgtggaagaagggtaggtatgagatgcacagtttagaagtgttactaatttcaacctatctagtcctttatacacacacacacacacacaccacaaacacacacatctagtggaaacaaaaaggttcattgatttttctcctttaaagtagtggttttgagtagactgtatatgagttatctattgtatgttccatgacaattaacatttgttgtaataaaatgcattttagcaaaacagactttattataagcgttggtagagctaagatttttactatctatgagtagctttgaaagcagacatttctactaactcagaaaagccttagatcacatatttcactatcaagtaatatgcagaattaggccatgcatctattataaaaccacagaaaaattttagaaataaaacattataggattaaagaaattgtaagaaattactaaaggagatatagagagtatagcacatttcatgtgatctactcatgtcctcaaacattagtaaaagataaaacaagatgactttaatggtgacttaaaattgatttgtttctataggggtttaaaagtttgatagtgttgagtaaagactttactctggtaaacattataccaaattattttgataaatatattaatacatcaaaagcatttttaaattttcatgatttcaatattgtacaatttttgcagagatatttgcttcttagtataaaggttttttcaccatttatcataaaaattttatgtaaccaaaattatgtagtggtaaaattgctttcttcatagtcatagtaatattataagctcttattgaagacatataaacataaaataataatatcctctctaaaacaaaaaaaaaatagcttctttcttgactatttgaattatatttaggttagttaagtataatctaaatgaaagaaaaaacaaattattgcattctaagattatgccataaacctaaatgtttgcttttagtggatttcatcaccatggttgatctctatcatataatattaagcaatttcaattattctctctgaatacacatgtcttaaccctgaatcatcctccaagtatcttcctatctctctagtccatgtagaactaaaagagtaatacacatttatctttctccatatctaacttattcaattcctaacctgtctctgcatccacatttctattgaatcttattttgccaagagtaaaataaccttaatatattgctaaataaaattcttactggatgttcatagtacataatatagttgactcttcaatccttgaaattttaacccatgaaacttgtcttcatctttcatgaaaatattggactttcccatatcctatgaccatttgtcttcatactgcttcatggatgcctcttcacctgagctcccctgaaatggtggtgttcttcagtttaatccttgaccatatatcttcatactctgtaatccttttggatgatctcatccattcacagagtcataatcactagcaatgatatatactgatgatggctaaacctttatctcttctagtgtttattttcactgagacacataaaatataatgttatatataaaatatgtaaatgaaaatatttttaaattagttactaatcaaatgcagagttctacaactgtatgtctacagctttcaaattaaaaaacaaaacttaaaattcccattctcatgctttataaagatttttgtctaccaaatataaaatctgtcataacatgcagaaaattaaatgatgaattataagaataaaatatggaacctggaaaccctctctgaccagaataggtttggtttttgttttgttttaacaaattccaaagcatatggttctgggaaatgtgtttccaaacaattttctagcattatttaaagattactagttccacttctggcattgtgcactatgtctgaatttatacattgactgcatacagtgtttagaaggataaaaaaataaaatgataaccaaaaattatcacagaaatattccagagaacagttaccaaaaaagactatggagaaaacaaaaaccaaaataactaacatcggttggatatacatattgattagttggatataaataaatcagttggttataaaattgagtgaaaataaaaattttgtgtggagataaactttactaagaatgctcatagtttaaatttcttttatttatatactataaaaattatttttaatgtcactgacaagttgcacccaaatttggattaaaaggtttggaagataaagaagaaacaaaccatggagaagtgagtaaattcggtaagaactttgaataagtaaaggtatacaagattttaagactgacagcttgggttccagaatgaaacggcttccttctgcacatacaggttatatggcaaattagcctctgtgaactgcattttctcatctgtgagatgcaggccatcatggtgcacaatacaaaggattgttggaaagattaaatgaaatgttacagtgcttgacatttagtcatcattcagcaaatgtcacctataactaagtgtagctgctgtaactgctgctattactgctcattacaggtgggaagttgacctgctgcctccatattagggctggggtcaaactgattcatgcatttagagagagttatgagggtaccatcttgaagaaaccacacaatgttggaacactgttaatacatccatccacataattttgatccctgagacaagaagaatttatggggttagaggcagtagaatttaggggttagagcctgggctttgtgtcaggctacttgggctcaaatcacggctctgaaactttctaaatgcattatcttaattaagttatgtaacctctttatttatctgtaaaatgaagataaaaattataactgactaaatgggttgtgaaatttaaaaagcacattttatataaatcactagatagtttatgagacatagtgctcaataaataaatatcaatcagtgcctaatattctactattctttctgtcagtatgttgtaaaaaatagtaatacagttctccattaaaactatacaaataaagcttattatttgtgtttcatttcgtcagtcacacaactgttctgatgaaccccgaactgaactctttgtctcatttaaatcaacccataagagtaaactatacactttatgggaagactaaaaaaaaaaaaaaaaaaaaagtaagaagaaagtggctgcaacttagatttacaagatttaagtaagtgaggaaagagaaagagaaacaacaggaagctgaagactggaaaaagtgagagaaaatgtgggatgtaagctggcatttcttatcacttgctcctagcagctggctgctggagaggagtaagaaaaacagggcagccagcaaacacccagggcataagttctcattctgagacctacccccaccatcaatgacactgtggctgcttgtatctagtgccacagcacagattatgctgatgtagttccacacatgcatcccttcagtacacaaatgtgttgtagcacttcccagtctaaatgtgtcttttcttggtccattttctttccccagttactataaatttttctattgccattgactgccaaatttttaatgttgtcttcactagtttctccactatattacccacttcgctctgacctagctttaaatcccatcactccagtgaaatcaatcttgtctatatcaccaaattattttaatccacttcattaaatgtcagtagcaattactgaagttgtctacactctatttgtcaaaacagtggcgttgatgatcacagtaaggattgtgggttttaattaaaatgtacagaaagccactgaaaggattttggcaggggaagcctccaatgacactaggctctttgggctttattcttacttctctggtttctccttgtcaaacaaaattctaaattccagttgttatagactaaatgctgtgtgccctaaaaattcatattttgaacccctaaatcccaatgcgatcatattagaagacagagtgttttggaggtaattaggtttagatatgattatgagggtgaagcccctattatcaaactagtgcccatataaaacaggaaagtggcactggagcttcttccctcccccgtgtgaggacacaccaagaaggcaactatctgcaagccagaaagagagcttttaccaagaaccaaatctaccagcctttaatcttggacttcccagcctctagaattatgagcaacaaatgtctgttgtttaagccacctggtctgtggtattttgttacagcagcacaagtagactaagacgccggtgttccccagagttcagtccacagacctcttctcttttttctctacacttcttcttgaggggtttctacccagtttcataaccttattaaaggctacttactgtcaatgagtttcatatttgtacttttgcaaattctcctctgagctacagatttttatagcaatctgtttatcagacatcttattagacatctcacagacacctcatactaaataagtttaaaatttctcttttttacagccccaattttttctccttcttagacttctctatctgaaaaaatcattccaacaaaaccagaaaaactgctagtcatccttgatttttattcttcctcaatccccaagtcctatcccttaagtagtcctatcaatccaatgtacagaatccaatgtatagcatcttcttttcatcactactgctgctcaactgtaccaacccactaacttgtaacagaaaaactaaaatatgtccctcactgttatcacattcaccctcttgccctccttctccacttgcttcagcagacttctctgctagtatggatcatgcccttcattactccatacttttgaaataaagcccaatttccttattgtggcctaaaaatcccaccataatcccgtgccttggctacacctcacctccacctcacctcactcatggctctgacgagctcactgagtccctagatgcaccgagcatcttcctaatgccactgtgtaccaagctgtgtcttacatatgatactctttctctctggaacgctctttcttctgctcttcgtaaggcaattgtttattaatccttcagacctcagcttaaatgttgcctactcacagagtccttgttcacttcaagtatcttgatttgacttattattctattcctcaaccatttgttccttcattgaattaagataaaattattttatacctatttgttgtttacctgtttgttgtttgtatttctgctaacacaaataacacagacataggatcttgtctcttgtattcactaagggatgcttagttctagtacatttcctggactttgcagcactcaatatgtgaaatgaatgaactcaagaatgaaagagacattcaatgtacacttaaatagtgaagtagggtgtgcaaattataacattaaacaggttaaactgtgttgttgtgtagtagagtttcaatattaaacataattgtcatccaaaaatattatagctcaattaacaagtatttattgaacccagtacctattctgtgcccaaaatactgcctggtgttatgaagaaggttgagtaaaaaataaaatggtcactgattttaaaggttataatattttagaggagctaaggtataaacacacaaaacaacttgaaaaggatatataaaatgacttcatgatgagaaaaacacctgtgaaatatgtaataaaacttaatgatagcaaatgaaacttgtctttgatgggagtgacctcaaacacccaaggcccttcagaaagggagcatcaatgagaacagataaaataaaagacaagtgcagacttcactaaaataggaaaattaaattacccatatacttgcacatacaaggttcatttgccttgggaagttttaatacccacaattctgaatttttctataagttatattaaaaagccaagggacattacttgaggatagcaacttaaatataatatataaatatttattaagaacctatcttgtgggctgggcacggtggctcatacctgtaatcccagcactttgggaggccgaggcaggtggatcacctgaggtcaggagtttgagaccagcctgaccaacatggtgaaatcctgtctctactaaaaatacaaaaattagctgggcatggtggcacatgcctgtaatcccagctacttgggaggcggaggcaggagagtcatttgaacctgggaggcagaggttgcagtgagccaagattgtgtcattgcactccaacctgggcaacaagagtgaaactctgtctaaaaaaaaaaaaaaaaaaaaaaaaaaaagaacccatcttctgtccagcctctacctggtgtattgttacaaaaatgaaagatacggccgggcgcagtggctcactcctataatcccagcagtttgggaggccgaggcgggcagatcacgaggtcaggagatcgagactatcctatcctggccaacacggtgaaaccccatctctactaaagaatacaaaaaaattagctgggcttggtggtgggcgcctgtaatcccagctacagaggaggctgaggcaggagaatggcatgaacctgggaggcggagcttgcagtgagctgagattgcaccactgcactccagcctggggtgacagaacaagactaggtctcaaaaaaaaaaaaaaaaaagaaaagaaaagaaaaggaagatacagtacctactcacagagtgtccatagtccagttggagggagaaggaaggaagataatcctatgaacctcaaatcaatatacattgcaacaggtggtatgtaaaagatacaagcacaatatctcagtgaattaatacaatagattcttggggagtaaagattttctccacacagagccaaagacccttactgaaaggtaaaaatgcaaaaactcaaaccaaacaaggtgattcagttgattattttgtcatgatgcatgactgtctcatcagccagttgaattttccactgtagtaatcatttttactgaaaaataggttctcttttgtagaaactgtagtttataggaaatcatttgagtcacacattaagtcatgttctaaagtttcagtgtccaattcagcagctactagtcacagataggtatttagcacttgaaatgtggctatttgccacgtgttaaaatgatattttggatatattgatttaaacaaaaatatactattaaaagtatttttttatttatttttcttatttcaaaatgggacttttcaaaaatttgaaactgcatgtgtatctcacattgtatttctactgggcaatgctgctctaaaaagtttatgaaacaagttaatactatttttcaggaataggatgggaccaacttagaagattagacattgtccaatacggagtttgcaaaattctttctaaaacaatatgtaatataaataaggaagcataaaagtttaacactatgtactgcataagtattgtcttatccatgtgggaaagcactgagcacttttaaaaatatggttccatctagggaggctatattacatattttcaattaaatttgaaatgcatttacagtattgtgctactgtagcagagaacttcataactatctttactgttacttttatgaagctatttattgtgctacttttgttgcttccacaaccttaaaaattatacaaaaatgcatatattttttatttatgtataatactttccatttgaattcattgatttctaatagaacttttttataagttaaagctaaagagaaaagtctaaataaacatcaggtagaaatgtatagtaatacccggccgtgtgaggtgtcagtctgcccctaccggggggtgcctcccagttaggctgctcaggggtcaggggtcagggacccacttgaagaggcagcccgcatagccaagacaatcctaagccaaaagaacaaagctggaggcatcctgacttcaaactatactacaaggctacagtaaccaaaacagcatggtactggtaccaaaacagagatacagatcaatggaacagaacagagccctcagaaataacaccgcatatctacaactatctgatctttgacaaacttgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaatcataaaaaccctagaaaaaaacctaggcattaccattcaggacataggcacgggaaaggacttcatgtctaaaacaccaaaagcaatggcaacaaaagccaaaattgacaaatgggatctaattaaactaaagagtttctgcacagcaaaagaaactaccatcagagtgaacaggcaacccacaaaatgggagaaaattttcacaacctactcatctgacaaagggctaatatccagaatctacaatgaactcaaacaaatttacaagaaaaaaacaaacaaccccatcaaaaagtgggcgaaggacatgaacagtcacttctcagaagaagacatttatgcagccaaaaaacacatgaaaaaatgctcaccatcactggccatcagagcaatgcaaatcaaagccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccgtttgacccagccatcccattactgggtatatacccaaaggactataaatcatgctgctataaagacacatgcacacgtatgtttattgcggcactattcacaatagcaaagacttggaaccaatccaaatatccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacatcacatattctcactcataggtgggaattgaacaatgacaacacatggacgcaggaaggggaacatcacactctggggactgttgtggggtggggggaggggggagggatagcattgggagatatacctaatgctagatgacgagttagtgggtgcagcgcaccagcatgtcacatgtatacatatgtaactaacctgcatattgtgcacatgtaccctaaaacttaaagtataataataaaaaaacaaaaaaaatggaaatttaacaaaatagaaaaaaaaagaaatgtatagtaataatatacattgtgtttatttttatgtttttaattggaagaaaaattttaaaaacagagggtggtatataatttaaaaccaaattgaaaatggcttcagatgttcagcatctatttgtaaaccaaactaaagatatggagactcatccaccaattattgtaaaattttaaagaatgaaattagaatttacttttaacttagtgaacctcatgcaaaaagttttcttaagttattttgaaaaaaaagtattacttgtaaaagaattataactgagatttatgtagctgagttaacatgaagcaatagtgacatgcaatagcattaaactaagtggatagttacactagttctgtgaagtgtcttaaaactgattgttactatctactttgtttagggaatctctgttaatataagagactcagtttacaaccttcttcaaatgattaggaataacacagctgttaaaatgcatgagattacactgtaatagcattctttacctaataacaaatcaggccacaaatactaatgaacataatcactgggcccttaatggaagatgtctgctaattttgaaagctttacaattagctgtgattcaatgaacctgaatccatgttaaattaaactgttagggaagacaaaacagtgttgtttcaggcaggcaatgctaaaggttctaactgaattttctcaaggcaaggtaattttaaagataaaattgttctcttcttttgttactgtaaaagtgaagctctgcttcatttataaattgtactcagattaaaaacccccttttattttattttttaaattaataacctaccagagccatcggactgccaatgtttcaaaccttctctctcatctttcttattgttcaggttcctcacatagggcttctttctgcccagctctgcaagcctattccagccttagaatccttacccttgctgttccctcttcctagaaggctctgctccttgctcctctcataaatggctccttttcatttaagtctcagttcaaagacagcattccagagttttcttttaaagtgctcaccacttcccctaatgtaggaagggaattattcctttctttttgtcagatccatcatcaaattttgatttattttgttaatttttttgcttgtttattgttggattttccattatggaaactacactccatgagagcataaaccattatttagataataactgccataaacaaactaccattaacaaatggttggtacacacacacacacgcatgcataccacacatacacacacacatagactcacaaataaatatatttgtaaatatgtcatatatattttacaaagttaatttttttgctatttgctagcaaggttttttctattaaaaatatattatgagagctttcaaagtcaataagcagatccctgtagcaaatttataacagctatagggtgttccaccatttcagtacactagattatcaaatctcctgtgttgaatacttatattagcaccatacttttttactactataaatagtagtttgtctcttattttttaaatagatatttttcacttgcctgattgttttctcaggataaatccctgtaaattaaattgctaaataaataagaatatacatattttaaattatggctcatattgccatactgtcttcccaaaatattttaccagtttcttcttaaataaacattatataaatcttggccatattgaaattatgaatacttgccaattcaataggggataatatataatttcttttttaataaattatggcctttgcctattcttctactggaaagtttattttttgttgatttctaagatctattcacatattaagactttaatatctatagtaaaattactctcagttataaatacttttccaatatttatatgtattttatatatcttggggcatatatctttagttgctttacagtaaaatctgttttcccttcaggatttttgagtttagtattaactttaaaaatgggcaccttccacccaagactatgaaaattgcacactctctctcacacacacacacatacacacacacaatgtacatctaatacttatcacacatgtacatgctatatattgtatttataaaatattttatatttccaaaaactgttgtaatgttttagatttaaatatttaatcaagaagttttaaattttgtttaatcaacatgtaataattacagtgacatgtaaatgatgtacagtataatacatgcaggtataaatatagtttgagtatttcttatctgaaatgcttaaaatcagaagtgtttcagattgagtattttttaggattttggaatatttacatatacataatgagatatctgtgatcagcacccaagtctaaacacaaaattcatttatgtttcatatacatcttatacacatagaactgagatattttcatataatattttaaataattttatgcatgaaacaaagttttgactgtgttttgactgcaacctgtcacatgaggtcaggtatggaatttttcacttgtgacatcagtcagcactcaaaaagttttgggtgttggagcatttgggatttcagaattgcacattagctatgctcaatctgtatgtatatccacctgaattttctttaaacactactaaggttttgctacttagaagtaaaatctttggtcaagcacagtgcctcacacctgaaatcccagctctttgggaggccgagaagagaaccacttgagcccaggagttcaagaccagcttggaaacatagagagacctcttcaccattaaaaatcaaaaacattagccaggtgtggtacacatctgtggtcccagtgacttgggaggctgaggtgggaggattgcttgcacccaggaatttgaggctgcaataagccatgattgcaccactgcactctgccctggacaacagagtgagattctgtctcaaaaaataaaaataaaaagaatatgaaatattcaaccaacatataattaattgttatgggagctataaatagaaagtattatctctctcaattggctttgatcattataaacacacacatacacatagaaacacacacatccaccgtttaacccacagaaatgaaatgccaagattttcatgcattgtaaatccccatataaactaaactatatgaactaattatagaatactatctatctatttatctatctatctatgtagtcatttctagattctctattatctcctattgtttcttcattgatcccagtataattattgtgctatagtaataacacctgtatacctggtggtgggcaattctacacttaccattcagaattgtcccatttccacatagtttttgtttgtgaatgaatacaaataagaatggttttctacttaatacttgcctattagtgccaacatcagcttgactctactaaaaggcacacaagtgtatctttccgtctctgtggtgaagcttctcttttgggatgggctatacttacatttttttttttttaattaggaggaatatttccaaatgtccttcagcaagccagtatggtaccttatcagtgccccaatgcaaagctccaaagcaaacaaaggaaaactctactgtaagtgctcaaataaccatttcttatacttctgatacaatgaaaaaaaaaatttcttcaaaatttttcagttgcatgagaaaataataattcaacattgtgcaaaagaagattatattagaatattttacaaaagtcattctcatacgttttatacttacagatatattatatttttaaaacattattttaaaggagaattaacatcaattatactaatatgttctgtgtaaaacaacttagcaccacttttttaaaaaggcattaattcaataactactatgctggttgaaagaaaaagcaaaatttgagtttcacataacattggtctcattttcatcctgaattttaaacaaaagtctataaacaagattagagaaatcgttttataaatttgaatgttgagatttatataaatatgccattataagagtttgatacaaagtacttaatattttctattgatatgttccaaagagaacctcacaaagaatattttttctgtatggcaggaaaaatgctaaaatcccttaattgcaaatgtgaatttcccagctgacattaattttggtttataaggatgcacattaaaagcagtgttgcctaagctcctaaatataaacttagagtaagagtttagtaataagtatcagttatagaggctatgtgtataggttgcattttagaattccttggtgtttttagtcatgactaatgaacagcccactctcaaatatattctgaaggtagatagtttgaaacatcgtgatttaacaggtgccttactgggtgactcagccccttcactctgactctaacaataacataaaaggatttttttttttaagtgggacatcacttttttttttttaatcaagcacaaaaaaagactcttacgctttcaattgtgctgtctttaacttggattatggaactgccacctcgtcagttctcaagttctctttaaatgttctgatattttcaaccacatctccaagagaagtgatggtgtgactagagtctcactaaataatgaaagcttgctttattttataagttaactgttctaaaggcaagggctggagcctacatctcaaagtctaaaatgtcacgattaacttttttcattttctttgtcttctttgctcataatacaattaaatattatgccaaatttttacctgtgtgatacatagccatgattaatatttttgaaatgattttaatactttagtacaaaattattagaaaatatgataaataataatacagcttttttgggggggtctgattgaatgctaagagctttaagcacattaatttaattaagcttcaaagcaaacttatgaggctggtactatttgtattcctctttgacatatgagaaaattgacacaccaaaaaattaagacacttgcccaaggccacccagctaagagtaacaaaattgggactcaaagtcaggaagactgcttttgctatatactctggaagagtatgatctctagttagatacaaagtgcttaataatttctattgataggtctcaaagagaaccttacaaataatgttgtttctgtatatgaaaaaatgctttagtacctttaattaactaatactcttctacagcttccatagtctgcaattatggcagggtcataatgaaaataaaagagacaccatttcctttacccagcaatgccaattcctacagttatacagcaaccccaattcaatcactcctagttctggaagtcccagtgtgctagtggtgtctcataggcttgctaatgtaggtatcctatagcatattgttcaggtcactgctatgaagtttattgctgtctaattttactcttgggttaacctgattcactcatcaaaaaaattgattgtgtctgtaactattcccatcattgagaaaatagtggagaacaaaactaaatccttgttcttataaagcttatattctagagaaatgtgaacagtgacaatttgtctgttagtaataaatgctgttgatgaaaaagtcgaagatagaggatatcattttatgcagaatggtaggggtaggtctcaataataagatgacatttggaacaaagaccttaatgaaatgaggaacgatctgtgaagatcactggaagaagactattttaggaagagttctgaggaccatccaggggaccagcgtaattggagaaaagaaaacaaagaggtaagtagtatgtggtcagagagagagaggtggtcagaccaaatggtaaatatgtatagaagcataaatatgtccttatatacatataataagtagatacattcatacacactttcatgcattcaattctatgtattgaaggtagagcaaagatgattaagtgctggctgatatattttgggggagaaagaaaattaaatctaggatgacttcgaaattctggcctaagcaactaaaagaatgggatctattacaaaggtatgaaaggcagctgagtgagcaatttcttagaaggtgaatgagaattaggtattcaagttataaacattttaggcttgatattcctatttaatgtcaaaggaagatattaaacaaccagttgccaatgtgagtcttccttgaggaggaataaaacatctagggttgccacgttgtgaattatattgaatgccctcgaatagataagcacaccctcagagtggttatagaaagaaaaggcagaagaccagccttggatatgttgatattttgaagctgggaagatatgaaagtggttattttgttagactctgaagaaatagagggtctgagtatccttcagacaatatcccataatatgttttgcaaaaacagttttcataaaacatatgtggttgatttcatggagatattgtactttaattacaactgtggtaagaccctttgactttagcaatgaaccaaaatgaatataagggtattcttttatgcaaataaaagctctatttatgaggacatatatgttaatgcttgataggaattgctctagcagcacatgtcagctcttaacatttcgaggaggtagtggtagaggatttgatatataattatctgtaaatagtcaatgggtgttaatgaagtggaaagtttgttccaaactccctatgtcattcttcttcatattaaactggcagacaagaggaggtcaaattgttaaagaaatagatgtactccttggtcctaattttacaagatggcacaagaaccctggaacatacattcaaatttctcaatatacagagtacaaaatagaaataacacaatttgtacataggattctagtcctaggaatactctttgtacatttggtaagactgtgtgaactgtttatcttcattcacttcttttcccatttattaatcttaagagaatttaattatatcaatagctgaatctactacatgttaatacatattaatagcgaaatcggtatgtgttcttaaatttgtgcttgtgctctatggtttgtatacagaataatttattttttaagtaggagattgcaaataaaattacattttctcagatgatatcagattaagcctcaggtgaagaaaagctactggatatgagcaggttaggatatggtcaagctttacgtgctttttctcagcttttttcccccagtaagattaaggtgatgtccataacaatggtcagaggaatacatttgctctcagtttccatgaatataaactttaatgcttgggtgaataatgagaaatatatttgtaattttagaatgttttgcaagctgcatgtataaaactttgtcaaggaaatctatatcacataaaacaatcgtacaatcacgataaaagtatattcccatgaaatttagaaaagctaatggcattatgctcccttgatttcatattatcttgtcttttttactattaaaaattaaataattaaaatcaaatttggactattattgtgaacacaattatagtttcttacaaatgactgaccttaataaacaatttttttaaattttaactcacagttcaattaaaaactttaattagaactggaataaatttattaaattttctgtaacaaatatttaatatatttattgagtaaataaattaataacatgtaatattcatatagtttcagaaatactttgttttaatattaataggtaagatcataactagtaataatggctaattgttcatttattaccattaagtttatatttatctacatataatgtagaataacaatttttataagtattaaattataatctaaatacataaagtttgttctagaatgtgaaccaaagctacaaaattaattttactgatttcatccactgtattgccttattttctatgtgaacaaagagctggatcagcaaaacatttggatgagttgtagtttgtgttgccaaagaagagcatagagctaattagcctatataggaaataagctcatgcttttcaactctttagaactatagtctaaatactgagatagtaaaattgccaaacagtccataaaatttgcatgacatttatttaaaatatcaagtataatccatggtgattgagattctatttctcacccagaagttcttcaactagatagtaaaatacttggaaagtaccaacacacacacacacacacacacacaagcacacacatagggcgttctcttcacactgtcggtggaaaacacgaaagcaaaaataaatgcctaaaaatgcatgttagaagtgatgctttaaacgtagttttgttactggacttacacctgtgaagtcagaaaaacttcttggaagcttttgttacattttcatgtatttcactttttaaaattattacttctgttagcagatttgtgctaaaaatgtcttcctaggtaagacagcaaatgtgctcagaaagaggtgcgaatgctttggataaataaatgttaccagctagacaagcagcagctggtaaccagaaaaaaggaagttcccaccaggaaagaaaaaagatttttctgaatagaataagtcagaaaaaaaaaatgacaaggtatggcatcataggccttgttgaactaaagacatttcatgatctgaagtaatgtaattgtaagaatccatgagatagtgggacaacatgggagtttaatctggggtcagcaagctttttctgtagtgggccagatagcaaatattttagtctatgtaggctacatactctctgttgcaactattcaaatttgcttttgtaccaagaaagcagtcatacacattatataaatgaatgattatggctgagttccaatacaactttatggatgctgaaatttgcatttcatataattttgatgtggcatgaaacagtgttcttcttttgttcttttcaaccctttaaaaatgtaacaagtgttcttatcttatgggtgatgtccagatttggcccatagatcatagtttgctagcttcaggcctaaatcatcatagaactgcaggaaatccaacactggtggataataatagtacctttatattaatgagcctctttttaattgaattgtaagatgcttgcaagtgaagagggtaaaggtgctgggtgtacttattttcctttgttatttgtttatatgactatcttcacccagaagcataatgagagctcaaataaaccagtgtgctgctcttcctaaaatagttagggccttcaaaactaatatagtcattcaaaattacttaattgagcaccaatatatgccaggcactgtcctgggtgctaggaaaacaatagtgaatgaaagaaacaaattaacctcaagaagcttacctttcaggattgtgtcttaggacaagctccatgtaaggagaatctgagatgtggattcttgtatatgtgatgcaatggcaaagtgctctcaggaggaggggaatggggaagaaggacaaggcaaaacataaaaaaaaacctaaacaagaatatggacttagcttcagactaccgtcaaattgatcccatggagaaaatctgaagtagaaactgtaccacagttagctgtactctgaggcaagggggctggacttttgtactcctgtccctcactggagaggcacctcctatttggcctgagggtaatgcttccaagggagacaggaacattcctgagtggtcattagagagatctgggcataaaactaacatcatccactacagaagggtgacaaataataaatataaatattaaacatttttaatatgtcaggtagtgacatggctttgtggctagaggaagacagagaaagatataggtagagggattgattactcttttacatcaagtggccaaggaagtcctctgtgataatgtgaaatttcagaagagaactgaggaaactgagtcccagtcattcagttatctgagggaagaggagttttaaatcaagacagaactagccttagaatgttctagaatgtgtgagaagtgggatgtggctgaagtgttaaggatgagtggagaggtagaaactgaagctagatgaaaggggtcatgacagattacatagggccttgaagaacattgtaatgtgttcagcttttaccctaagaaacaaaagcaccaagtgctacaagtatgtgcattatacttgtagaacccagacgggctctcaaaaaccatctggtctaacttctcaattttagagatttgtacagtggaaaatctctttgaagataaaagacaaggatagagttctaaaatgtatggaaagtgacttcccatttaatacatttgaagaaaatgctgctataaatatttgaacagtttctacagattatgttcatttgtttaagtcctgaatcttaatgtcatcccatcaatggcaaaactgtgagaggatgagagacagctggctgatgcacagaggatgcatgctcactgtctgacgttggcttggcatttattctagctgtaatttcagcacgttgggaaagggaaatagtgataataatttcaagcaagtgagctgtattttctttacatgcagtggtcagctactgccaagatgactatagctccataaattgttatttccaccaaatccaatgcaaaatattttatgtttaaattgacaaataaagaacaaaaaactattcttggaagataatcattaagtagttataaagcaatttaaaaataacattgcatatgaattcccattaacaatagtggtatcttgtgacttctattagtttgaaagaaatattccacttcatgttagtactggacttcatagaaatatttattagtgggttcagccctctgttgttggtgttgttcaatgtatagtaactatacccaatgtttctaataattcaaaaatatttttatgttccaatgcaaagccatatcttgttttcttgaaagagaatttcttacatttccagctctaccttaaatggtccatatcctagctctgatgtcaattctcctatatgcaagttctgatcttaattctgcttcctgattctttgctattaaaaagttctctggggtgatgattacccctgacggaggagatgtccttgaaacagaagcctaattttcatctcctgtgtcatacttcttcttcctccttttaaatatgttgaactaccaatgacatcaaaaagaaatttaagccaaagtgaagcatttggaggaattaaaaagttttaactgaacatctttatatatcttagtttaattaaatctataattaaaacagcattgaagcatacatcttaaaaagatcacagatgaaaaattcagttatttcctgaaatttcaataatatatacatattctaatatctaggtgaaacaaatacatttcaaaatgtgttgtttaagttcactgaccttaaaaaagcaacatattgctgataaataacatcatgacatacttagcttaatttacataaataagcttttaaaaatatatagaatatttcagtgtaagggaacatttattccatttgcttacagttaaagagttatgtttgtcttattaataaattatatccattctatctgtatttagagttagtaaatttacctgtaaaattgtgtccattctatctgcatttagagttagtaaatttaaaaaaaaatgtaatttaaacatagtctggcattccctaccttaagaggtcaagtgtaaattcttgtgaaattacctgtaatataattggtgaagaagcatggcctacatctgcccaggttttaaatttcaaataaaagcaactccctaattgttactctcttctgtgcagaaacacttgctctcaacaggattctttaattaggaaaagaaatgtttctgtaaaaggctcttactgattatacagtaaaatgctttgggggaaaaattgctttaaattactgacactaaatacatttggatctgcatgtcaaatgcacatactaacttcattcttggatagccaagagctacacacataagtggacctaaaatgggtagaatataaaacttcagttagaatgtcatctgtcactttccctggtttccctgcacagcacttgtttgccccttttggtaaagagatctcaacttctttgggatgctacctgtcttcaatacacaataggaccaccaattaaagaactgcacccttctagccaaggtatggccctgtgactcaaattaggctgcctcaattctctgacctgggagtaaattttgaacagagttccatgaaggtggaaaacaattagaggtaattcatcttatgtacaaacaccttatcaattgtcccttagttcctgctcaatccttgatccccatttttttctggaatataactattgggtttcctttttgtgactgagctgacttgtatacacttaataaattttttttgtttgtttttttggctttagttagccagaatcaacttttgttacttacaaccaaagatccctaactaataacagctcataaaaatgattaaatattccatgttcaaaagcatttaaattgaaatgtttgaaatgtttctaataacaaatcagttaaaatcggcacataagatgaactataaatcttaagttgggaagcacagcaacaggcaggcaggtgattatgaaatggatgaatgatagcgtcctagctaaaaaaaaaaaaaaaggtggccgtttttattgcctagctgcagctatcagaaactacattaatattacagaaaaggggaagtgtaaagcctctagtgaaatgaagaaaggggtgcagaaagggccaactgtggagaatctttcatgttgaccccagaggttttcctagaaaaatttccctgaccaattttctttaatgatggttctactctctaggactatatattttgcttcgcatgtattctaagcttattgcattcctcaatgcatttataaactccaattgggaagggactatggttactattttttctatatctggtagagtgattgttcagaaattctattccattaacacctaatacacacacacataaacacacacacacacacacaaacatacacacacatatgcatacatctagtggcaattttatctctacaacttctcccagtgattagctatctgctattaagacatgatttcaaaagaattgggggtctcacaaagcataaagcttatcccccctcacccctgttccaccacctacacatgctaattcaacctgagagtgactaaaagtttacgatgagaaaaatattatttttactacaagtcttttataaaagcaactcaaccttttttgtcataatttcatgacagagcactgatatcatagcagccacacattttttagtcacataaaactggcttcatctttcactgtttgtttgatctgggataaaacaagcattctctctaaacatctagaaaaaacaaggtaataataacatcaacctcagaagggtttagcaaggatttcagtgagatataacagtgtctgatatattataagcacataatagatattactattattattatttaaaacaatgtgctgtacaatcataatatatctgcagtggtggtgtaggacattagtttagatatctgatttctaattgttattagtgtccaggaaaaaaaaatcagtgtttcataggacactttcctcagggcatttagatctaaaataatattttttattgtacaacttcatacagatgatgcaatatataaagtagatataacctaggagtattcaatgtgactcattcctcagtcttccccaagccccacgtttctcccagccaagattaatcttaacaaaaaaatcaagtagtcacataccttgccataatattagaagacagtgtatgacaatcatcattaagaacttgatgtcaaatatatcaacttgtctctgacagatttttctctaaatgagatttactgtccatcaagtcatatatttatgatcttaaatgtacttattactagtatcttatccccaaatctaaataggctagatctgacattgacctttattaaaattacaggtagttatgcttttgtagtttctccctaaaatttaaaaagtaatttctccttaatcaacaaaggtttgtctgacatcttagaaccccaggagagataggagataggaacactatctcaattccatattaagcttcaatttcccacagcaaaatcccttgaggaatagttcctgtattttcctccctttgccttctggaatgcaaatcaggacgctacctcaggcaggttccagttcctacgaaggaagttttatattatcaaaatattaaatttatgttccaaatcacctcatttcaactctcctaaggacaactcctcttctgaaaaaaaacaaaacaaaaacagttcaagggatgtttatgtaagcacgctgtgctaccttcatacaatatgatttttattcaaaatttctcttctgaagattcatgaggatgcattttgcaaagtataaaagatattaattacctgttcaacttgtcaggttcagaaaatacatgaataacacatcaattagcaatatataacaccaaagaacaggacataacctaagaatttaacctcctatgatctgcctagcttcaatttaaagtctaaaggcacaagtgcacatattaaagcatataagcaaatatattcagaaacctagtgttaagaatattctgtgtttttaccttgctgcttcatatttctctgctctactaactgcatgcaaaccctttaaaacctataattaatatctcaaaatgctaactagttcactgcactcttcctgcctgtatttaaatataaaagataaaggggacacagtttgccagtctacagaaaatgcacagccaacctgcacaagctgccacataatttatggtgaggattaaatgaaatgatatatgacacatatacaattagttcagacacagacagctgaaagaatgttaataagtcaaaagtcaatgaactttcttaagattcatgaaaacaatgaccaaatatgtaactctgtaaaaactatccatactgtggtttggggggaaataaatgaaatgcattcttagctgtcattatagtcacctattctgtcattggtattttaattctaacacacttcccaggtgtccatgaaaagaattacacttctttcataaaaaacgatgtcatcactttatagaacacaattatctatacacattgaaaagcttccagttgagtttattaaattcttgcaaacacaactattgtaatgcaaattagagaatataaagacactctagaatttctgtctacaaagcaagctcactgagaaaactctgcatattataatgggataattcccctttaagttgctttatatctgaaagcataaatcagagggtaaaattaagatacatttttccttcatgactgtaaataaaataaattgtaaatggtattatctgttaattttatctaaattatcagctaaaatgtttgagattgaagtacattttgggatatttcaaaatattattacttcactcatttcaaataatcaagctatctacaaatataagaaaagtgaaacagggaaaggtgactgtttcataagagaatattcccaatcatcttttggcttggttacaatgctctatctctaaatgtgaataatcttaagaaacaatgttagaggatttataggatatcttcttttaaaaggccatatttgacattgttaatagtgattgttaatcgttctacataaagtttccaaataacattgtgttatgcctgactgataatgtaaaagctctataattataagcaatgacaagatgttattaaattgcttatgtaattttgagccttctatttatttatttatcatttttataaatttagggggtacaaatgcagttttcttacatgaatacattgtttcatggtgaagtctgtgcttttagtgtaaccacaacccaaataatgcacattgtacccattaggtaacttttcatccctcaaccccctcccactctctcacctttctgagtctccagtgtttattatttcactctcttatgtccacatgtatgcattatttagctcccaattataattgagaacattcgactttcttttttgagttatttcacctaatttaagacaatggcctccagttctatccttgttgctgcaaaagacatgatttcatcctttttttatgactaagcagtatcccatgatatgtatatataccacatttttgtttacccagtcatctattgatgggcacttagattcattccatatctctgctatagtgaatagtgctgcaataaacataagggggaaggtgttttttgatataatgatttctgttcctttgggtagatagccagtggtgggattgctggatccaatagtagttctatttttagttctttgagcaatctccatactgtttcctacagaaattgtactaatttacattcccatgaacagtgtataataggtcctttttctccacaccctcatcagcgtctgttattttttgacttttaattatagccattctaaccggtttaaggtggtatctcattgtgattttaatttgcatttctctgatgattagtgatgttgaacattttttcatacacatgttgcaaattgcctatataattaattcagctttttttcagttatgtcagatcaagggaacaaaaataatatcataatttagaaaaacttacataataagattaggtctacataatctatatattaaattccatacaatgagtaagtttttttccccaaactcccttagaaaatacatacattttaccataatagaagacacatcaagaaacaatttaaaaattggagccaatagagaccacagtttctgatcacagtgcattaaagataacactaataaatttagaaaagaaacaaaacatattcccatcagtaggaaaggaaaaacaattaatcaattgtttagttcttttaaactgcagaatattaatacactgcctatccgaacctattagaaggaaaccaaagagttctcaggaaaaaattagggtcttaaaatccatgttaatgaagaagaaaaatttaaaataaatgagttaaacatctaactcataaagttagaaaaaatatataaacttagagaaagtagaataaagtattttaaaatgataaaaatataaattgataaataagaaaacatacattgtagagatgataaaggaaataaaagtaagttgaaagaaacaagcacagacaaccctttgaataatctaatcaagaaataagggggaggagaaagaatggaagcataaagtaaaaaagaaaaatgacaataggtaaataatagataccataaaaaccttaagaggacctagagtgctttccagtaatcaatactataaaaaaccttaagaggacctagagtgctttccagtaatcatactctataccctaatcatattttctttcactctcttaggaaactatttcacctcttctagactcaaacttccaagtcctctctcatattcactttcaatggatgcccttgctccctacttcactgaagaaattgagtcaaccagaagagaacttccaccaactccccaatcacatcttcccacctattaccatctctactgatatcctataacatctcattaactatcatcgaaaaaataatgtatttttctactaaagccattccatacttttcctctaaaactactcgaagacagtactccaggaagtcccatccctctctcataaatcacaaatgtatggttctcaaatagattatttctatcagcatatgtccttgaaaacatcctgatatctgtctggaggaaaagaaaactttctttctcttaaccccactttactcatcagctaccacctgttcatctcttcccatttttagtaaaattccttgaaacaaccctttatacttgaaatcttttctcctactcctcttcttttaaagtcactgaaacctggattttgtccaccttgagctactgaaaacttgcagaaagagggtaatatgctagaccctgtataagtttgggaatgttcatagttgagttagacaccagctttgcttctgagaagtttctaatgtaaaacagtaatcaccttccctagaattacaaacaattcaaatcaacagagaaactaccactaagtaccaaaacaaaacaaaacaacccacagatggcccatgtattgctattcgctcaaaaaagattatatggcctgcctcttattgtgtgaactgtagtatctgcatctggggtaagtgagctttccacaccattgcctttaagcttagctttggccaacagaatgtaagtagaagtactgctgtgatgcaacaaaatccctgagaaccattgaatgacctgccaattgctctttttagttcctactgcttcaagaatggcatgtctctgattgaagctactttttagctgggtcttagaataaagaagacatgtgggacagagccaaagccaaggtggccaatatggtgcaaaaaggagaaacaaatcttttttgttgcaaaccacagagatttggcttttgttgttatggcaacatattctagcaaaagctaattgatgcagcccaatttaatggtgcctgaaaagcattaggccaaggaattctgggttccttccatacatttcagaccatgtcatatcaaatcaaaataatgctatttttctccatcacaagcttatttatataactaaaggttcatgagcaccttctgaattcatagtactaggagtcagaaataaattcttttcaattgtatttaactttctattggctcatttagctcttctgttcgccacttcttggctgtttcgaacattaatttacaaaagacagtttttcactaaccatcaaaagaagaaaacttagaatgatagaaaagtaatataatttcattgccatttaatcctattaacatagttcaagtatttctccttgtttctatgctgtttctttggggatctctacttttgctactcaaatagtcaaacagaggcatctgagagcttgttaaaaatgaaggctccaaggccccacccaagacctactgaaacagaatctgcattttaacaaagtctccagctgagatgcacattaacatttgagaggctgtggtttataaaaaaacaagttctcctttttactagatgttctttttcatagatctggagtagttaacagccaggatcattttttctttttatgaaactttcaggtgatcctgatgtaagagatttatataatacattttgagaaaaatcaatttaggcttagctgagtatgtctgaatctccagttttgacacttagtactagttgcatggctctgtgaaaactacttctccaaaattcatttcttccatccatggtgaagttactacctatttctatttcacgggtttataaggttctatcagatagtgtacaaaatatctcactgttaactgcaaaggagactaaaacaaatgcaaagttgaaacatattaggaacataataaaatgtgttgattaatatgatgaatgtgtaaatgaatactattcaactctaatgcaataagaagaaataacacaaaggaatgatattaggttatgggaaaatactgccaaaggctgacacagtctctgctggtttggactattgccttcacttttggttgtttgttgtttgtatttgatatctctccaccaagtccaagagcaaaaaggctaagaatggttgagagtatcttttcttatagggctatttaaaatagtcatgactttcaatcacataaacataatattaaaaatgtcaatggcaaaaaataattcaatataaacacaaagtaaaaatcttccttccccaaacatctttatgctcagtctcactccccactttcaatcatttatgtttccaggttttctgttattttccactacagcataattttaaatagtgcaagatgagaaaattagtacaactatacttccttctacttgctatccccctctccttctctcagcttctattatctaaattttaataaaaactatagtttgttctgtaactatatctagattttccttgtatttcctatagattacaatttttaaaaataagaacatttaaaatgttataaaattactgttgttttgcagaaccaagaaaaaatattgaacaaacgcagaagacagatttccttgccattaaaactgctttttagtaaagcagttgaatttgataacccagaaaaagaattctaaggtgactaccagaaaaagagtaaacttatttcaaaacattctgacctatttaacaaaattcagcaatgtgatagatggtattgagagataggtggacagatgggtaaatgggatggaggaagaaaggacatttttaaggaaattctcaactcatctatctgtagtcaactctgaaaagataataaaaccacatatttataccaaaagaacgtacaattatgggctacatatatgtaaacatcaagacactttcattacgaaatatcaaaattgttttggaagtgaatggacccttgaccaaaaaactgttaataattttattaacttaaataagtattacaataaaaaattaggaagagaaacaaaagatctgtttttttatagggtccaaatagtgttatatctacatttttagaatgactacattagcattttcatcactgaacttgaataaatggactcatttaaataattagcacttagaaggcacactaaccatggtcacacagaaaaatttcataaatgataaaacattcaagaaatcgggatttatttttagagcaagtcctctggatacttttgaaatgcatcaagccctagtgacaacgttggacatactgaaaacaattgtctttctgtatcctacactgtactttgcagtgaattcctgactttgatattgtgaatagtttcagatatgcagcacatactttattattggagatatttttaaaagtagcctcaagtgcggtaaacagaacagccccccaaggatatctactcagtaatctgtggaacctgtgaatatgttacatacatagcaaatggaactttgcaaatataattaaggttacggaatttaaaataggaagaatatcctggattatgggtctaatcacctgaggccttaaaagtagcaacatttctccagctggagtctcagagctgcagcagaaggaaaagtaaggagatctgaagcaagggaaggaactgatcagaccattgttggtttgaagacagatggggaaaaattaggatgaatgcagcccacttaaggtattgaaaagttgcccaccatagccagtaagaaagctgggacttcagttccacaaccgcaaggattgaattcagccaacaagtggaatgagcttggaaagggatttgtccccagaactgtcagaaaagaatgtagcctttgctgacaccttaattttagctctgtgagagtctaagcaaaagacccagttggctcaaggtctacctgaacttctgacccacagaattgtgagataataaatgtgttaagccactaaatttgtgatcacgtgttacagcagcaaaaggaaaactaataccatatgttcctttcctcctttgcatagagaaagttctacacattatgctcctattttgaatatacccattttccatgataaattgagcctggctaaattaaatgaatattaagaactattcaaatccaagtgtattagtctgctctcatactgatatgaagaaatatctgaatctgggtaatttacaaaggaaagaagtttaaatgactcacagttccacattgctggggaggcctcaggaaatttactatcatggcggaaggcaaaagagaagcaggtaacttcttcacaggtggcaggacagagtgagggcaagcaggggaaatgccagatgcttatgaaaccatcagatctcatgagaactctctcattatgacaagaacagcatgggggaaaccactcccatgatccaattacctcaacctggtcccacccttgacatgtggggattattgggattataatttgaggtgagatttgggtggggacacagagctattatttctggtttcacaaaacaaacacttggaccagaatttattctgtcctcaaatggaaaagcaactaaccttgatatgtctgctatatgttagataacaaattaggaaatttgtaaataatattttatgtaaagttcaccatgttccaattaaatgttattaccctaaacctgagttaatctaactacagggtaatagttgtttatatgagaattggtctagaaggcacgaaaagtataaatgagttcttgttatgacaaaaaaaaaacctagaaatttctgagttaggtgcattagtaccctttataaagaatgaagaatccctatttaaaaaatgtagtagtttttgattaaaactgttacatctctgttgctcctgccatcctggtactgctgctcttattgcaactgccagagcttccacacactaacatcacttccactgctacgcactaccctactacaaggctcagttgaaactcacagccttggtcttcagaagccctgttttggatgctgttctatgggtcctacactggctgttcaaaatgctttgttctctttcatcccattttcttcttttcttgtctgaactcagcagttaaaggaaggctatatctggtctgtctggagagattgagatggaaatgtaactttccagtgttttttccatttctgcacataacagtgtgaaatacctgaatctgaaggtttagcactttttttgtaatttctcttggctatgaatgtgggtctcatttacttttcaaaaataaagatttgagacacagggaggttcagtgggttaaggtaacttgaaacccaaacttcaaacattgcgagcaaatgcattttctgtctcaagtttcacaaaagagccttactgtgcttatatctcaccataaaaatctaaacatttgcttttaaagacacttcagttaattaaaaatatataaggttgaaatagtattaaaagtgatatatcattatatgagtatatcaatttagagtgctggttaatgtgagggttcagaaaacagacaaccttgggtagaattggaactctgccatatactatctttgcaaactagagaaggtgagttaatccctctatgtcagtttccttatctgtaaaaggggaataataatagtacctctagtcatagaatggtggttcagattaagtttgttatatatgtaaagtccttaaaactatgcctggagttcagcaagctcttaaacatgagctatcaattctggttctgattctagtcactaaagagtcagcagtgcaggggtgggtggggagttctaaataattgtattaaagaaagcatgatgaaaagatgaaagttaattcttcaagcctatgtcacaggatgatatgagaaacacatgtgaatataacatggactgtgacaatatataaagtaattagaaaatatcatatgtgtaagggctcagaaaatgtatcaccactcaaatatctttcttaaaatgcttacttagaaatacattccttcaggcaaagtgatgaaatcaaatgtaaaatataaaaatggacaaatggtgactacaagaatgatagaatcattcaaattgaacatattaatagcatttaaataattgctaatagcttaatttcaaatctgaatgcaactttagactggattttgcagtaaaaataccgcataaaagtttttaataataaataacactttatgttaatacaaattggaaagtccagtgtggggaaaagagcaaggacagagaagtattcaattcttcctctttatatgttggaccagaagatggaatgattactttcctgattataccaaataaagaaatatggatgatgtttttttttaaaaaaaaaaaaaaaacactcacacacacaacaggttccactagtttagttacaaacaatgtgtatttcttacatatactgcagaagagaaaaggcaacaaaacccatttcaacagccaaagcaaaaaagcaaaataatatcaaggaaggaaaaagaggaaataaaaaattaatgacatagataattgctcatgatatgttaagtgaaaatgcagtgtataaaattacatatagtatgcttctaattttgagaatagcatctttctcttagtgtaaaagatgataaagaccatcgacctaaattgaactttaagtaattatagatgcagaaacttgaatattttctacaaagcacacaaaaaaagcagtacaaggaaacaacttccaagaacagacccaaaattaaacacagtcaatatgtaattcaaagtagaaaatcaccaaaataggtattataaactgtgttgaaaattaacttagagcagaccagtaaaaagcaaacaactttcttagttacgtctggccttgtatttttgataaatttattactgaaatattttataaattaatacaacaatcttttattgtctctatatagtagaaatatatatattatggttaagtttatgatggtaaagtacataaaattccagttttaaagtgtgagacatagttcttaagaatatctctctttttaggttttaggttaaataacttctccagaaatataaagcaactagtacgcatcaagtgtttaatccttgttcttgactttctttgactctaaaatcttaaatgctttaaggaagattgcgttttaaaagtacaatggatgtaaattttcagttatgcagtatgaataagttcaagagatctgctgtacaccattgagcctatagttaatactgtattgtgcacttaaaattttgttaagagggtagatctcatgttaagtgttcttaccacaataaaaaataataaaataaaatgagggaatcttaaatttaaatcttgtctctgacacttaccagtaatgtgagaataggaaacatacttttctgagattttatctatatataaaatggaattaaagagattgcttttacaactcttatgaagataaaacaaaatatttaaagaggcaatgaatatattgatcaacagatgcttcttcctattctactacactgagttctttgctcttattcattttctgtcatacttctatcattgtcatatttctatcacatagaagtgtaaatattggtttaatcatcagtcacctcaaataagctaagcattcctgaaagggagaagcatttttcatcatctttttttgtttctataagccatcaggataagcaacattttatcctgtaacctacatgttacattgccaccaggataacctacatgtctatcttttgtattctcataaactagataacgtgcctgctacacacatattttatttaaaacttctgatttgagggctgtgtcttctgaaaatgtgtaagaccaatgagcacaggaatgcagaagataatcagcacctgtcccagataatcatggtctcatattaccactgtttcctatttcagggtgcatattgtgcccaaatctgagaatgctgtggtgaaagtgataggtgctgtggagctcacagttggagtttgtctctaaccccaggtgaacctcttcaaacacctaacaattgttgagtctaaataaaggctcacacagcactgtgtttgtagtttgggaagatatgcacatataaggaaaaaatctctttgctctgagagattacattgcatttgcagaaaaaaaatgcatacaatcacactaagcaagccatcattaataaccagtttagacttgtattttaagttatgtgacagaatagaagaatacaaagggggagagaggcagattagaggtcaggcttgaagacataataagaagcttaatcatttattttccagattagcattttacaaatgtaattctatgaattacctaaggtgattgttaaaagtataaaatcaaaatttccagagaagatgtcattgtcaacaagcactttgagcaattctccttttcagtcaagcttgtgaaaacttctctaggtgattgggagccatggaaagttattttttaacatcttaattgaaaaataatttacatatcacaaaattcctttgtgtttagtgtagaatgctatgattttaataaatgtatagaggtgtgtaatcatcacaacaatccacttttaagtctcccaaaaagatccctacccatttgctgtcacttcctatgcccacctccagccgtaggcaaactttaatctcctttccatcttatagctctgacttttctgggtatttcatgaataaggaatcatgtaatatgtaatcttttatgatgggcttccttcatttagcatgatgatttttaaagtttcattcttgttgtagtgctgatagtttgttacttattgctgaatagcatttcattgcatgaatacacaatattttctttaccacctgagggatatttgttattatgaataatgctgctatgaacatttgtgaacaggatatacatgaaaatatgttttcatttcccttggttagatttctaggagtaaatttttttaattaaataaactactagattatttttatggtagttgtaccatattacatgccaattagcaatgtatgaaagttcttaattcaccacaatgtctctaattctgggtattatcttttgattataaaaattctagatggtgtgaaatgtggttttaatttgaaattcctaatgactacagagattgagcatatcttcatctgcttattgacatctatttaccatcactgatgaaatgtctatgcaaattgtttacccattttttaattgggttttcctcttcttattgacttgtgagagttctttataaattcagaatatatgtcctttaacagagatatgttttgaaagcattttctcctagttatcttagtatttttcattttcttactattttgaagtataagttttttttattttgatgaagttctatttataattttttttgtggattgtacttttagtgccatgtttaagaaatatttgcctaatccaaggtttcaacaatgttttcctattattttcttctgcagagtgtatcgttttgctcttacatattggtctatgggccactttgagtcaatttttgtgtatgatgtttggtaaggttctaaattagtctttgtgcatttgaatagccaatcatcctagcctaatttgttgaaaagactatcttctccacattgaattggtataattgttgaaaatcaattgaccataaatctacggggttattcttgtactctctatcattatacttgctctatatgtctatccttaaactaacctgtttactgtccttttagagtaagttttgaaatcagtaaatgttaaattctccaattttgttaatgtttttcaagattgttttaattatccttggtcctttgtctttctatataaatattaaaatcacctcatcccttcctgtataaaaggctgctgacattttaatagaactgtgttgaatttatagacaaatttgggcatatatgacatcttaataatattgaatattttaaaacatgaatgtctctacatttgtttagatatttttacatttctcttaaagtcttcactatacaagccttgcatgtattttgtttaatttactcttaagtatttcattattttagatgctattatagatggagttgttttaacttcatttttgatcattcttcgatactgtaccaaagtacaatttatttatgtatgtttatcttttatcctgtgaccttgctgaattggtttattcattctgttgggtttatttgtggacatagacgcattttaataaaggcagtaacacagtcagattttaataaaggcagtagcacagtcagatttgtattttaaacagataactctgcagctgtgaaggggatgcatttgaaggaggaaacgccggaggaagtaagagtttttcaacaccgttgggacaattactgacatctagaatactcaaaggaatatataacaagactaggagtacaccagaaaaaaaattgaaaatggtaactgcttattttgtcatagaaatggacatgtttattttaagaaaatcattttaagctatcttttctttgttttttagacaaagtctctgtctgtcacccaggttggagtgcagtggtgtgatcagttcactgtaacctcaaactcctggactcaagggattctcttgcctctgcctccccagcagctgggactacagacatgtaccaccacacttggctcatttaaaaaataatttgtagagaagggggtctcactttgttgcccatgctggtatcaggctactacatttatcgtgcttattaaagttgcagacttcttccaggaatggcagactgtgtaattgggaccagctctattgataagaacaactagaaaaattgggtaattttttaaacaaattttaattcacttttgaagtgaattaataaaggcaaaaaaaaacagtgaagattttagagtttgggatctagggaaaactaagccctcaggcatttcgacctgctttttccctagttgtggaaaaaggagaggctggctcagcacatttggcaacttcacaaggctgaagagatgggaattgagatcaagtcctttcaagatgcagtagccttaatgaatcttcctcacttggaggtgagactcctaagaactgtaccctagaagaaataatccctggatgacagatcttcccagggattatctggattgaggtaattaagatcactgtttttccagacatctggccaaaaaaaataaatgttccctctagatgaagataatattctcctagaactaaaatgacttccactgatgattttacaaatgagatgactgtcacacagtcaaaaataacaatgtacatgatataacttgacaaaaatgaataataattcaccaaaagacaaatgaaacagataaaaggaattcctcatattcaagttagcagaaagacttaaaatggccatgtttcaactgttaaacaaaattaaaaacaaaacaaatggaaaagaatgtttaaagatagtaatcacaacaaaatattaaatatatagactcaacagcaaattagaaacagcagagaaaattagtgaactaaaatttcagtacaaaaataaaattccaaatgaatcacagagcaataaggggatggaaaatatagaagaaagagtaagaggaatagaaaataaagtgagaactagcatataggaagtggcattccaaaatgaggggggaaacagaatgtgatgaggcagtatttactgaacaaaagtaaatatttttccaaaccaataaatggcagtaagtcacaatgttaatctctatggacactaagaagaaaaaaaggaaaataaaaacaaatacgttttaagtacattatagtaaaacttcttgtaaagaaaactctctaaagcagccaaaaagattaaaaaaaaaaaggacagtttactctcaaagaagaaacaattaaattgacacctgccttctcaacagcaacaatgaaagtcagaataaaataatatgtcttagtgccaagtgaaaataaccactaacgtaaaattctatctccagtagaaatacctttcaggaataaaggtgaagtaaagatattttctgaaaaacttaaaccagaaaaattactcatctgcagacgtacagtaaaagaaatattcaagtttatttttcaagtagaagaaaaatgatcccagatgaaaagccagaaagaatgagatccagaaagaataattggtaacataaatggtatacatgtgaataaatctaaaggaatattgcctgataaaaatataataatatatttcacatcctacacatggaagtataaggcagggaaagtatacattaacattacactttgctaaggatgcacattgtaatttgtaggttagcaaaagaatagcaagagtgtaaaacttctagataacagaggaaaaaaatgcaattcaaatggtggcatgaaaggttgatttaaaaaaaaaacacaggataggaaaaatagaaatcccttggtaaaatagtagactaaatacaaatatacaagtatttacagtaattataaagataccaaataatttaaagagaaagattatcagtctgcatacaaataaaattcagaaattgtttattatttgtgggaaacatatataagaacacagacacattgaaattagaaatatagaaatggcacacaatgcaaacattaacagaaaagaaatctgctctaatactattactactagtaataaaatcagattaaatagaattcaagggaaaataccagtccagaaataaatgggtcacttcatgatgataaaaggctcaactggccacgaagttatacatatgatatagtcaaataaaactgatagcagcctcaaaatatatgctaaaaataaaagaattgcaagaagtagaaactctataattatagcatgagacaataaaacttgttattattctaacacagaactttagatgtggaaatgcaaaatgaagttacatttttaaaaaaacaaattaaatatatttgacagttactaaaacttatgatttcagaagtcacattttctataaaaggaatactagctgaagagattttctaactcaagcaacatcaactgccacagattatttgtccagatggaatatagttcatagtactgtattctgatagcatgatggatcagacaattggctaacataacttttaaataacctttttataagcattttaaaataaacttttctatatacaaaattaacaaagataatataattttgatatttagaactgattttatctcctttatcttagaaatagatcatgaaataatattcttatcagggaaaactttcaattcaattaccaattttttaaaaaaacttggtcaattaatctattatcgatcagcaacatatcaatgcatcttataaactcttataagaattaataaaaaattttgaactatatcacatatcttaattgaagcagattacactaaaagtggacataaaaagagaaaatcataggtaagaataatacatgaaaattaatttaccgtacatagaacaagatagtgtcaaattctaatcacataaattcctaaacaatttcttccaggtaacatcaatattaacatgggcttatagatttaaaaaagaaaaaaacaaaaacaaaaacctcttcaaaacagaaaccttcttctggcaaatatcttaggaataactattagtctttgtacttgcctggaagacaacctggggcttcttgacctaggagggaaagcagagctgggagccaagagcaatgagatttcattttcttcctgtagcacctattgcaagttccagggccaacaatctcactttttgaaaagcaaaaatgatttaaaatattcatttttggggaaatttgttctaattcaaggcccaaggaagaaattgccagtcattcagaatcttactcaataaatttaatcatatttgagagaaaatagtagagccttattatgagtattttttaaattatcagtgtcacaaataaaactctgattgcaatgcaaattgtaacttaaaattcaagccctatgtacgtttggcctatgaatcttttcttaaataacttaattgttatgactcttaagtaatcaaacagcaagtagtaagggtttactaagagccaggcagccttagctaattcagagatactattttgtaaactgatttaattgcagagatcaatgcaaaggtgtgtgatctacttagagtgtgatagtcatgttttaaaagaagatgtccacaaccacagttctaaactctccttttcacaaactgaggaatcgtgatggttgttgctaccttaccctcaagctgtaaagctctgaagtgaactattcaggaaaagtaaatagtgtgaatttcagtgtttctgttactgcatatagaatttctcatcaaagattcataaaaataaatgaatcataaacatgctaatattaagtacaacaaattagactataaattttagcaaaaaatctcaggttaaatagaaactcatcttgataatactaatgactatttttctgttggtatcattccttctgacagaataacaataagagcaggccaaaaaaaaatagaataattcaaatataaactattccaaagtgaaaaactaatcaaaatattctacttttcattttgtccttccacaaactgaaagtcggatatagataataaatagtggtagcagtattataaagtcatataaatattcatacacttttttttgtgtcaaaagtggcttagtttaagaaataaattccttagtgaaaaaacatgaagaatgtgaaaaaaatggaatttcaaatccacagaaattgtgtcaatatctcttaaaaattccttcaaagcaaatcatatacattctgacctcagtgctatgattgtaacatattcaaaatgtcaccaccacctcttgatataaaacccacttcattcttgaaggggatttgaggtgcagcattaatgctggtctcatacataatgacactcgtgttgtagacacttgagccataaggctcgatgaattatatttgttttcttgttttcattaagatttttaatatatgatagttttttttttatgattgcatgatttgctaaacaagcatagagtagatatggagaatgtacacaacaagaaaaagaataatctttgttttcatttatttagtattttttttaaactccagctaaatgctagatattggagacagaaaatacagctatgaaccaaatataaaagaatcccctgactcaagcttgtccaacctggggcccacaggccacaagtggctcaggatggctttgaaggcagcccaacataaattcataaactttcttaaaacattatgagatttttttggtgatttttttttttttttagctcatcagctatcattagtgttattgcattttatgtgtggcccaagacaatttatccttccaatgtggcccagggaagccaaaagattggacacccctgcctgacctcagagagcatagagcccaatggaggaagaaagagaaaagtaagataaagaaataaaatatacactatactaggtggttataagtgctttggaggaaaagtagagaagagaggttgggtgtatgaggaagagggatgtaataatttcataaatttaagcaggatgatcaggcatggccttactaaataaatatttgagtaaagacctgaaaaggtaaagaaagcaagccatatggttatttaggggacaacttttccaagcctagagagcagccgcagcagtccctaaggcagttgaatccctgacccgttggacagcaagaacaccaggatggtgggatagaatgagtgagctggaaaacagtaagatatgttatcagataggtaaaggggaattgcaaatgttaacattgtaggcctggttaaagacctaggcttttccattaagacattaagttatttcagagatttgagcagatatgaaacaaactctgacttactttttatccgaatcagaatctcttttatggctctgaattatatcgatgagctacaaggacacaagcaaggagaacagttaggaaaatttcatctgattcgggtaagagatggtgactctgactaggatggagttgcagaggtacttatagtggttcaattctgcacatactttgcaggaaacactgagagactgctgctagattgcacagagaatatggaagaaataaaacactgaagttttgggcctaagccaatggaagattgatgttgctattaattgagatgtcaaagactaagtgaagatcatgaactcagttttgtacacgttagacaataagtgtctgaaagttgaaagaatgtctggagaagaggtgaaaattctgaagtcatcaacatttagatgatatttaaagccagcagatggatgacattatcaatagtgtcaatagagatagaaaaagacaaggttcaggatcctggccctggagtaatcaagcattaagatgccaggaagatggcaagtgaacgataataaagactgaaaagtggccaaaaacaaaggaggaaaaccaggcaagtgggctatcctaatgccaaatgaggtaagtgtctcaagaaagaagggggatccactgtctaaagttgctgataaagtaagcatgaataaagactgagaagtgaccgttgcatttagcaatgtgggagatattgctaatcttcacagagcagtttagatgaagttgatctaaattcatgttctcttaaatccactccactcagggtgaattcaggctgaatgcctgaacccaggagttgattcaagagaaaatttggggagaaaaataagaacagacgtagccaattaaaaaaacaaacaaggctgggcatggtggctcacgcctgtaatcccagtattttgggaggccaaggtgggtcaatcacgaggtcaggagatggagatcatcctggctaacacagtgaaaccccatctctactaaaaatgcaaaaattagctgggcatggtggcacatgcctgttgccccagctactggggaggctgaggcaggagaatcatttgaacccgggaggtggaggttgcagtgagccgagattgtgccactgcactccgggccacagagtgagactccgtctcaaaaaaaaaaaaaaaaaaaaaaaaaaaaaaaaaacttttgctgtaaagggaaagataaatggtggggtggcatcttggtagagtggtgggggggtgttaatagctttttttaaaaaaaaaagagaaatgtaggtacatattttaatgctttcagttataatttattagagatggaccaattcataatgtaggaaaaataatgcaaacgttttgtccaggaatagcaaggagggatgagatctagaacaaaagggaaaaagttgaccttttctaggaacatgtacagttcatcacagtagaggataaaaggcaataagatcactaaaaataacagccagtttcactgaatttacaaatacatgtgacagccagcagaatttaggcagtgccttcttatttgccattatatattcctagaaaccataattgacaagataaaataaaatatagatagcaactctatgccataagcatagaacctgacacagaataggccctaaagtatttgttgaataaatagtaattatttatgaaatggttatgataaaattaatacatctaaaatgtttgcccttcataatcatttaaaattagcaaaataatacaacagattagagagactataattcttttgtatgtaagacaatagaaaatagtaaattcttttgtatgtatgtaaatagaaacctcagaagttcagtggttttccaatgtcacaggttttagcaaaagttgaagctgaaatccaagtgttctactttctagttaaataccctttcatgtaacctacagtttctggctgataaaatggatcttatagtctataaaatatgctcagtgcataaaaaggtaaatttatagtatcataaatattagactggggatccttaagtaattaaattcagtataattatatgaattctaacaatcatttcaaatttcattaataataatttgtttgccttactaaaacttagaggtagtcatgagaaatatgagaaatgctttcttttttttttttttttttttgagacagagtttcactattgttgcccaggctaagtgcaatggcacgatctcagctcactgcaacctctgactcccgggttcaagcgattctcctgcttcagtctctcaagtagctgtgattacaggtgcctgctactatgccccgctaattttttttgtattttcagtagagacgtggtttcaccatgttggccaggctggtctcaaactcctgacctcaggtgatctacccaccttggcctcccaaagtgctgggattacaggcatgggccactgcgcccagccacaagaaatgctttctattgtccatgtcttttaaacagggtttccagaggactttaatacttcttttaatctagatgaacataacaagatgaagaagagggctcagggtaaaaacaaaagtatgtcattaatgggatcctggtgaataccacttacaaattgtgtggtgctgaagaagttacctaacctctctgttccttagttttattatctgcaaaatgggaatagtaataacaacagcctcattggaatgttcggaatattaattgagatgatacctctacccagtttaatgaataagctgaatttagtaaccattttatctcctctgattccctcaggttaagaaattaatatgaaacaaaatttcagacagccgtcctagcttctctagcatgattagacaataaattaattatcttttgttttataatgaaaaagtctagtctagactaatgattttatagttttggtttgaaataggattataaaagagacacagccctaaggtcccatctaacctaaagtttctccccttacacttggttcaggcttacttcaagccctgaagtctgcactggagggtaggagtctggtggtctctctttattctcacttcacccactcacagcaactgtttctgaccacttcagactcagggcctgtgaaaagaaacttggaggggaaagaccacagtggcatgtggctgacccttgtgtcaccactgtctgggacttctggaatggcaaatgtggaagcaatgaccttttttttcttcttcttctggagtgcatctgtggcattctcaaagaacccctctgtctgttctcttctctggaatcaatcctccaaatttgttgctcataattcaccaccttggaacctgggcttctgcgagtatactcacctatgggcttaagataaccctaagcaagctcccctcatgaggaccgcagttgctcttcaaacattgccaacctttttcttgaccttggagaactatgaggacttgcctgccttgaaactccttcatctgctatatgggcatccacagccactgtggctgcttttagattttagactctatatcctttactctctaaaggaaacctgttaagctctctgaatgtttttcccgaagctcttctcacttggctaaggtgagcaggaactgctctcatttctcatacatggagtggtagactatgtacaacaaacaaacagctttccaaaacaaaagtatttctcttttagcttttccaactcaatctttgtagagtccaaatatggagtttgagttaagacaaaacttactggttggactatatcttagcatctcctgcaaataaagtcttgtgcctcacttaattagcttcatctccaacagagagagagggaaacactcccactttaatatctgggtgcttaaataaaatactgaatggcatagcgggagtgttcagaaatgttagctattacaattaatcttatctttgttattgaacacttaagaagtaactacataaggaattggccacaagaaaaaaattgagaggaataaaacaaaatatttaagaactaaaagagtatggtatcatgaaagttaaggggataagattcatttatccattttttttggagaagcgcagtgtcaaataaaacaaacctactacaattattaattggttattggtgatagcgaacattctgaacagggagttagaggaaaaatcagactgcagtatagaagtcgaaaaaattgagacagtgagagcaagtctggagaataaacttggagaataagtttatagaaaaagaaaaaataagttgaaaactaaagggaaacacagagtcaagggacttttttgttgttaattgtacttgtcatcattttaattttaagaaatatatttgaacatcttgcaaaatagccagcttagaggaaaagtaattgaagacactagagacagagggaaacaataatcaaaagaggaggtaaaagggagggttcagggatttagagataaatattcatataccagaagggcaatgcttaagactggagaatgtaagtaaatgaagacaagtatgggtatgggtaagtgtgtgggaggaaaataatgagcattgaaggacaacatacctactagcctagaaagggaatgtttatggagaattaagagcatgggaatttcaacatgaaataattaatagcattgcttaacacaaagaattcaagggacatggagaatatgaaagcatcactagatttgcaaaatattggtgacatatatgagtgtactttattttaggaaaacaatgatgatagaagcctgattgcaagggttaaaaaaagaaaaagaagcaatgagcaatacagaaagcaagcagatattttatttggccaaaagaaaaaataactagaagagagaaatacacattaagaaaataggatggctataacaggaggtaaaagatggagcatgcttctcttttacaggtaagggataaaacagtgtgctggtattaggtttcacaaaaaacaaaggagctaaattcagttataatcgcagcacaataggaagggatgttgtttgatgtaatcaagggacatgtgtgactggccatggtggaagtggaaaatttaggaaaatttagttaagaactttttaaaaagataaatcaaaatacctttaaaatttgataaagattgaagagagtaaggatttttaatgctctcaatttgtgctagtgttcattattacccagtaaaattgtgcagttaaggttggctaaagataatgatgacaatatctacaatgataatatcagcaacaatagctacatttaacatttattgagcatgtactacctgtaaggcatggaattatcatttgacatattccaactcatttgttcctcataacgatcttatgaggcagtttctattattatttgaagtaagcactttgaccaaggttattgagctagtaagtagcaagtccaattatacctaggtagtatgcattcagaataaaagggctgtcagggcataatctgttgctctctataagatttactcaaatagtttgaattttagaatgtcaaaagatatatatgtcctccataagtagcctcttttaatttctcatcaagatgtacaccagcacatcccaaattatacatataaaaacctggtattttaaaatgctcagggtttctgaaacacattctcatacctcctttcaatcactcttaagggtagatattatttactcttttcaattaaggaaacagagtttgagagaaatcaagtgactttccaatggtcctccagttaacaaaggaaggagccccaattcaaattcagatcttctgactcaagtccaaagccttggccattcaggacattacccatccctgaccattctttctcttcaatagtctttatatttcaattatcttttctagttttctggtcacatttctatttcaaatctccatacttcaccagaaggttatcacaataagctttctctaacatgaaaatgaccaaaatgactcttttagtaacatttgtgtaggtcagttgcagtaataatcccagtgtttcatttatcctgtagccataccctttgccatttaattctgttctgctttccactctctctaggtttggccaagggacattaccaaaaatgacttaagcagaagtttaagaagcatctgcttattcctatttggctcttactcctcttccatgatcatgagaacctgccagggctagcccattacaggattagacacatggcatagaggtgaatggccccagttggctcagccaaggctgtcctggatcagaatcagacaacagccaattgacataaagctgacacagccaaccttcagctagccagtgacataaagttagtccagccaagatcagccaattcaagatcagctgaatcccacaaactcatatttttgtatgttattgaggtttttgtgttgttatatagcattatttaagcaatggataactgatgaatattatgtaatccatccaaaatcaagattgtaaaataatttttcttcatgatctggtcatcagttcaccccaaattctccagattataccacatagaaattcctgtctttattttgcaccacacataataacagcctacgcttcacagccactatatagaacttcactttcatcctataacctttcatcaaacaaatctttttttcattattgattgctatttaatcttttaaaactaaacaaacaagattccccaaagagtcttctttgtacaaagtagggaccctaagcctagcctgggaagcacagcatatgctgaattttggtttcccatatgtccttcagcaaagttctatctgcacaactttcctgccccacatggaatatctcagaatctttaccaatcgtttctcaaaaatacctctttaatatcactttccacatgaaactttttgtagtgaatcacatatcaacttcatagttcaaatactttcagtacttctataatcttccagtactatatttatttgggcccatttatgtattttttccaagcaactctattccctaaactgtctgagagccaaacttttttccccatcccctttacaaacatatgtagctatttaataatgcacagtggaccctcagtgtatgctaaaaaaggtgatgaaaacaaattttaaacttctacatatgacattttgcaacaggaagcacattccctttacctcttctccaaacattcttaacaaatatattaataactgacaattattcccccattctcaaaaatgtgtaggattattttgtcaatattcctagtaaattactctaattatcctaatgattattcacatatatgtatagaaatgatcatcttttagcattctggataaaacaaatgcaagtaattccatatttaattttttatacattaattagtttttatttgcctcatattctttaatcatcacaagttaccctatgaggtgttagtattaaacactttttgtagcatggaaatctgaagttctgactcaaactggtgatgtgtagttgggtcacagtacaaatctgatcttcctatttcaagtttattgttctttctacatcaaaatgcacatatatttacttctccatttactttaaaagccttttttatgggcctagtactttggcagttcagagggttttgcattattgagatctgctccttttctcaaggagcttatagattaggttggggaacaggcacataaacagacaatttaattacaatatgataaatgataagagtaaggcacacagaacaaatgtacttagggttcagaaaagagttcctgaaagagataaacttttggctgggatgggaaattaaccagacaaagacattgaggaaaaacattataggtagagagatgaacattaatgaaggaaaaagaatggagtttgctgggacacaccaaacagtgtcgtattattcaagcatataatgtgacatatttacaacaccagaaatgttaggagatgcagcaaagaatttcagggtcaggtgccaagaaaaacagaagagtagagagatttgagaattatttaagaggtacaaaaagtgtggcccactgaggactgaatttagagaaggaagaaagcaccaactataaggacccttaaggtgcctaagtaaggagttagagcacacttaggttgtgaattggaggtagatgatgactgggtttggagcatgttgaatctgaggttctgtggaacataaaaatggatctgtgcattaataagttagataattgagggcatagctaagaaacttcaggcctggaggtgtggaatgatgtgaaattatcagcactttttaaacgcagatatacccaaagacataatgaaaaactaaacaatacagctataaaataatttacatggttaaaattgttaaaaattattgttgcatacttttataaagaaataataggagagaaagtgactaaagtaaagctccaatcaccaagacctaatagcactgaataggcaatttaagacatctatgtcataaagtttatctctgctttcaattctaccctgtgtttgctgaaataattttcatttttctgttaccctagtggttttcaattttacatgctttatttctgccccaaaagtcacatttatggtagttattttcaccttccagctaaatgtcaagtgcaatgccaccaaacagtggcacattatttacaaaatattcataaagtttcaacaatagcaattgatgaagaatattcctctattacttatagaaaacttatagccctaaagatacagagtaggttattaaacactttctttaaaaaaaaaagatgattatcactgtctaaggacctgtggatttctaggggtactcagatatttataatagcaacatacaaattgatattgaaaaagatatcctcaaagtatttttaatttagaatggaactatagccatctaaatgtataggctcataatccctaatctacaattccaaaatccatacactctgaaattgatatttgatttgtgaatatgtaatgaatttgacgggtgggaaaatcagacctatacttatcatgagactatttacagtctttttttttttttaccatgcagtaggaatattcatagaattatcttcagaaaaatttcagaaatattcagaaatatgggtgctgcccatagtccttcaggaggattgttctataatatgctacacacacacacacacacacacacacacacatatacagagagagagagagagacaagaaacagagagtaagagagaaagagagagagagagaaccagaaaacttctgagctccaaaacataactggtcccaagggatttagataaaaggctgggcagtatatttaaaaattaaaacttaacattttaaaggcaatcataatttagatactccatacaattgaatagctagaaataaaacattttcattcttgtacctttacaaagagatttacctccacaatcagttacgtataaaaatatttttcagttttctcctttttttcctgaagtatcttgttctagtgctttatttttacaacatttttaagtaaaatagtcaccttttttttacagaagaggaaacatttaaaaatccaaattactttcagatgtattttggtaagattgggatttaaactgaaaacttcaagcttgaataaaatctagaaagacaaatgtaagagggattcatgcagtcttacatgtaggatcagaatcaacttccaagaagagtggaagggaaatgggaacacactgcagcatctatgcaagtcaattagaaacttcagttgactgctgtcccagtacacattgaaggtatgttgaacttgtctccaaatataataaaatcctagtgtaaactaatgaaacactgtatccagaagaagaaatgattgccccattttccacttgttacagtagataaggaagagtgtgactggttctgggaccactttaacaagagaattaactaactcaaataatcctccaagagagtaagcaggatggtgatagttctagaaatcaccttatgaagagcaattgcaaagactaaaatattttccttaaaaaatataatatttggtgtagctatctagctgccttttgaaatgagtcaaaacattttgtgtgatgacacaaaccagggtaccaagaagtgagagttattaaaaacattatttcatctcaatacaagataaactgcctgaaaacgaaaaggactagaatggcagttattcacacagggttatgggtttacctatcaggatgtgacaggggattcttagtgatcctttccattttgagagtcataaatatctctatgagttaatagtacagatagctttagaattttatcaactttgaatatatagttttcaatatttataaagatatctttgctacaagccataactttgtggagagaattcaactctttaacatttagtatactgtcttttaaggagcgggccaatcaaccttgtatttaaaagaaagttttagtttaatgggggtgagtatcaaaaatcccattcatttttatgtttcttctcatacctaaaagaggcacaattatgcttttcattttttttttttttggaggtggagtctctttctgtcccaggctggagtgcagtggcgtgatcttggctcactgtaacctctgcctcccgggttcaagcaattctcctgtctcagcctccccagtagctgggactacaggcgcatggcaccacacccagctaattttttgtattttagtagagatggggtttcaccatgttgcccaggctggtctcgaactcctgagctcaggcaatccacccacctcggcctcccaaagtgctaggattacaggcctgagccactgcggccagcctatgagtttcttaaacaagtaaattgactttcatcattaactttgtatataaataggctggcagttcttaaaatatcttaggattttttttttctgtaaaatacaaagattgacagaaatatatttaaatatagctaacaacgttaagttagtgaggcttaactttttccctttcaccaatcttcaaaatgttttaaaaataaaaagaaaccagttaaagtgtttttttttcccaagggagaggataatatattagtaattccaagaattttaaagcagatattaggcatttaaaaaaaaaaaaacaatagttggacacgagacttccaaagtacggtcattttcaaagaccacacaactgaaaatgaaaaatacatatttccaaatgtcaatattgtgtttaaaaggtaagaaagataaaactatctccacattctggtcattaaaagctgatccacaagtggttttctacctccctaaaacacataaatacaatttttaacaaagactggataagaactcttgcttctcacacaaacccccaaccaccatcagtagtccatgattttgtttgaggcaaggtttcaagtgaactaatcatctattcctaagttgttctcaccaaaacgtgtgtatcacatatgttaagtggaaaagtaacattaagaatgggagtaaagtgaatcttaacaaatgttcaattacaataggagaaacaaaggctaccaggaagcatacctgtggcagggctgaattgagctgtctctggagtgagtctcggtcatagatgacatcctgaagtctttgctgggcaagtgagaggctttcctgggtctcccgaagggtgtctagaagacgatccctttcatctagcatattcaccatcagctgctcaaaatgggagtctgagtccgagccactgctttgggaccccctttggctcattggggtgtcctcattaatcgtgggcatcacttcacacatcattgcttaaagaaagtaagtgggaaggagtcttagtaaagaaatgatttccaataatttcatttggagagcaattcactaaatatttttcagcttattagcctatttgtctctatttcccctacctgttgccccaaatccagccaagcaaaatgttttgacctcaatgaaatatgatccatttacttccttcagcctaagtgctttctctttccatgacatcacatttatcccacctcccatatgcaacttggtttcacctgtttctcaaaattgttgttcatgatttatcccacctaattcaatttacataaacatgtgatttctattattatttcatcacctttcttatctgcaagtttacaaatctcttacagcgaatacttttatgttacccttatttgttattactgtatattattaatggcaagcacagtgtctggcatttaacgggtaggaagtaaatgacttgaatgacttaggtaattcaatgatttaaagtttactctttcttgtagaaaatatacaaatcattgagtatttattttatataataatcagcttttactttgttttttagtcaaccgatttttttcaaactgactagttttaagctttctgacattacattttccattttattacttttatatgctctctccctgaattcctacgtggtctacccagagcagataagtgatactgactgaattagaccaaaaccttatgaaataaactgaggtatataaatttgtttagagcattatactcatcattacacttaatattccctttttcctgttaactgcatggtctggttttcatccaaacaatacaaactagcactctttcaaatattccgcaaaacagatgtcataaattatattagctaatgtagtaacttcacatctcaaccgccaatcacaagttctcagtcatgaaataaacgaactgttttcagaatatttttaaatttgatttaaaatagacaaaacacacttaggtgcatgattgaacaattatgtggcaacttaaaaatcagaaattatctcattttctctttcatcctctagctaatgtttcaaagaaaagtcaaactcatctcaattttggttgttgtactatggccagcagctattaattagatggcttggttttgcaaaaggctgatgtaaagaaaggcaggtttggctgttgatcctgaagcactgtttggttttataatgcaaggttaattaatttttctgcctatacattcctgtccttggggaaaatatttctggtgatattttcaaatagaatgtcaagatttaacagctcaatatttaattactttttatgtgagtcttcatataaattgggttattgaggagcgaaattcaattatctgtgaatgatctggtcagggactcctgaaaactaagaaaaacttttaaaaagtatgtaagtaaagtattttgtgattgataacctatattaaaaaattaagggggtcattgaacattaggaaagttttaaacgctttgaagttttgctcattgctcataacactgagctacctgaaggcaggaatttaatttgttcaattttgtatgcacactaaaatatataacagagaacacacataaaatgaatataagcacatacaccctgatacccacacttgatactactgttacacacttaatggataaaactgtttcttgcatttatctcaatttgattttcattcaaagactatcacaaagatggaaaatacagactctttttagatgcttcaaattttctttatattaattgaaaaggaattggaaaacaacaaaaagtgttccaacacatttgattatttaaaacgattagttagcaggccatgcatgaaacctacacattgagccgctatgtcattctgagaaatgattaccaggagccaatatgtttacttttgacatttaaggttaaaacaaagtactgggagagcaaatcatagcatcatgacaatttgtgcccaaacactcacaacgttagggttacctatagatttaaattcttaaatctatattttaaattacgtccttcttgaatgaaagttattaatccctttccaccctgaatcactcagaacaactttaaattccaaggcaaagcataacagcagtgaataccccaatataattttcacctgaaaataatatcctaacaatccctcattgttaccatgggatataaacattcacaaactttagggtcttaaatcaacattaaaggtagtcttcgatttagtcaaaagatgctatgatgaaaagtggcttagggacttagaaagtctattaaatctacactcaaaagaacttgatttgattccactcctaaggcaggtgaaccaggacaagttactttacatgttaaaactttagttctctctttcatgaaagagggccaataatctatgcttagaggaaaaaaaagaaaatatataataggttacctgactgagaacacacagcaaaacatataaagggcaattacaaatgtaagtattaatttctattataaagtgatcaacattaatctttgtagaaacaatattttacctttacgactcattctgctgctgtaaaggtttaattctagtagatacttttgaactcttcaaatccaatttataaaaatcaaattatgcaaaatttacttaggaaataagatgaatatatgctgcttataccttgcagtcaacccaaatgagtaaatccaaagtcttcttatcaaaattagaaaaaaatagtctacaaaaaaataaggccactttcatgaactagcttagtttctttcattagaattcagattctaacataaattacaaaatatttgattaatccttaaaatgcagtataacatttcttaaatgcacattttgcacattttaagtattaaaagcaattaaagatatatattcaatataagagttaaacacccttttaaaaaatggatgacatctgaagcagcttgcacagtccggaaggctatggtcattcaatgtctagtgcgtttcacccagatacatcacttttaacttttataatcagtatcaatactaaaaactgcattcatcacataatttctgaaaagccagaaagggcattttaacaatttgccttgatatttgctttttcatcattcccccctcaaagtcaatttgatatataaattatgttatcttcatctagatattgatgctttcctcattaaattactgaaggttttgaaacctagtcagagacattgttaattttgttgagaaagaaaaaaagtaataataaatctgattggcttaattatcccagtgcttaaatttagccggaagaattttatatcaggaaaataactcctttattcttagcacatagccttgactgtcttttaaatttctcagatttcaaaataaaagtttgaatgcccactggagtcctcactcaagggctttcaagatccaatgtgttccttaacaatatatgccatccaagcagtacctcttcagatatgagagtgctacaaaaagctttttttcttttttctgtcaacaaatgactttatttaatcatatcactaggaattcggccctactagaggtaagaatgtaattattatccatagtgagtttcttctgaaaacatttagtcttaagaaccatcccagctccacctcagttaacctacaaggagtaattcagtgagagaaatcctagccattgtctgattacattacatgaatattctccctcctatttaactctttgaaagcctctgtcctcgggaaatatgattatcacctttaatggacacattttacactttctttaccctagtgcatttacggacagccagagccagctcaacccacactactggacagttatctctcagccacaccccccaccaccttgaagaagttgacttcatcatttccacactaaaattgttcatcctgcccaacaggacacagccaagtaggcaggaggtagagagataggagatggagaggatgaggtgaaagcaaaaggcacctaacggtaatcaacaaggaggaatttgcatctcatcttccctgggggcggggtggggccggggaggtggtcaaaaaatacagcgaaaggagacagtaaaactcaaagacagcttctgtacctaatgtctgtgatttcgggtccttgcttcttcaattgatcaatgacaaccgcagtctccggcttgaggagaagggaggctcacacccagcactcctggaccatttccctagcaacgggaggagaaaggcagctcagacacacgcgtgccccggcgccctcccggaacgtgccccggcccggtggcgtggcaggagctcggcatcttcccgtggctccgtcagcagccaaaaggagaagcgtccatcggaaaaatggcatattacaaattttgctttgggaagcaaagctcggttcagaccattgtcaaaggaggagagggggaggcggctcttaaagcagccgcggcccctttgccagaacagccgcagctccccgcgtgcagctggagccccggggcggagaccggagaccggggactgggtttgactttcagaaacttaaccacgcggcgccgctccccctccgcgcccgggccacccggggtgtgtggggcgtccctccaaaagaaagcttggagaaaaggcgtgagaagtatctgggagagaagttctccacccagtctcccctcctggagcccctctggagtttaaggctaaccctgggagttagaaacctaaaggaaaacgagtccctagggatgcaaaaagcaggacaggtctcctcctggcccccagcctgtttccgcgcgctcccgtgtctcgtttcacttaaaggaggcgctttttctctggaaaggcaaacatcaccccacgccgtcccccggccccccttccctcccccccgccgcccccccgccgccacagcacacacacccatttttctcctcccggcctttctgcaagcctctttgcttgcttcaattggccggaagaaccaacctgctggcagccggtgaggacgctacagcatcttctctcctcacttgcctc
